United States Patent 10,407,724 (METHODS AND COMPOSITIONS FOR SCREENING AND TREATING DEVELOPMENTAL DISORDERS) - sequence listing, part 89

SEQ ID NO: 2601 - DNA, 466634 bp, Homo sapiens
tttgtctaagagtaaacggtgtttattttttgttgatttttttcaatcaaatggaattgcttaattaaaaaaaacttatctcttttctccttaaatactacagacaacctcattttatcgcagcagacacctaggaacaaaacactggacccaccagagaaaactgggcaataaaagcatcagaagttcaagtcaactatggaagaattactgttagctggcagctttcaattctaaacagaagtgtcccaaacctattgggtttgacaaaagtttcttagaactggggagctgggaatgttggactccttttaattctattccaatcatttcctgtatagggaaattaaagtcaatgcatcaaatgaagacccaaagaaacatttaaaaacttgtttgactagtattcagtatgtgagattattaagtaataacttgtccacctagttaaccttgtcctggaatatatataggttatttgtagccgccactgctataatattttctgaaggatgccaagctgtatgcaagatctttttgctaaagtccagactgtcgacactgatctcgtcttttctccgcttgccccccacacacacttttcggggtttgaggatagcccggggcttgctgttttccctcgaagcctcaagggtcacatcacgcttggtgtttctgtcgaacatcctgaagaagttgttgtaggagcctgtcatgatgacactgcaaggcagagagcaaaggcaatgacatatcttcactgtcttttctttttggagcaaatgataccatgttatggccagcttatgacaccataggttttattaaaaacaaaaaccaaaaaatgagaacaggctctgcagtgtgattattggctttttgttttttttttgtgttttttttttttttttttgaatcactgaaagcaataggatttttggctgggtttggaaatgagggatggtgagaactctccttgtaatttgcttttgctcaatagattctttttgcttctttggctcagaaaaggtgtccactggttttaatgatcccagtcctacctacctcccatcaggaatgtgagactagaatgaggtttgtcgaagtagacacacttttgaaaacaataagcagttgtacgtgtttaaggtttggccactgtcaacagggttcctgggccgtctggcctctaaggcttcatggcatcagtgcagtgaggggagagatgctagtggcatcgtgcacgaacccggggcgcgacctctcccctgccgagaactagctctgaattcggcctttttagaaaacttatctacgaaatggatgtcatcatggtcttatctaggaaacaagtaaggaaattcaaattttaaaagaatctgggatggagaaataaaaagattttatatggtttttttcccacacttaatggacagatggtttccacatttttataagttatcccctcttaggcatagctgcaatcgatcaggagagtggcaaacacccaatgtcttccagaggcaaggtactgaatgtttaatggtgacatttcagacacggtgacaagctgaggtggggagggagagattccttgggccagggcaagtaccccaagtgccatcacacggtggttcccctggagtggggggctcctactcatttctgggtggagctctgactggctccttaagatgggagagcaggaactctcgtgtatttctcaaatgatttgggatgtgtagagaggtgaaggaaaaagctgacaagattgggccacagcaagggggatgtgtttttgggcacgttgtcacctgtaccaggtaaattaagcaaaggttagattttgttactctggctcatcaaactgatactgtgaactgtgtctgtgtactcgagtggactgttatcaccttgtcaggcagggcgctgagggctttgcctccatgatctcgtttcaacttctattatcccctaaaagggttttacagagaagtaatttgctcagtgtcacattgctaattggtggtaaagtccaccctcaaacccacatatggttgactctggggcataagtattcagccggttggcctcactgcttcccatactttgacgtttgcttgcccaccatgacccgacttatttttaaacaagtaagagattattttccaaaaaaaaaaaaaaaaagactaccaaccttatctgaaagagaaattaaacttcccagttgtgatgttatagaaagagtgttgatcttaggattcaaactctaaacttgttacttttgtctctactacttactactttatgaggttgggcagattactttatcttgctaagcctcagtttccttaactgtaaaatgagaacgatggaagcaatcttgttagactgtggttgggattaaataaaatgatgtgtacgaatgtgtttggtatatagtaggtgcctaataagtgtaatttttgaatcaaggctaagatagaggaaaaacttgagcaataataacagatatgtaaataataatatatgaataaataaatacctataaataaataataaaatgagagggctggcttctttttcccatggtggattttgttcttatgtcacagttgctttgctctctgtcctataccaactggtcagtgtgacttgggtcctttgccacgtggagactccttccaagcctgctaaggaggggattcattttggatcagtggcaaagaaagccaagaaacaggtggagtgtgagagagagacagttcatattcactgaaagcttgaatctctgaatgtcttgccataacagaatttctatgctttcaaacactattattggtgccaccttcatcaaggaacgaaatcagcccctggtagcttgcacttagttctcatggaaatcagagaatcatttgtatttgtcaaactaaaaatgaactattgggaggtattatgaagcactgttcaaatcaaaggccttaaaatagtaataaatcactttgagggaatgtgataaatgaggttgactagaattcagttaatgaactaccagggccgttggccaggtctccactagcagcttcaagggataatttttgatctggaaagcctacttggcattaatctgaactgttcaggctggaatttgctggtggataagtgatcttcatttaggcatgttgacctagtgctggaggtgtcttgtgtgaaaaagataggactttcttattaacattaaggtgttatctgtgccagttcagaaacaggattcaaaggccttactacatccttctcttctttccagccttgacttcaagggtcactaggggcccacattatgcatttcagccaggttttggggcccaattttgacctccctttggctgtactctacttaggataaattccctgagcctcttcaagacaatctttggaaggttcttcagccacagagcctttcttacctgtctgacccattccacacacactcaaatttatcaaaaatgcagtcattttcatagagggaacacagcttgctgcggaggtagtcatgaacctggagaggaaacatatcgagaaggtcagttattattttaaacagtaattatttctgcaaacacctcctcttctgatgtgagctgttaaatctttcattgtacatgctctttgaatcagatggccttggatctgaacctaggcttggcccttttagctgtaggacattaggatgggttgatgagcttctcatgtagatgatatggattaatcaagcttgcttgtatagacagtggcatccagtaagactaaataagtggtagattctcattttctaagctgatttgctcacaggcattagagatcaccattcatgcagtcttttattcaacaaatatttactgaatacctactacgcacttgagatgcagcagtgagccaaatatccttgcagtgcttttgacccagtgtcaggtgacagattatataaccaagtaaataaataagatgtttagatggtgataaaatcatagaacaaaagtgtatggaaaaagagcctgggagatcttgtcgggggtgtattattttatacagggcaagtagtcagggcttcactggatgaggtagcactggagcagaagcctgcaggagatgaatgagccacagtgatgtctgggtttggggtgaggggaaggctctccaagcataggaaacagcaaacataaaggcctagaggcaggaatcctggagggagtgtggtgggagaggagtgagtaagcagctgggggagaggatgatcagtttacataggccctttattctgaggaagaagagacctcacagaaaggattgctgaatctgctgtgttgcaatggatcctaagggtgcaaaggcaaagggagggagaccagttataacctgagtgatagattctggcctggaccagggcatgagcagtgatggggactggtcagattctccttttgtttagggaaagagcagataggacttgggtcaactctgaggtgtggagagaaaaacaggagtcaaagatgactccctgatctttctcctgagcaagtggaaggagtaggtaccatgttcacttttgggtacaatggtttagagatgtctacatgtggagctgtcgagtagactctgaggtgaaaggtgctgtcctggagtatgtggcgattctttcctggtttctcttttccagtgaaagcagccagcatggttatcaactaagagtgagcaggagagagaaagggttgagaaacagtgtcagatttctggaaggcaccaggggacacttgacgttgttggacatgtatgtcaaataaggctcatcaagcatagttgaatatttttctccagctacattcagcaactcagctgtagatgccaaatagatgaataaggttcagagagtagtagcctgggttctctgttttgaaggtaatccttcctgaacccactagcacggagtggcaataataacgggcatacccaatatgctggcttgtcattattagccaggtgctttatctgtcaaaacctcatttcatctctaaagccatcttatgatgtaggtactttcattctctttactttaatggagcatgaagcacagagatatgacatcatttgtccaagatcacacagaaaaagtgacagaaggggagggaactgagccccggtatcaggctctggagtgcacactctgagctgcactagcaacctgcctccagcttgctctggtgggtcctcagtccttgacaggagctgtgataatgaactcaagtgaggctgagagagaaggagatagaactgtgtgaaagcagagggaggctaccaagggcattggtgtttaagttaagagtgatgattcgatctcttttttcctgcaactgcggctctttctcttccttcgactccaacagttctgctggatgcagagcttcaggctcttagtcttgggcaaaggaacgaggtcaggctcatcctatgttccattagatgttctgggtatttgaaaagctctgagttatttggacagaggaagttatttctaactctgcaaattaattttcccccacctttactctctcacttccaaacagttccaggccttgtcagggtaacagcttcagtgctttggtgacaagggaatacccctacagcagtgctcttggcattgttaggtgcatttgggggctgcaagggtgaggctgtgtcctgcccttacagaggcatctctgctataaactaactcattcaccttcactagggggcacagcagtaaaggtatataaactgggcagtggcaaggtttttaaggtctagttccatatgtctgctttgtgatgaacctttcctcatctgtcaccattcaccttcggcattttgtcttattactcacctgcagtgtttctataagtgtcaaaacatgtgtgctttggaagtcacgcccattagcaggaatgacattgctgagaactctgtaaataattcttgaaagatagaagttgggatagattcaagggaaaacctagtctgaaccattatttctccaccatacctaaggtctgggtagctcctatctgcctccaattgacagcatttaaagaaaaagaatgtctactatgaaggtatgctgtatttatgttttgttgcacagaaaaaaagtcttcttaggcaaaccagagggacctttttctactagaggaaagaataaagtgagatgtatacatgagcaacctctagagcttggagcaagagagaacttaaaactcatcctatttgatgttctttcttcatgttcctagtatgacttttctatgatcctattaatttgtgcatgggattttggacgccagactgagtgtcccagtacagtgtttctcatatttatttgtgggagtccagtgtcatatagttagtggactgctatgaggcaaacaaagagccaactctattggtccgttcttatatttcaagtgttgacaaactttttctccaaagggccggatagtaaatattttaagctctgtgggccgtatggtctctgtgacagctactcaactctgccattgtgcatggaagcagccatagaagatatgtaaatgactgtacatggctgtgtcttaataaaatttacctacaaagacaaatagggggctggtttggaacacacgttgcagtctgccaacccttgttctatggaaaaacttgaaaatagctaatcatacttaagtctgcagccttttattcacggaaatgtgattgagatctgtgaatgcatgtatgaaaatgtataatagtagcattacctgtctccttgcccagggcaggcattattaactgatctttcattaactaatttctttcccactggacctcacaacctattaactaatttctttcccactggacctcacaatctatcatggtgttctggaggctcactgaatcagagtttgtttaccatcatctttaaattacttcacgtaaaagctagctggctgtgttctaaaactagctttgtcctaaatctactcttcctagttaaggctccccagcagccacacatgggtcctagttcccactgccctttcttttgcattaaggattcgaatcctgtaaggtttgtcttatgcagctggaagaggacactgaggtgactctagtcctgggctaaagatgaagggctgcaaatgaaagcttgggggcaagtgatgtggagccaagccctgaagtcgaggtaggattcaggagacaggaacactaaataacagggagtacgatggaccacaggggaaacaaagctatctccactacatatatggctgtgaattctggctcccaaacctttctccagccctgctggaacacagagtcatcaaagtcttcaacctcctctctgaacctttccttcttcttcctctgactggaatttggatctcctctgaagacactcaagtggtagctagaattttgctgtcactccacatgccagtgttgggtagctgggctccttgttgctccagacaactattcctatttaaagtcttcaactcctttgaagtcatgccatcaaactaagcttcctgctacctgtccttctttcagccatcaaaagttctgagtccctaatcctcatcccttgaagcaagtttgtatctctgtctctcttccattactattcctgccactatttttagttattcaggcactctagtctctctcttacatggtctcatctattcaatgtgttttgtcctttgcttccttggtcatattatgaaccttgtcattgctatccctgtacctgtcattgctatccctgttgctgttgttacctcctgtctttttagttcactccttctagtatgttgattctatcaattcttaaaattcattatttccccttttccctaccttcgattcagcagtacatcgttacaatcaatcactcctttagcatatatattcaacaagcttgcctttcttgctctctctttccattgtactcatttggcaaaactccatcactggttaaatcttactttctaccctttgtttacctgtaccaagcaggtgaatgtggctgggaagaaacataaaatcatacaggttaatttccctttaaagcaattatatagatttcaagtggatccctgagcaaccctaccaccctacaacatttctcttagatgagtactttaccacttttcttccttcccattcagctaatgaccttactacttattttactaaagaaaacacctacatgttcccatcacaaaattcacaaacctacttcatctatataagaaaactactctccttcctttgatagatgaattatctttgcatcttaccatctacagccaattctgcaatggactccatcccctctggcttcccccaagggctttgctccttcagcggtctctctctaatggtctctctctctagtggcttattcctatcagcagaaaacatgctgtaataacttccttcagccagaatcccatttcagctacccttccatttctctgttctccttcagagcaaacttgttgaaacagttgtctgtcctcataatgttcccatcttcagtttcttgaactcactccaattggacatttattcacactgctctactgctgttcctctgtcattcaggttactgataatctccacttactaaatccaagttcgtagtcttctgtacttgattcagcaaagcatttggcagttgatgacttatttttccttaagacagtttctctatttggcttcctagtcactcctctcatctcactggctagtttccccaaatctctcttgccaaatcctcttcctattctcaactaggtcatattttctgacctcttctttaattatactaattgtctagaagatctcatccagtcctatggctttaaataccctctacatacttgtgagtgtcagatttatatcttgaagctaaatatatccagactcacattgaagtgtctacctgctgtgtctgtttggatgtttaattggcttaacagagccaaaaccaaactttcgattttctcatctaaataacttggcaactctacttttctaattgctcaggacaaaaattttggagtaatccttgatgcttctttcttttcctgttatatcccgcatcaaatttgtcctcaagccttattgcttttaccttggagatatatcaagaatctggctaccttcattgctaatacactcatctaagctactattgccgcttgccagaatgttataactattctcctgtctcttccaatgtccctcccacagtttctcctccccagcacaaccagaatgttcatttaaaaatgtcaatgatgaaaatgatctggaattagataatggtggtttgtgagtaaactaagatcattgaattgtgcactttgaaaggctgattattatgtacattatatctcaaggaaaaaatgtaagtcaaatccttctgtctagaatcccccacttctttttatctaaccccaaatagcttaaaatagggttagtttatctccagcacttgatctttgctttcattatactcttgcttggacctggattttgcttctttaagtcctctctacttcaaagtctggtcttcctctttcaacaaaaccaccctatacaatgccttttcctttgtttccttgcatttacaccatccacccaacacttaaatccaaaacttccacacagtcttcttgattccctctccctgcacatttgatcagtaagcaaacctcactgactcttcatcctacccatccttccatctgcacgctaccatcaccagaccaaattgccatcatctcctcttatctaaattgtctgtttggcaaactgcaaagtgaaacacacagtaaaaagtaaaactcacaatgttatttcctggtgtaaaactttaatggtcctccattgtacccagtccacaggcaaaacagcctactgtatattaccagggcctagtgatcagccccttgcctctatctccaggctcatccttctgcctttgtgattcatattcaaggtgtaagcaccctgaacacacctcatttctcttgacaccaggcctttgaacacactgtgtttttaattattacactgtaagttctgagatacatgtgcagaacatgcaggtttgttacatatgtatacatgtgccatggtggtttgctgcacccatcaacccgtcatctacattaggtatttctcctaatgctagtcctccctgagccccccaccctctgacaggccccggtgtatgatgttccccttcctgcgtccatgtgaacacactattttaagagcatgcatttcctgactagttcatggcagttaagactcagtttaagggtcacttctttgggaaaacctttctcacctggctggaccatctcttgcagagaggcacactcaattccttgttcatcatctgacttttccaccagatggtaagctgcatgagagcaggaccatttgtttacctctatagtgtccattccacatgaagtgctctgtccatatcaattaaattgaattctagcctctccacatgtaccgttatcttaaatcctgtggcacttatagcctgtaccattttactgaatgtatcaccatgcattgccttccattttgctgcactgtaaacctttggaagcaggggctgacttaaaagctcatgaagggaatgttcaatatacctatgggtgcctggggttctatacctggtaagtctcgatggggcggttttccatgttgagatcccagactttgacggtcaagtagtccctggtcatgatatacctcccactgtggctgaacttcacatccgaaatcgaagagataatttcagagaaaaatgatctgttgcttggatcttccggctcttcaaaaactgcagaacaaaagcaaaacaagacaaatttagcaatccttatcaactgactctaacatgtttggactggctaggaagctgacagtgtaactgagagtcttaagtagggctggtgtctgcagaatgtaagttgctaatagagaactgtcatctctctggtagcggaaaaagctgtcattagtttctggattttaattctcatggaaggactggcatgggacccgtcccatcatagatctggcactgacagatctatgtatctaactctgtttctgtttcccttggtatctgggtgtcactgcacaaaatctggagtcatgttaagatagttaaaaaaatttgttttacagctttagtgagatacaattcacataccacaaaatgtagagttcagtagtttttagtataatcacaaaatcattgctataatctaaatttagaatatgttctttacctccccccaaaaactccatatccattggcagttactttccattccctgctcctatagtactaggtaaacaccatctactttctgattctcattctggaaatttcacataaatagaatcatagaatatatggtcatttgggactggctccttttacttggcataaaattttcaaggttcatccatgtcgtagcatgtatcaggtcttcattcttcctatggctgaatagtattccattgtatgaatataccacattttgtttatccattttatgagcatttgagttgtttccactttttagctgctaggaataacactgctatgattatacatgtataagtttttgtctggtcatatgttttcatttctcttgttggctcacggtgtttaatagtgaaactttggccaggtgtggtggctcatgcctgtattcagcactttgggaggcctaggcgggaagatcacttaaacccaagatttcaagaccagcctggataacataggaagattctattgctataaaaagttagccaggcatggtggggcatgcctgtggtcccagctacttgggtggatgagctactattgggccactgcaccccagcctgggcaacagatcgagatcctgtcttcagaaaaggaagaaataaaaaaagtggtgctttcttactggactgccttgggtctaagcctgtcatttacttgttgtgtgaccttaggcaagatacttctctgtgccttaggtttccttatatgtaaactgtaactatgatgtctttttaaaattaacaaaatttctaaatttgtataaacttaatgggtacaagtgtggttttgttacatagatatattgcatagtggtgaggtctggacttctagtgtaaccattagccaaatagtgtacattgaacccacaatgtcttttgtgtggattgtctatttgcactgatatccaggttcttattatctctctcaatagcttcagctgatttccacttacaggaaaaaggcatggcttctcagtatgttattggagcccatcacaaactgcctctaattctttctaccttgattttaagttggatgtatagagtatatctcgatatttcccacttctattcattgcctgattctttcttcactgatccaaatactctttgatgcatatacctcatctactacatattatttcaccccaaatgatcttttcttttctctgaagccctatcatgcttggtctggtcatttatttagtatttgctcaggtactctcttacaatggaactatcatttttcacattattattattattttaacaactgatgagtttgttttatctcttcaactaggacataagcttcctgagaacaggattttggtcttattttcgtattcagagtcttactcacaaatgttcaatgaatatttgttgcttcactggagccaaagccagataaattaacagattctttgccttctgggtgcttagcatgtatagtattcagctgaaacatatgcatttgctgacattcaattatttttgacctacaaagatggcaattgtgtatggctaaaccgaataagggtttatatcacaattttaggctgaaccaaacactggcctgcaggttgctgagttaacttatcctccaagactacttctttcctgcctgctcaatgcactcgcatagtcagtaatgaattctatataaagaacccaagtatataattaagttgctgaattaaaccgtgaactaagccaaaacgttaattttcacagaaccattgaagagaatagcaacaaaagccctgatcaatcagaattgaaattgcaaaaattttaaaaaaatcattgaaacagaaaaacatggcttattacagcctctgacccaatgtcttagtctctgccctcagcttttgggcttcggctgagtattagtgaaggcccctggattctgattggtatcttcatagttgagaactagataggaagaaaattttcacattagtttcaactaacagctatgtcattagtattggaggtttggaaattccaagtaaaacacctgatccagaggcagtaaagtggatgggcttagtaaattgtgctctggagtcatcaattcctgcctctgtcagttactagccatgatcattttatttactactccagctttagttttcccagctgcaaaaagaggagccacattgcttggcatataagcttggtacgcagtaggtcctcagtatatgccatcactattttcattttcagcatgcactgcttctgtgctggccagtcatatctcattcaacaagactcttgagaatttgggaccaaggagtacagaacctgcggactatttgaaagacataaagaatgtttacattttctcttctttaaactcaaatctattttataatgtttaaattgacaacaaaattgtatatgtttatggtgcctttcaatgttatacataggaatctgtttcccaaatacttggcatattgggaagccagtgcagcaacactgtaaagcctcacaatgacaccttcacaagatggatgtgaaatgaaagatgacaattcttcaatcaacctaccaccatttatttgtggagtgccggctttaggtagcacacagagggcaaggtacagataacataccagcacagcactttgtagttcatgacatatctatgtatattcaagttttaatagcagctccaggaattattttccttccttgggtaatagcatttaatagtattaataattacttttgatgggaagcttataatactgcaggccctgtgctttacatgttttatttcatttagttgttaaaacagcctatgaagtaggaattatgattcttcattttatatatgtggataactaaggcacagagaggttttataaccagtccagggacacactgagatagagctgcattttgaactcacatctatctgacttcaaaatctttgttcttaatcatgatgccatgtagaagaccttgctgagcattcatttataagttaagtgtcttgtatgcacaggcacacacacatgcacaatatagtatattagctagagtccacaagtaaaaagtatttcgatacgtgccaggccctgtaccaaatgctaaagacacaataatgaacaagacagatccagcactactcctagtgagctcacaggatagaggaggggacaaatgtttagcaatcacacaaatgtggttacagttgtgaataagtgtgattttactgtgttatcagacggaaatcatggtgctatggaactggctagtggaaggtaaatggaacaccagtgtgtgttccataaaatttacttctcatgccccctgcaatatcagagatgtgcaaaatttgttgaacaacagtatctggtgcctgagtgatagaacttaggacaaatcaacactagcctttctcctggagacccttggcttggcatgacagtagagaatctgctgacctgcaaggtttccaattagctaccagaaaatagagacattgagaggagagaggaagagaactaagggagagacaagaagagctttgctccctttgtaaggaagcagtcttggtgagaaacctgatagcccagtcctagccactgggggtatgtcaggttcaccaacaggagcgtatgtcttggagaccccaatagtaacagtaacaacaataatgacatttgctaccacttcttggtcctcaagctttaaatacattattgcattttaatgctcaaacttctaaggaaggtactatcactcttctcatttgtagataaggagacagaccaggaggaaaggttcagtaagtcaccaggatcatgcagctaggcagtggtagagatgggctcttgactctgcccatctgtcacaccacctccacaacagggccttgccttgctttgtcaatattgtttccctgttcaaacaagtcaaaccaggattcctcacattctagatataccttgtatagtcccactttggtgcctctgttgctcctcacctcttcctgtgcccatccaggtacactggaaagaacatcagactcagggatgctgggctggaatccaggctgggcacaagtccaggctggcttttgataatacctatcatctactgagcttttgtgctgtgtgctctacatgtattaactcactcactattcataggttttagtacttttccacaaattagtctaatcagtcaactcaggtacaactcacagctagtaggaacagaggcagaatttgaactcagtatacttccagcttatgttcttaacctctgtcctactctctctcatctgtgtggctttcagcaactgtcaactctctgaccctgtttccttctctgtaatatgaaggagtaagtgttgcctaccaggtccctcccagctgttggattctaaaatctatgaaattccactggcttttccatttccctttcctaatccccactactctaggtagcctttccaaagtgacttcagcaaaatgttcaacctgtgatatgtcaggcattccagattccaaagtcaaataagcttgggaaacctcgacaattttgggagttgacaacgcaattaccctattgttggggcattatagaatgttcagcaacatatctggcctctactcactagatctgccctgctgactccatctgcccacatgtggcaaccaaaatgtctctagatattgccaaatgttccccagggggcatgactgcccctggttgagaatcactgctttaatcctacttcagagtattatttgatcatacctttctccccactccattttatttttatttggcaaatcatttgcagctcagtgtttttctagtacaggcttcctcagaatacactttgggttatattgctatagtcaaaacaactgaatactgcctttaaaattccataggctatcttatgtgccttgtgtagacgtgttttctgttataacatgtacagatatgaatagatctccatggagctgtaagtatcttgtgggagccccctgaaagggctcagatgactgggtaaataaataaggttccagaatctggggaaaatcttgaattcagttattcaagaattcaaaaataagagaaagaattaagaagaagactgccaactttagagaaacctaaagtgaaacagcattcattacaactggagcaagggcagaaaggaggcatgcagtgagctggttgtggactctggggataggagaagagagagattaggtaaccacaggtgcaggctgttgctgggtgtggctcctttctcttgaccttacactggaccttcattaatttcacaggaactcatgcccatgtagaggggttaggaggggcccaagaccactaacagctgatcctgaaggcctgttcactctgtcttagatggtgtggtgactaacagtataggtggttccaaacacagtggcctgggttgaaactccagctttgctgcttataaatgatggagctttgaacaagcagcttgactccttccaagcttcatttaatggagataatagtagtacctatgttctagggcggttgtgagaatagacgagatcttgcttgtgaatcacttagcaaagcgtctgtacccaaaacaatagggaaggcagcagtaatgcagaagtaggcattgcttaaggcaagcttggtgtgcaatgagtccaaaagcctagtgtttttccgtttgaggcagatcttaagaaccagttgtggtactgatttctgggttttctgtctgggctgcgacacagacacatactagcttgtttctgaactatcccttgaaatacacctccttggtccaagtgtctctcatttcaatgtcacccccaccctggctgtgatgacgcgggcagatgagagtgagtgtacaggaaacaagccagtgggacatgagggtccgctcacgatgaaaaaggaacgggctcggaatcatgcgcagggctttaaattgctcacttttgctgacatttcttctacagggaagcacggctggcacgttcttccgtttggagacatggttgacaatttctccataatggggacacaactggcaattttcctacagagtgaggcagatggcaattttccttcagagacatgcaggcaacagttttgcccctggagagaaaagcctcgccgattgagatgcagccagtaatttttactatacagaagacacatccaataattttgcccagtgagagaaacggccaacaattttcccacagagggtaagaactccctcggactgacaatactggcctttatccagctgaggacagtgagagaagaggtttaagatttaattagtggctactgtgctaccaggggcctaatgacatagtctccagacacagattggagactgcaaatttagatcgtattaagactcagatgaaggattctgaattgggaaataatgaaaccaagttgcttaacccttgcagtttgcttttcatatagccctccattaattcaacaaacagttgtttgacagtgacactttaacaagacaaggcatacaatgcatagcgtgatgaagaatgaaaagttaatctagaagaaattatattggtccctaagttttacataacttttcaaaataattctgcatctactatacttcttttacaacatgtcttttaacaactaatcattcattcaaagttaagaaataatgaatcaaaaccttttcttttcccagacaggaaaaacagaccaaaaattcatagtggggagaagtgaggagcaaatgggctggtatgaccaagaaagacttaataagaagctgagccttaaatgatcaagaagcactggatagataagaggttagtacatattttagactttgagggccatctggtctccattacaactgtttaactctgcctttgtagtgtgaaagcagcatagacaatatgtaaacagatgagcatgtatcccacatgaaggctttgcatatggacattgaaatttcaattttgtataatttttatgtgtcataaaacactattcttttttgatttcttcaactatttgaaaatgtaaaaatactgttctttgctagagttgtaaaaaagaaaagttgtgagtcagacttggctgtatgccatagtttgctgagccctgataatggtgtttgaggggtaggagggggcatcctatctagacaggggaatcagcatgaataaatgcctggggtgatcaatgcatttttgtgggacagtgggcccctaggactggtagcaccatgagatcatgtagaagggctggaagatgagatttctgcttaaactgcaaatttctttcctaaactacatctctcaggatggtacatggaatgaacttaggagtcagacatattggggctagaacctgggcttcatcatctccaggttggattgtctttgtcagttttccttatcttgttaagacgcaacttatctttaaaatgtagacatcaatatcttatttgcctggttataaaaatgaaaagagataaaagcaaataagacatgtagcacaggacaggcatggtggctcacacctgtaatcccagcactttgggaggccgaggcaggtagatcacgaagtcaggagctcgagaccaacctggccaatatggtgaaaccccatctctactaaaaatacaaaaattagctgggcatagtggcgcatgcctatagtcccagctacctgggagaagaatcgcttgaacccaggaggcggaggttgcagtgagccaagatcatgccactgcactccagcctgggccacagagtaagactctgtctcaaaaacaaacaagacatgtagcacagtgcctggtacactgtcagaagtcaccaagcccatatcgaacatttaaagaagaactaatgtcaattctactccaactgttacaaaaaaatagaggagggaatacttccaaactccttctatgaggccagtattaccctgataccaaaaccggacaaagatatatcaagagaactataagccaatatccctgatgaatatatacaaaaatcctcaaaaaaatactagcaaaccgaattcaacaatacattaaaaagatcattcatcatgaccaagtggaatttatcccagggatgcaagacagttcaccatacgaaaatcaatgtgatatgtcatatcaacagaatgaaggagaaaaaccctcaaaaaactggatatagaagaaacgtaccttaaaataataaaagtcatatatgacagagccaccgctagtatcacgctgaatggggaaaaaactgaaagcctttcctttaagatttggaacacgacaaagatgcccactgtcaccactgttgctcaacatagtactgaaagtcctagatagagcaatcagacaaaggaagaaaaggcatccaaattggaaaagaaaaagtaaaattatccttgtttgccaatgatatgatcttgtatttgaaaaaacttaaatatgccaccaaaaaactattagaactggatgtggagccaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggtggcaacgaggctgggggaggggcgcccgccattgattgcccaggcttgcttaggtaaacaaagcagccgggaagctcgaactgggtggagcccaccacagctcaaggaggcctgcctgcctctgtgggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaacgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagagctctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcacgaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctccataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgactgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggataggaaggacctcttcaaggagaactacaaaccactgctcaaggaaataaaagaggacacaaacaaatggaagaacattccatgctcatgggtaggaagaatcgatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgtcgcatatctacaactatctgatctttgacaaacctgagaaaaacaagcaatggggaaaggattccctatttaataaatggtactgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtatggcgattcctcagggatctagaactagaaatcccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgttcacatgtaccctaaaacttagagtataataaaaaaaaaaattaaaaaaaaaaaaaaagaaaaaaaaaactattagaactgaaaacaaattcagtaaaactgcaggatacaaaatcaagatacaaaaatgatctcaacagcaaataatctcaagaaattaaacccatttacaacagctacaaattaaaaaccaaggatttaacttacttacccagagaagtaaaaggtctctacaatgaaaattaaaaaacactgatgaaagaaaaggaaggggacacaaaaaatggaaagatattccacattcatgaattggaagaatcaatactgctaaaatgtccatgccacccaaagcagtctacagatttaatggaatccctatcaaaataccaatgactttacagaaatagaaaaaacaatcctaaaatttatatgaaaccacaaaagacccagaatagccaaggctatcttaagcaaaaaacaaaactggaggaatcacattacctgacttcaaattatactacagagttacagtaaccaaaacagcatggtactggcataaaaacagacatatagatcaatggaacacaagaacccagaaacaaatctgtatatctacagtgaactcattttcaacaaaggtgccaagaacatacactgggggaaaagacagtctcttcaactatttgtgctagaaaaactggatatccatatgcaaaagaatgaaactagatcccaatcactcaacatatacaaaagtcaaatcaaaatggattgaagacttaaatctaagaccttagagcatgaaactactacaagaaaacactggggaaagtctccaggacattggactgggcaaatatttcttgagggataccccgcaagcacaagcaaccaaagcaaaaatgaacaaatgggatcaagttaaaacatttctgcacagcaaaggaaacagtcaacaaaatgaaaacccataggatgagggaaaatatttgcaaactacccatctgacaagggattaattaccagaatatagaaggagctcaaacaattctataggaaaaaaatatctaatccatttaaaaaaatgagcaagtgatatgaatagatatttatcaaaagaagacatacacatggcagataggcatacaaaaaagagctcaacatcactgatcattagagaactgcaaatcaaaactacaattagatatcatctgaccctagttaaaatggctttcatctaaaaggcaataatgctgatgaggatgtggagaaaagggaacacttgtacattgttggtgggaatgaaaattcgaaaaaccactatgaataacagtttcgagattcctcaaaaaactaaaaattgagctactatatgatccagcaatcccactccttatgtatataccccaaacaaagaaaatcagtatactgaagaagtatttgcgctcccgtgtttgttgcagcactgttcacaatagccaagatttggaagcaacctaagtgttcaccaactgatgaatggataaagaaaatgtggtacttatatacaatgaagtactattcagccatgaaaaagaatgagatcctgtcacttgcaacaacatggatggaactgcaggtctttatgttaagtgaaatgagccagggacagaaagacaaaccttgcatgttctcacttatttatggaagctaaaaatcaaaacaattgagttcatggagatagagagtagaaggatggttaccagaggttggggggcagggggaagtgggttaatggttaatgggtacaaaaaaatagaaaggatgaataagaactagtatgtgatagcacaacagggtgattatagtcaatattaatttaattgcacatttaaaaataaaggagtataaccagatcgtttgtaacataaagagtacatgcttgaggtgatgaatataccgtttaccccaatgtgattattactcattgcatgtgtgaatcaaaatatctcatgtacctcataaatatatacacctctgtacccataaaaagacgtcaacaagttctagtgtcacacaccatttaaacaacaggtattgagtacccagtgtgtgtaaagcactatgataggtgctagagttacaagagtgagcaagagatataccatgcctacgctccttcaacaaagagtggggcttcttatctaccatggctggggcttcctctcatctctctctctctctctcttttttttttttttgaagcagagtctcgctctgtcaccgaggctggagtgcagtggcgcgatctcagctcactgcaacctctgcctcctgggttcaagcgattcttgtgcctcagcctccccagtagctgggattacagacgtgtgccaccacgcccagctaatttttgtagttttagtagagatggggtttcaccatgttggccaggctgtctccaactcccgacctcaggtgatccacctgccttggcctcccaaagtgctgggattacaggagtgaaccaccatgccagccatctcttgctcaattcccctgtagtaggcagaataatgccattgcccccatccccaaatatgtctacaccctaatccctagaacctgtgaccacgttatgttacatgacaagggggaattaaggttgctaatcagctaaccttaagacagattacgttagattatctgagtgggctcagtgtaatgaccatggtccttataagtgaaataggaaggcaagagggtcaaagtctgaataaccgtatatgagaaagacaagactggtcaccgctgtctttgaagatggaaaggtgccatgagccaagggaggcaggcagcctctcgaagctcaaaaaggcaggtagccattctcccctagagcctccagaaaggagcacagccctgctgacaccttgactttagcccagtgagacccacttctgacttttgacttccagaactgtaaggacgttaatcaatttgtgttattttaagccactaagttcattaagtatgtgataatttgttacagcagtgatagaaaactatcctcctccgtttgtcaacaaagggagggctcaaagttcatgaattcccccttcaactctgcaaagccgctgttattatttccctgcaccccagggccagttccctttcagcagctgcccctatacagctggacagggaaggcaggccagagcgggctgcttctgggcagaggccatgagaggctcactgtccaagggagctggtgaaccccagctcagccactctttcctcccagcattcctgatgctggtgctgtacacccataagccgacacagttcagagaaaccagaacccagcggctgcaaaggcagagcaagccaaactcctcagagacatcagggcttagcagcagaacatgaaacgaccggcaatcctaccatgtgctaaatatttgaatcttcccaaagcaatgccactttgtgctcagacatctacagtgactctgtgtggctgatagccaacagtcctacccccttgtcctggttcaggggctccatatcaagccctaggtcagcattccaatattactctctacttcattctgctgaaatgctccattgaggtctgacccatctactactcatttgcaccagagttgaataactcctacctccagggtccaggcaggtagtgaaatagatgacacattcatgggtagcaatagggaacagtagggactgtggcaaactagagtgtccacaccctataaaaggggcagtttccacctgaggtcagcagttcgaagccagcctggccaacaaggcaaaaccccgtctctactaaaaaaaaaaaaaaaaaaaatacaaacattagctgggtgcagtggtgtgtgcctgtaatcccagctcctccagaggctgaggcaggagaattgcttgaacctggtaggcggagattgcactccagcctgggtgacaaagcaagactctctcaaaaacaaacccaaaatacaaacaaacaaaacaaaaccataaaggggcaatttccactctgctccggctgaatgcagccatgcagaaatggggctccagcacagccagactaatttgtaaggcctaaattttttgaggaactctaattttttcatgttagcaactaactaaagaaacttgagcgtgtgatcaaacatacgtcctctgtaagctatgcaggccacacctgtgacctgattaactccctgcagtgatgatggtgatgtctgtggtgcactggcatgtgctggggctggatccatgctccttccctaacctctccctgctcccctgtttctctggctcctattcaaccttcagggctcactgtctttttctagaaaaacttcctggacaatcttggcccactgcatcctttcttccttactggttaatttggccaccttctaatcttcctcctattatttttaaatattatctgttcaggattcacaatgagttaaaaaattttagttagggaattggccccacagaaaggcaacaccagtgacaacaagagcacctgttacctgccgggcaccatctagggtaagaattatctctatattatggctgaggaaacagaggcttggagagatagggacccaaaggaccatatggtctctgagtgagcccagcattggaaggctcattatctgtggggttagaactttcttacgaaggagactcagctggaatctgatctaaagaaaggggaagcgaaaacctgtgtttggcttagggttcgcctgtcaatctaaagactgaatttgggctaatatgtacagacaagttcattaattgtgggtctgtttgtctttcttttgtgaggaataatcatttattagccaagcgggactggtgcctttttgagaactgtcattctggaaagatattgattgaaggaggcctctgagcacattctctccagcaggcagccgtaagggaggcggctgcagtccagacaagatgatgagttggcagtgagcatctcgacaggagcctaatgaagaaatctggtaacagcgagggctggctttatgagcgctcatatttggtctttcactctctgcaaggttggtgagtggcaaaagtgtccatgggcctctacctcccactgtggaattacacattcctacagccagtgggctccgggaacccaatggcagcatccccaggcccctgggcccactccacacatcacaggctagagacttcttgtctgcctcctttctcacgtctctccccctgagatagcatgctctcccctccctccttccctctcataatttgttcccaacaggtagctttgtgcagttactccaagagaagcccgaactccctggggagcctctgcccaggtggaagagctctcgagtggctattattaggggtgattgctgggaagctggttgccatggcaccgcagaggccagtgctgaactcccaagctgccccgtttccaaggctgtctacataatcactgcaatgagaggcacaggcacagaaagggagagaggagcagctccccactgacagtgatctccctgcagagcaaggtgagcagttcacagctgagtacgacagcccatcttggcatgggccaagcactgcctggagggaccctggtgtgagctggtcactgcttcactgtcttctcatggatcaggcagtctgcctctgtgttcccagtactggttttctacaggaaaacactgctcctaatccactgatccatttcttaaaggttcctggagtttgcaaacatcgagtagtgatagtcttccatctgccaggcactgcgctaaactctttatggagacaaagaaatgatgctcagagagtcatttgcccttggtcacaggctaagaagaggcagagctaggacgtaaacccaactctggctctatggcatctcatatagcatcatttttcctccagtcctctgactagaaagggtggccccttcaacctggtgctgagaacagacactggcggccccacacctctgaaggcatggttccagcaaatagaaattggactggcaaggattaaaccgctggtttgggcttcattagctatgtgatctcaccaaccacagagaattaaccagagtggagccatctctttacagacttaacacaatgtaccgaggcaatgtggagaacagtcactgaatttattgagcacctactacctgctccagacatgccattaacacgtgggctatccttcccttccacagtcactctagaacttgaggccactgtcctctgatgcagagagaagaaacattttataatcactgtagacaataaaggctttatctgttagcaagcacttttgcttaatgacttggtcatggggaaggagagacaggttgtacttggtcctcattttgcacttggttagagagtaagaggcctttccatctccactgctgctcaggtacttcctcccagtgtactctagcactcccccagcaggttctgtagaaacacagaccccaaggcctgggcagactctaccagaaaaatacttgtgttcctctgtgctctgcctagtacatggcttccctggctacctctcctacaggcctggggaggcaaagatgggaagtgtttgtaggtattatctactgacaacattcaactttagacctcggttcaagccccctctacctttgcctagatctttgactttgtgtaaacaacatgctttttctgggcccaattttctcatctgtaactccaagtttatgaattgttttgataataaaatactaaaaaatattgagtgtttgctgtggaccagacatttcattgaatctgcacaacaatccagtaatgcatgtgccattattgtccccattttatagaggtggatacttagctgtacagagggtaaatccaaggagttaagtccaagttacccacacctgggcttgtctgaccccagaaccagcactattgaccactatgatatacagcctctttctatcttcattaaagccaagtttccaagccacaggaatctcacaaatacctataaccggcctttataatttatgaacctcaacagagtatctgaaagccacctagtggctggaagttgctcagtaggatttgaaattctctaaaaggcaaaattgttcccatattccaggctctgctccctctcccccttccaccaccccttgatattctttctgaaaagttgagttggaaacaatcactttcttctctgaacttctatagagcaaggttcccaagttgtgatcaagacacaaaagtcatggggcagagcaccataaaatattgtgacattatctttaaagtagcttatatataactcagtataccattttgtactggggtctattatatagatcatacaaatttcaggaatacttccaggagaaaagtttaacattgagacaattctgagttttagcttataattcatagccttagtgtattctgagatacatatcaccttttatctgatgttagatctcatctcattcactcatacattcaataactacaatttagtatccatgaaatgtcagggatggcccttggaatcttccggtacttaataacctccctaggggcaagcaacagtacgttggattaacacaaatttgtggttttgtggccccacagtgacacgaacacaaaagattctcaataaacagaaactgaaaaatgctacgcgtcagaacttttgggtacacataggatatgctgaggataagaacatttgaaatcactatttcaactgtctaaaacaatattcagcataaacactttttagtcagcattttctctttctgattatgggaatctaaatttcatattcaattgaaaatgaactttatattagaaacatttcataattttatattctcttgtcccaccacgataagtgtacaaaggcagtaattgcataagtctgtctatccattgtgcttagcacaatactttgttaacacttattgaccaattcattgctttgtttgatttcagtctttttcctaagcttgatgattctatttttctcatatgtaactcttcaatgacaatttcactgcattacagacattttcaaatggcacaaaaaatgtcagaatatgctatttgaccctgggattaaggatgcccatacatgagatcaatcctatttaaatccttatgctcaggttaaaaagagaagataaaggcaagtatcattatgagcttcgtggggatagcattcccctgacctctgctgtctccagtctgtgcttgataatgatggaaggccagcaggtgctttgagtaattcagcagataaagagacttgcactgatggggctggaagctgcttgagtggacagcagatctcacaattcagttactgatgctacctactgagctgtcaaaatagaattatgagaactgcatggggggcttgaattaaccgatatacttaaacatgagtcaattacacacacgagagatccccccttctccatcttacagggccatgcaagtcgtgaggatggttgtattcattatatgatgtaagaaaaaaaaccaatcattgtcagtgtttcagacttaatgttttctaaaccctgatttcctcagctgcaaaaaggaagagatactgcaaacttactgggttttcaggaggatcaatgaagataaatcaatgagaaggggctctataaatagcaaagggctaaacagcaaaaggtatcaacttttatcattttatgcctttttaaaaacataaatctgagagtccacagaatttgtaaatttcccctgcaaactgttgttgtgaactcgctctatggcaccttcatctaggtgtgtgctcaggccaaaaagctgggagctgtccttggtgctttcctttacttcaccctctacatcttttttttaaaaaaacagttctattaactttacactcaaagtacggcccaaatcaattcaatctcaccatttccactgtcaccatcttagtctaagccatgctcatctcttacctggagcactttgatagctttctgactcttctcccagcatctactcttcctcctgaggcttcattcttaaatagccacagagtgacatattaaaagtataatcaatcatcctctttacaccaagccctcctggattttctcttaatacagcaatatccaaactccttaccattgcctacaggtctaccgtgtggcccagcccttcaagtcctttgcacagaagacaatgtgaatgggggctgtgtggtgcaaggggactgccctgtatgtagctcttcctgcctcctctcatgctattcctccttatggtactgtacacagcccagctggtcatctttctgccctgtgacctgccaagcactgtccagattcagagccactccatttgctgttgcttcttcccctgaaacattttcactaaatctcaatcttatttatgtgtgtgttgttagattccttctccttcaataaagtgctgcaagggcagggggcatgattttcctagtgcctggaacagtgcctgggacatgtgaagcaacaataaacattcgttgaataaataagtagcagttgattacctttacttcatggacttctctttcttttactttgcctgcaaacaccaaaacttatgttctagttttccaatttgtaaaaatattgcaacttttaaaatcttattttgtgcttttttattgccattttcccacttgtggtgcctaggaatgcgatttaattttaatgttcatgtaagttaaatataacaaggtaggtattttattatactgtgtgtgtgtgtaatgtattcttaatgctagaaatgagcaaacagtgggtcaactactctttactgttggcttttacatatgtgtaaagagaagtatcagatgcaaatttatcagattgaatgactatagttgtttacctctaaaagcatttctttagcactttcactgtcctaaatgctgagggggtttgagaaaagagtctagccataataatggtcccatctagtgagagagaccaaaatagaaagaggtaattaaatgtatggtattaagtgctctgagacagggcatttaatcctatttgggggtccaggaagtcttcctggaggaatgtgccttaactgaaacctgaagaatgtgtaggcagaatgatggctccccaaggatgtcaaaatcctaatgcccggaacctgggaatatcttaccttacatggcaaaatggaataaagattgtggatagaattatgatgctaatcagctgaccttaaggtggggagagtatcttggattacccaggtgggcccagcgtaatcacaaaggtccttaaaagtggaagagagaggcaggagagagacagagagatgtgatatgagaaggactcatcttcctgctgctagctttgacaatggaagaaggggccattagccatggaatgtgggcagcctctgaaagctgaagaaattgaggaaacattcccccctagagcctctagcagggaacacaacttgatcaacaccttgattttagacagtgagaccaatgtcagacttctgacctgcagaactgcaggatggtaagttagtgttgttttaagccactacatttgtgagaatttgttacagcagccataggaagctaatacagagagaaagaggtgaactttgatttcactgtggaggggaaaaacgggcagctaatacagagagaaagaggtgaactttgatttcactgtggaggggaaaaacgggctgttggaagatctattatatataaagattgtatgataaaattcccaccttgttatgatacttatatgaatgttaaaagattaattccttggcaccacaaatggaaaaatggtcataaaacacagacttagattttaaaagttgcaacatatttataaattgaaaaaatggaagataatttttggtttttgcaggcaaaatacagggaataggaggccagtgccctccctaggctctaacaggccaatgcctctttctggggaaaatatttctgggcatttccttgactgggttctcctgaacctagaattcaggatgcccccaggtgcttgtggctgctttgctagtgatagcttgttacagggcatgacgacaggtaagttggcctaaaatgtcccaaggccagagccatctataaccctatggccaatctttcccattctgcatgtcttgggggctgcagccatgtgtgggagccaattttgaccttcactgctgtctcattcaagaccccaagtgagggagagggcaagacctgggaaggtgttaactactaatgaataacactcacttccaaaattaataagccttctggttcttagcaaaatccactcaactggattctccaggatgactaattgacagaactggttaaattaatcaaaaatggaaatgaggatggaagaagggggaagggattctatttttattcgatggcttgggcactgcctgctctgttaattgctgctaagcttgaatgggatagagcagcttcagacatgggggtgaggtgggggtggtggtggtatcagtgaattctgctccttgcagcaaggcttttggcttttctccagagtgggaagtgtgtgtctgtgtgtgtgtttgcaatcctgccatcaggcaaaagcattttaataaaggaccttgtctttttaacctaaccaagctcccctgaaataaatactgttaattatacctcagatcaatactgaaccccttttggaagatatgccaaatctcaggggctttaagattcattgcagttgctgtctcagctgatgtctttggacacattccatcagggacctggggaatgagccacaggtttattagggagctctagtggcttacttaccaggggttggcaattaagtttgtagatgagggtgaagaatgagagtggattttatgttctgtgtaatggcagaattaattctatggttgaaaatggtcaggctggggaatccagccagatggggattgtataaaatggactcttgtgaaattatccttctggattttagaaaaacatcatgctctttatcctgtcagatgcccagcagaggaataaatcttctggaagcagacctacatgggttcaaatcttaggtcctccactgtgatctggggcaagtttcctcacctctctgtgcctcatctataaattagaggtactaataccaatcttcatgggttgttgtgagaattaaatgagatacagaaatgttcaaaaatagtaccctccccctctactacacccacctttggaggacaatgaaatttctgatttgcattgttggactgggcatcaaactttgccttcttctcattggaactcgggctgtttctccaatgactacactgttcacagaaacatctcagatttttttttttttgagatggagtctcgctctattgcccaggctggagtgcagtggcacaatctcagctcaccgcaacctccacctcctgggctcaagtgattctcctgcctcagcctcctgagtagtggggattacaggtgtgcgctaccatgcccagctaatttttatatttttagtagagacagggtttcaccttgttggccaggctggtctcgaactcctgacttaaagtgatctgcccgcctcagcctcctaaagttctgggattataggtgtaagccactgcacctggcctaacatctcagattttaaggtctaaagtgcttatgccatttccccctcagcatgaaaaagtcagactgcccctggacaggaaggctgctttggtgtcatccgaaggaggggatttctgtggccaatccttgggctgcagacttgccaatgcagaagggccttgctgctagaagagagtgtctacaggcagtggacttgctggtagagccagtgcaaggattggtgctgcagggcagccccatcgctactgctgaggtgaaccctggctcctcaccctggccctcaagaccttctctggccagattcagcttctgcaattccccagcactagacattacctctcaataagatggaagctcgaggggcaggtgaggaagaaggaaggtctgcccaaaccacaatggaattaagatgctactgcagaacctaccctgtgccaccacacacaagattgattgcattcagcaaatgtgtactgggaacctactatgtgtcaggcagtgtgctaactgcttttacttaaagtaactaattaatggacaaagacttccataagcccacatcccatgatcacttcacccctctcatctttcttgccctctcagaagcatttgacataattgatcctaatgtatttctaaatcactgtcttctctcagcttacatgtgttggttttctgctcacttccctggtagctcatacttgatcatctgtaaaaagccacctcctcctttcccctaccccattggtaaatgtcggtgtggccttcacctcattcctgggccctcagttattctctatccataccttctgccctaattgacattatcccatcccatggcttaaaatagctatgacatgctcgtgattcctaaatttatacctacagctcagacctctccccagacttccagactcatgttatctaattgtctgccagacttctctaattggatgaatcacagacatctcaatctggacacatccaaaagagaatgcttggtctttccatgccaaaactgttccttccccagtctcctcgtttcagtgtatggtaccgtacagtaactcaagcaccaaacctacgagttatcttagattctcccttttccatcacctcttcactgccaatctctcagcaagtcctcttagcctcacctcctaaggtgatcctgaatctgcccacttaccactacttcactgtgcccaccctggtcaaagccattatcatgtctcctccagacagtggcaacaacctctaaatggtctctctgctttccaggcctggcaccccttgtctgagaactcttttaagatcataaacagtattcacttccttcttagcaccatctcatggtttcccatctcacttagagtgaaatgcaagtgctctgctctggcccataaagctctcaatgatctagacccagcctacctctctggcttcactttccttttcccctccctctctttctccctccctctcttcctcccttcctccctccctccccttttcttccttttctttcctttcccctttcccctttctcctttctttccttcccctctccctctccctctcccttgccctctcgtcttgctctgttgcctaggctagagtgcagtggcacaatcttggctcactgcaacctctgcctcccaggttcaagcgattctcctacctcagcctcctgagtagctgggattataggtgtgtgcaaccacacccagataatttttgtatttgtagtagagatggggttttgccatgttggccaggctggtctcgaacctcctggcctcaagcaacccacctgcctcagcctcccaaagtgctgggatcacaggcataagccaccatgcctggctgtggcctcactttctatactgtccctagcctacttgtatccatccactgatcttttttctctattctttgaacacacaagtttcctcctctgttagggccttcacacttagatgttggctttctctttggatccgtctgataacaggtcttaattcaaaggctttgccacataccactacttcctgaccctgctaattttcttacagcttttttatcatgtctgaaatgacctcggttatttgtacatttgtgttttctctcatccctccccacaagaaagtatggtccttaaaggcagaaaccagcaggtgtttaatcaatcttagttgaataagtagtttttggtgttctcttgaagagctacaggtggtctggctcaaacctcaacttcatcacttgctctttggtggccataagtgtatctttcccccttttagctagttgcctcatctctaagatgtgaataatggcagtatgtacctcatagggttgttatcaggattaaatgagctcatgcatgtatacttggcttacttcctggacacagtaaaatgtcatggaagttagctgtgaatacggctgttgacattactacttttatgattgcttctgctcttcctgctcccacacttaaaagacacatgtggtagggaagcaagacaccatcttcactccaaccataacacgatgcttatactatgtgccaggcatcattctaaggctccacgggtgttatttaatcctcacaagcaccctataaggtaaatactttcatgacccatattttataggtgagtaagttgaagcacagaggttaggtaacctgctcaagatcaccaattaggccatggatacaagctgatagtggctgctcaactatgttgatttgcctcccctgttttgacccagtccctgaattcactcactactgtcagtttggtttgacagaggggaagaaacaaaacaaaattgtcctgggctgtgcttacagggaacatcatgctgggctcctcaccgccttgcctcatcccagtacctatgacaggggctgctggggtgggcagggagttttgatctttcctgctgtctccaccctggaggtaaggcacccggtggggctcttcagtcattcatcaactttcttcaagttatagaagtaaaacaacaaccttggagagaatctagaaaataagagaactgcccacatttcatggcccctgacctcatccctttcatatagcctctgctagtctttgtccacatatacttatcctgaccttgctgcattcatggtgagattatcatttcgcatgctgctttaacattcataaacatctctccacttgctccatctctgtgtccccaggtctttggcaagtcaagtctctgtggcctttcaaggtatcacttttactattcccagtcccacttgaggatttcacctgctgcttttatgctgctaaaccacaccctacttattggggaacctctcccttcaagactggcttttgaataggaatcaggtacctcaatgcctctaaaatcaattaaagtctgctttgttcagaaagaaagtgttctagctccacaggaaagcctccaggcatcactgtcctaacacacacggacaacctgcctggtgaaactgtcgagacccaatgcacaggtttctatcatcctggtcctttggtcctttgtctagtttctctcctgcctttaataaaagttatgctcattgtgtgcttccaatgtgtcaggggctgtgcaagagccctgtgtccatgacctctttccactcttacctcctggaggaaggtgtcaacatcagcacctgcccaggcttctggcggcaatgaggcctggaaacaatgtctggaactgctggctccagggcttgtgttcttgatgacttttatgtctttcctcctactatgggctgagttgtgcccccccccccgcccattcatatattgaagtcctaactcccagtactgcaaaatataactgtatttggagatagagcctttcaacaggtaattaaaataaggtaatcagggtgggtcttgatctaataggactggtgtcctcataagaagaggaattttggacacagacactgatggaaggcagtgtaaagacacagggagaagacagccatctacaagccaaggagagcagtgtggaactgatccttctttcgtagcctccagaagaaaccaaccctgccaacacttcatcttgggcttccagcctccagaactttgaaaaaatagttgaattgtttaagcagtgtagtccatggtactttgttgcagcagccctggtaaaccaatatgtcttttttcacctgtcttttcctatctgcctgcctttccaccacagatgttctatgaagccccaccaggtgctatgtaagtattgtacaaattcagtaattagtgagataaagtccctgtcttcataaagattgtattccagtcagcaagacagaggctaagtaaagcaaacaactataatggaggctatgaaagaaataaagaaatagagtgatgagattgagagatggtaggtgcagatggggtggacagagaagttaactcttaggaagtgacattttctcagaaacttaaaaagtcagtacaggccagacaggtagagtgtgtggggggcagggagaattccaggcagaaaagcatgtgcaaaggccctgaggtgggaaagggctggatgtattggaggtgtaggaagcaagccagtgtggccaggctacagggagctgagcctggaaatgttggcagagaccagatttacggggcacgttggaaaggagttcaggcttaattcctttcattccccaggttggtgtccattacacctggccagtttcttcacccagccaccgatactcatgcgtggaaaggggaaagaataatccactctagctaagtactgctgccatcagcaccctattgtttcagacatctaaactgcaaacaaagccctgtcactaccgccagaagtggtagaaaaaaataggcgagggagaaaaggaatcatcctttccaacccctgctgagtatgcagagtgagggacatatggaaattaataaatgcagctctgataacacggttctcctcggcattttgattaaatgctgttggttattaaatactctccttctcagagctcatctccaaaagccaatgttgcttttcattttgaactctgatgaactgtctcaattccgatcacacacctcggctgaactgcggttgactgcaggctgccgtttgaggaggatggagaaaatcaatatgaaatgtcaggcgaggggtcagattgaacttgttttcccagctggcaggagctggggctcgtagccgcagcagctgaacaaagggagatgtgcactgaagaaggttggttctttgaaggagtcaggaaaatgaatttcatttgcttcttaattagattagcaggctggcagcttgcaattcagaactctgttggtgttggaatagggagtgggaggacagggctgggcagaggcctgaaggccagtagctggctcctccgcctccttcaggacagtcaccagggctttgcttctctggggctgtgtggggctgaggctggagggagaagcagcttctggggctccctgggtgtgtggcttgaccggcttcctgcttctgtatgactgcatgattcttccctgggctctccccgtctgcttctccatccttaggtctcagctcagcagtcactgtcttgtagagtcctcaacacctctacttgtaccagcacatgcctctcttttatacatgtattgcagttgcgatgctatatttgtttctgttctctaactaatgcatcttctctccttagacagtgtggttaatgttatgtattagcttgactgagccatgggctgcccagatatttggctagaaattctgggtgtttctgtaaaggtgtttttggaatagtttaacatttacattaatagactgagtaaaagagattgtactgcctattgtcaatgggcctcatctcatcagttgaaggcctgaagagaataaaaacgctgaccctcctgcaagggaaagagaactcctctgccagactgccttcgagctggaacattgtatttttccccccttgcttctggaattgaatggaaacactggtttttcctgggtcttcagcctgagggttttgtttatttatttttttgagatagagtcttgctctgtcgccaaggctggggtgcagtggggcaatctcagctcactgcaacctctgtatcccaggttcaagcgatgctcctgcctcagcctcctgagtaactgggactacaggtgtgtgtcaccacacctggctaatttttgtatttttagtagagacggggtttcaccatgttgcccaggctgttctcagactcccagccttgggtgatctgcccgcctcagcctcctaaagtgctgggattacctgtgtgagccactgaggccggtctctgatggcttttagattagaacaccaccatcggctctcctgggtcttcagcttgctggctgcagagcttgggacttgtcagccttcataaccatgtgatctcattccttatgataaatctcttaacttacacacacacacacacacaccccctactggttctgtttgtctggagaaccctaatacagagagtaagctctaagagggaggaaaccaggtctgtttttgcttacccttctgtctccagagtctgatacagtacctgacataaagtatgtgattaacaaatattgattaaataaatgaataatgaggcctcctatatctggcaagagggttggggtttcgaacatcttatgtctgcaggcctagaaccggaggaatccagggtgaataattgtgataactgctgccgtcatttattgactcctttgtgcctggcagagggctaggatctcacacacatgaaatttagttcttgtgaacaacctgccctatgatgctgtccttaatatttctactttcaaatgaggaatctggggctcaaaatgattaaataacttgcttgaggtcatgcaggtactgagtatcagagctgagttctgattccaaagcatctgctctaaatcactctagttttttttttttttaacttttaagttcagtggtacatgtgcaggtttattacatagctaaacatgtgtcatgggtttttttttgtgtgtttatttcatcatccaggtattaagcctagtaccaattagttatttaccattctagttttgaaagcttctaaggccttgccctttttctatcttgtgttcagttcatcaagcttcccagtcagttgattccccaatatccagaatgcatgtggatctgtctgactccaaagctgaggctagtgtcagccacactgggctatggggatgccagggcttcccgtgccatccctggcctccaccctgggttggtggcccagaaagcccggttctgccttcactcactagagaggccctgcctccttagacagctcatgtcacctcacccacagcatgtccggtactgagtcccaacccttcactctctgggagagagttagagactttccatccatccccattcccacttgttatttatgtcaacccttaggcacacatttattaaatatttcctgacctctgcttatgtgtcaggggttcatataatgtgaccaagtcagattcagttcttatcctcaaggcatttactatctacaggggaatgacattgaacaattcatatcacgtccatgtatgacgaatgccaacctttaatatcactaatgtcacttataacacccatagttattttaaaagaaaatgttcattttcccccttctctttctttggatttctatagccaccattcttgatctaggttccaaattatccttgcattgagactaaagcaaaaccttctaactttcctacctttattcacatgaccactgtgttaatcttccataaaacacaatttttattaactctgctgtccagcgaaatgctctcaaattacctcccacatactagaaactgtgcttctccaaccggggtacctgtatatatccttgggcgttaggaagaggggaggatatgggggtatactaaaaagtacaggaagccataggataaatgttacatcttttggaaacaccagttttgtttaaaatttgggagtgggggtagaaacataattattaaattaaagtgaaaatagattttatatgggttaaaatgtaaaattcacatgaatttttagaaagaaaaataaggcttcaaagaaaatctgttgtggtcagcacctcccccagggtcgctggtctctgccaggcatgggctgttttgcctttgctggtaggttgggccaacccagagcacatgggaggaactggattcctctctgtgccctccttccatggcagcagggttcatggcttggccccaccagaactgtatttggtggaacagcttaagaaggactggatactatgggaaccagactctgggtataatataagtactcactgaatgcatgaatacatgacagcataaactttggaatctgatcttcaaggatcaacctgatatgaaccatcattgctatttaacctcattaacccaagattcccctttcccccaagcctgacactttttatttaacacccttcaaatgttccattactttagtaacttcagaattttgcccattctgtggttgctgccaacaatactcttctttctgtttcccacctaaccaaatcctacttgtacttcaacactcaactgctcagcctctgccttccctgtgaggtctgtttcaaatgtctcaaccgtctctgaatggcctaacccataattatctccatcattcacttgagtattaaaactaaactgccttatacattgttcctgaaatgcttcctgggtgcatcttgcctcattagccaaattttaaattccttgagtataggagataagtcttacctttccattgtacccctcagagttctttattgtaacaaatacattgtagatacaagaatatcatgcagtatctgtgactgaatgaattgtagtctagatcagtggttctcaactgggagcaatgttttcaccaagagggtatttcacagtgtctggagacatttttggttatacaactgggcttgggttattggcatctagtgggtaaggccacagatgctgctaaacatcctacaatgtataggacagccccttccccgaaacaaaaatctatgtagcgcaagattcaatggtgtactgttaagaaatgcttatctatattatagtggcttcctaacctgtctccttgtttctttgttctctcagccagaatttaacctttatccttctgccttccatctgaacaatttccctaacaactaattctgatcatactactcctctggttacttttgtggctgttcactcactttgatgaaaaaaatttgggttttaaaaatcatggtcattatgacatggctctggcatcctatagtcacaatctctccaagaagccaccagctccttcccccagctgctgttctagatggcttttatgttctcagcctcccatgcagttcagcaagtcctgttaattttattgccaagatctgtgcagtactgtgcaggttacatggattaaaaaaaaagatgtgtccagaacccatctgccctctcaatttccactcacctctttgtccaggccacccttcaacggtctcctaactggtccccctgctattcctcaaagtcattctccccatggcagcaagcatgatttccttaacacataatttggatcacatcacactgttatttaaacccttttctgatgagggtcatgtcttatttattttcatctctggatgttttggaatcgaacacaaatgttcatctttactgaaatataaaatacggagctgactcccacttgtagtttctttactcctagtgtgtctggtgtagaaagggagatcataagcttccaggctctcccccagcacattggggccagtggccatgccccccacctcccttcagttgctactcacatttggtgtgcctgtcacacagggcagatgcccgcatgtcacacagccggattgtccctttgctgctgctgtacacgaaggtgttgcaatgatgggggtggaactcggctgctgtgatcacctccgtgagctcctccatgttggctggcttaatgtccacaatatctggcacagacgagtcaaggaaggaaccaggagaaggaggcaggaacttggggaaggggagaattagcaatggcaccatcttatattagtaaaatatgtcaacatttgctatgcacatggtagatcctcatcataaacttgtcccaggcagatgaggctcaggaactttaagaaaatagcccagggttacccagtagtcagaggcagcattagaactcaggtctcttgactcctcatttgtgttttatcctctataaacatgtaaaagacatccactcatgaccaaagttaactgcttgtgcaatcaggctaaaatgtaccaagttgcaaagattttgcttctcattttataataatgattaaggtactggtcctattataaccaaataattcattttatctgattccttaatggattattgggctgataagtgatatctataataatagagtgcatatcttctttcatgaaatccctaagcccttctttataatatgttgatgataataataatagctgccaccaataatggagcactagctataggccattcactgtacaaagcatatcatgtactttatctcatttaatccttacaagaactctatataattagcgttttccttatcctcattttttcaggggtggaaacggatgctccatgtgcataaagaaacttgcttcaagtcacatggctaagtgacaacactaggatttcatcccaggtgcaaagtctgtgctctttcataattatgcaaaatttctctcatgtatgatatataagacttctagtctctgtaagttgtgatctgcttttcagcttgtgagggagtttttaagtatcagaaacaagccatccagttggaaagttttagggtcccgtggaaaatatccttagttttatcatctgggtttttttttctcagtatttccctttctgatcaagaattatacctctattttttaaagaccatatccttgtatattggaatgaaacatttagtcttttatttatgaaggtgactcaatgaaaataaaccccttcactgggatgtctggcatgagtgaaggagtgggtttgtacagatctcttcacacctccacccagagcttgggggatcaggacacagaggggccgaggtactgtctgaggacccagcaacatcctgcaaagaacaagccttgtgatgtggatgctgttacacagtaaagctgaccaacaggactcccacttttcctagattttcctactcgtgagccacctttgtgatttttgccctatctgtgcatcatcagatagtactttttacttaacatttttctttcagatcaactttaaattgattcacttttttctttacttagctttatctaaacagtaacccaatgttcataaaatcatgggtttaataaggtagctacattttaagtaatatgcataaaaattgacatgtgataactgcaaatgcgtgtgccaggagtttatgcaccacattttggacaacaatgtattgaatcaacaagcaataacttgatataactgccccattagactgagatggatgaaagtcttgtatgcttttcattaagctagtagcatagtcccctccttagagtttagatgcggtacaagcaaatgcactgatatttttagtcccgctagcactaacaaagtaatcatctatgatcaaacatcactatgctcctgctacaacattccaacatgcaatttgttgcaacaatggctttgtatttggttgtgcctctttccccttcattatctcttataaaccctattgggttctttctaaaattggcatgagactgagctaacagtacatgttactacaatttctcctaccaaacccagatgcaaatattacttgggtctccggggcatgtgagtctcctggattcacaaaatactacccttcaactcaacttctgccagagttataaatatgattgcagttagcatcacatgctgtggagcaagagcctgtgcccctcaggaggaggctctaggctgcagctccggtgctctctcagccactgacccatgccctgggctttatggccatgacgtggcgttgggtaaacggaggttagttttcagctgctgttagatttcctcatcctccagagcaagccttgatatcccactgtgcctgtgaacatgtttctcttttctccaaatagggaaagaaaatctggtgtcagctttctcaacctctaccagtatagctctgaaaacaagctgaactggaagggatcttcgctgtgtgggagggggaggtgctacagctacagttattttttcccacctaaaaataaagccccaaagtaagaatgtgcaaaaacaaagtgcctaaacatgtctatgaaaccaggcacatcctccaccatcaaggatgccagtggggctgtgcccacgagatctgcccagagctgccatctctggatctttccttccttcactggaccttccaagcctacccaccacccagccctcatccccaagccattggcttcctatccccagcaggtctcagtcttcctttttgagtagagggcttgtttagtttgactcaaaggggttccagggataaaccatgattatccctctttttaatcactgggatgatgaagttaagaggaagatatggccagttgctaatgctgatcaggggccaggcctgccctgtgctaacactttccatgtgttgtcccccttgcccctcatctcagccttatgagggcaggattattaacaggtccattttacagccgagggaactcagataaattactcaaggttatgtgacacagtgggcagagctgggatttgaacccaagcttgtctgactccagagcccgggttctttctcaccatgccactctgcctcccttgaggaatggcctcacaaagctggccaaaatgtgacaattttggttcctttgaaaagacccccagctaatctgagagggcagccccatctcttctggctttaggcttgtgctctcttaatttacctaccactttggtgactgcattttccagaatcagaatttttatgtgctctaagattttttttttttttttttttttttttgaagcagaatttgggacacaagcctgataagggattatttggatttttacctgctggaggatttggtgagttctagaaacatttgagagaagtctagttgctaaaaattaagtgacttatggggatgatgggagaggatattcaacatctgtatcctctagaaacccaggcattttcccctgcacaactctaaagggcgatccatgttttcagcatatgtaattttgcccttcatgttgggagggaaggagaaagaagatgagcaattcgtggctccacgtataatcttgaaaatggaatgatgcattttgacagtcacttttattttttttaatcctttagagctctctatccaaattatttccctgttgtcccaaataactagatggcaaaagcaaaacagagcattgaattcatggctaatatacaaccccgacagccaacagattgccattaaattaaccctggggcttgacagatctgttcttcttgacctgactgcttacggcatttcttattaatgctgagcccaggcaaattacatctgctaacaaaaggggttaatctggctctctgctgggactctggaggcagctctgaggacaggagggggcatagccagcttggcagctgagctccatgcttggaaggcagaagaggggaaggtgagggcaccgctgtgccaggcagtggcctaaggcatcatttaaaataataattgaagacaccaggaggtcactccttaagggatccacttcaaacaaatgggaagccagagccacaaatggttcatcagtgtgggatgagggaatggagagggtcatggcaggatggtaagaggtagcatgggggccattcaaacatcatttcctaatcccaagtttagaaaaagctttttatgaaaacaaaagtccagcatgatattagaaaaagattgacaacttaaataaatatacagaacaaggaagtgattagatgaatttttatatatctcattaaattgtttttgcagtgaaatttccaagtctgtaaaaaccatagtgcacaaaattctaacaacagtttgatgatgtcatttaaaacttatactctgaaaatgatgagctaaatgggaagacactaaaacattagtgatagttctatcagggtgggtttacgaatggtttttcttttgatttcaatgatcagcacaatttccacattttcttttaataaagttgtatttcaggctggaaaaaatcttagggccacgcatggtggctcgcacctgcaatcccaacaagttgggagtccaagatgcgtggatcatttgagcctgggaatttgagaccagcctgggcaacgtggtgaaaccctatctctaccaaacatacaaaaattagccaggtgtggtggcatgcacctgtagttccagctactggggaggctgaggcaggaggattgattgagcctgggaggttgaggctgcagtgagtggtaattgtgccactgcactccagcctgggtaacacagccagaccctgtattgaaaaacaaaacaaaaacttaggatactttccatacttatgatgtgtactattttgggtaaggaaagttaggtacaaagtatatacagtctgaccaagaccacgtaaaagatattacacacacacacgagagagagagagagagagagagggagacagacaagggcccattcactcatttctttctttgtgtattctataagtgtttccaaagaatctataccctgccagtactcttctgggtgcaggagatacagtagtgaccaaagcaggccccaagcccccctgatccatggagcctatattctagtagggaacagtcaataaacaaggtaaatgagtattatacacagtatattaggcagtgataactactaagcagtaaaagcaggaaagggagagagaaattatgtctctatatgtcctagattgaatagaaggaaggttcttggcattgtatgttcccactcataagtggaagctaagaggatgcaaaggcataagaatgacacaatggactttggggactcagggggaaagggtgggaaggaggtgagggataaaagactacaaattgggttcagtgtatactgcttaggagatgggtgcaccaaattctcacaaatcaccactaaagaacttactcatgtaaccaaataccacctgttccttaaaacctgtggaaataaaaaattgttttaaaaagaaaaaggcatatggtataatcccaactatatacaaaataaaatagtctgtgaatatgcctgatatataaatggatagaaaaaagtgtgagtccatatcctaaactaggcgagcttccataaggaccatgcagcaagtattttcagccttttgggcctttgccaccgctattcaactttgcagttgcagcaggaaagcagccatagataatatgtaactgaaagggtgtggctgtgttccaacaaaactttacttacaaaaacactttgggatagatctggtctgtgggcagtttgccaacctgttctaaccttttagcagagtaagaggtgaattgtttattgctaaagtaatttaccaaaaaataacttgtattcatgtattatttgtattaaaaataatatcaataaaagaatatcgtaatgcaaaaaaaagtggattaggaacctgaacttcttcccttaggaaagtttcaaaaaaaaaaaaaaaaaaaaaaaaaaaaagaagaagaaagattcttgggtaaatcaggagttttaaattgtttttggctttggcttttaaaatttcttttatttccccctgaacccacattgttgaattagctagcattaagttaaaactgtgatgcgaatccaatgtatagacagcaaaattggtagtaagatttttggtcattttattttccccaaatctctacaatgaatacatattaaacaaagaaaacaataagcattaaaaaatagcagtttccctggcttaaaatcatctgtgagagagctgcgagaccaggaacctcatctcgatgggtaaagtttgagataatattgtgaaaaatacagtgattgtaacaaaatggggaccagagattgggattcagttttgattctatctccattttgctaagagaatttgggaaagtcattttatctctctgggtttccatttctttgcctataaatgggtgtaaccctatcagcctctaagaattttgattattaaacaagataatggaaaagataatttaagtggttttacactggagtgaatattccttcttctgaaggaagcacatatttctccaaggatagggtttatatgcattgcctttgtgaggtgactttcatatgcctctgtccctttgctgctgattttgctaatactgacatgcgtatttccccaattcctgtctaagccaatggaggataagagagccaagtaggacgcttttctgcagggctgagtattataaacattggccaagctgaagagtggaatctatgtttaccagggtaaagtacccacattcaaaagcagctgaggcttttcatatcccacttaaagtctgccagtactgaaggtagaaaatagtaatatctttgtgtgaacacagcgtatttgtttgatgagtgtgatttccttttagggacatgagttgctttgagatctttttccctttccatggtctaaatttaatctttggatattaagcaatgattatgaaacataaagatcttattagctgaaaggacatgttgcttgatgatgagacactggaaatctccaaagaggactccaagggatattcctctcttaagagcttaaaaaaaagtcaatgtgtaaatattcatggagtgtttgccaattcctaggctcaatatgaggagactgacaaagagacacatggtgtcatattaaatatgtattgggcagggtgaaagccactgaagcagcaacaggggagaaacttgtactagaccccacagttcccctggaagcctgcctggcagaatcccactgaattaaaaggaagctgctgtccatggtagtaatgagtgctagaacctggaagccaagagttgaggctacctggtcccttaattagggaatcgactctaacagggcttcagcttggttgacaaataaaatgaagccactgtacagggttgttaggaccaaggtcaaagttgaagtatccctagagtccagctggcttctcccagataagtcctctatctcatattcagagactggacttctgaaaggtgaggcttctgctacccttcccagccttgcttactccatgctccacttcactctctgggcttcaaaaatagtggccttcttagaattcctccaacatgtcatactctctcctgccacaggacctctgtacacactgaacacatgtctccacacctctttgccaagttagttcatagtcttcctctttcagatcttaactaattcttcagcaaagccttccctggtctatagcaggatttttaaaaatgcattcatagaaccatattccctgtcttcacagaaattatctcagtttgtaattatatactcagtgtatttgatgaacattactctgaaagcggcaaatttgttttttcccattttcatgcctggcacaaactaggtgctcaatttatcatcgttgagggctagtctttatttttactcgatatgggcctatttaatagatcccatgttggacaaggtaagaactcaggtcagttcattcttagtcctgcaaaaagagttcaaaggattctaggtataccatagttttcataaagaagcaacatcttttaatataaattttcatttattgctattgtctcttgccctagaaaactactaatctattaatgagttgttatagtcctgatgtagttagcctattaagacgaaagtttgactgcttatgtgggaaactgttacacaagacaaggacagactggctatggatggaagggagagaattcatgaccagttatcatgaggtttagaaatgccttgctctgatctggtgctaaacacaaggccctagacctcagagttcctgaaaacatttagtaactagggggcagcatcttgcaaaggacacccaactgcagaaccaaaggaagagtctagaattgaaaagacaatccagataataaaattagcagaataaaagctaccattctaatgttcaacttttctagtttccttgttctctcaataattatcatgattgtgctagtcctgtttactgagcatttgcttagcaaggcactaccctaaatgtgtgcgtgcgtatgtgtgtgtgtgtgtgtttaattttcataatcctctcgtgatagagctgctttctacagatgaacaaaatgagaaatggaggcttggatagattaagaacatgttaaagcttatacagccagaaaagtggtagggctgggtgagacctctatcacttgttggactctgaagcctgagttctcaaccgtaatgccaaagtcacaccaaatgccagtcacaggaagtcatgactgttttctaaccatatctccagatcccttgtctcactatttacttaatgctttacatacacttactttgtaatctaaatagattttgaatatctatgaaattgtaggatatgatggttatgttttttgacgttcactattgcttagaagcacattgcttaccatccccagtagtagccacactatgctttgggaatcccaaattattctatcctgaaccatgtttcttctgtctcctttgtgaataaggggcattgtggaaatgagacctgcctggtggctggtatttttctgagactgttttgaaagatggccgcttcctaccccagaggtggctatacttcagtgatgagaggctcagtgcttagggcggtctggttgaaaagaactatatagatatcacttatcatcgttctcatgatgacaatgattattttacatatggctgctttaagggtgaatggcacggtctcatttgtatgccagcatctggcagtctgtcacacatctgcagaatataacctaaactgcgctgttaatatttcccctttgcattctccccaaggcatctgtctcccaaaatgcctaaagaaactcccctcccccttgaaggcctagaggcaaaattcagaaaacatgtcacctagactggggaagcagaagctcagagtgacagccagctgagcctgagcagatttctggctcttggaatagatggagagagaaaaagggaaccaccacccacactcattctattagcagctgcactgccaggcaaaatctgtaggcaggcccagacagcatgtggagtctgttccgtgatcaacaaaatatgccaggcatggtcctgatggtcagttctcattgtctccaaatatatctcataattgccactatctgattaaagctgccttccctgaaagcccttggagacggttgagtgctctccatggtggagactagctagctgtgtaccaaaaccgggtctttttatcctgggcacacagccagactacatttcctaggctgccttgcagttaagagttagccatgtggctgaattctagccaatggaatgcatacttttttagggcatggctcagaggaatctcccacttgtgatcttccatgaccttccccttttacagtcctgctataaacatggtaacattggggagctgcaaatgaaagaggcccgagtttctgaattactgattggaggaggctgcctgctgatggggatcatcaatattagacttcatacgaaaataatcttttatttgtttgagccattatggggtctattctataaacgaaccttcagagctttactataactcttaaaattaaatttccaggttagattttatgaactgtctactggatagcgctactttgatgacctactattatttcgaacttgacaggttcaataattttctgtatgtcagagtgttccacgtactggaatacagcaatagttcatacaaggcccttgctcttgtagaatttacatcctaacatgaggaaaccaaaaatacataagtaaaaaaatttcaaatcatggtaagtaccatgacaataacagggatagtgttattggtagctacttaagagttaatgggaaagagtacctctggggcctgaagtgacatgtaactagccatgtgaatgctgtgggcaaaatattctagaaagagggaacagcaaatgcaaagaatggaagaataaggtttacttaggaacagaaaagtgattagttggctgaaatgaagtgaattagggaagcgtgacaagactggataacaaagatggagacaggttccagatcacgcagaatcttataggccaagttaaataacttggattttattctgagtttagtgggaagctactggaatgttttttatcagggaaggaatgatatttgaattacatgttgaagggttcgtactgtataaaagagcaagaatgaatggagaccagatgagattattgcagtcacagtggtgagagacaacagtggcttatgctagtgtaggtaggtagatagggatatatgcgttgatttgacatatattttagaggcagggctcatggatagatggagttagagtaggggaggctggtaagtggaagagaaaactccatattgatacctaggtcaattgttcagttacctgagttgttcagtgccattcctcataaatctcatgccttaggtttgtgagaaatggagcacatgataggtattcaataaatgaccaatttttactatgaaatagagggtcaacatagtgggggtgaaaatactggcccagctattcagcattttttttttttacctttctatatattttttatttttattatttttttgagatggagtctggctctgtcacccagactggagtgcagtggtacgatctcggcttactgcaacctctgcctcctcagttcaagcgattctcctgcctcagcctcccaagtaactgggactacaggcgcccgccaccatgcctggctaatttcttttttgtatttttagtaaagttggggccttgccacgttggctaagctggtcttaaacctctgacctgaagcaatccacctacctaggcctcccaaagtgctgggattataagcataagccactgcggccagccgacttttctatattttaattaaacaggagataatgatacttacattatggggttgttttatcaaatatgtccttgggggtagaaattattaatataaagaggcatgatgggggcttgagaattgttagcaaagttctgtttctggatgtcaatgctggttataggtgagttcaacctctgaaatttcatcaaactgtataattataatatgtatactgtacattttatcaaactgtacaattataatatgtatactatacatttcatcaaactgtacaattataatatgtacttttctatatgcataatatacttcaatgaggtaaaaaatgtaatactataaagttcccattgcaagtgcttggaactcaataaatgtcagtcactattattttcactattatgagacaatggaaaccagtatgtctgtggtccatgctgtccatacagatttatgaatcctttaacagagaaagaacctgaactctagggtcttatcctattgttgataaaatcacctctaattttaattcgtgacatataaatgcctctgtatgaaggaattgattcagagtcccaatccagagctagccctggcctcccacttgtaataacaatatttccctaactttattgttatgattaaagagtctcataggtgccagtgtattttaaaaggggcaagttctccgcaaatgctaggtgttgcatttctattccatattttctcccagcccactcgcacctgaatactcttaattcaggccagttgattcttgatcacaaagaaaggatactaaaactttgattggttatttcaaagttccataggttaatcctcaggtcatcagcggacatgtaggtttcatagtcgctgttgacagatatggagttgatgtgatatgtgtgtgcgttggcaaatactcttcgtggggtggcctccaccatcaggtccatgggtctcaggacaggcacctgggatgcaagagaaacaaatcacttcagaaccaaagatcttccataggaaaagagtgtgcatgctaatatcatttattatcacacacaaaataatagccacattgaagaaactccaagttagagaaagaagaggctaataacgaatcacacactgttcttgttccattctgttcctcctctttcaaaagatatcaccatcacttagccctggtgggaaatttcattctttataaattctaaacatttttctaagcccctccaggtagcctcatctcaggggaacttggcttccattgtggagtcattaccttccagagacattgttctattttttttttaaacatgaaatctatttaaaaaagggagttgtgggaaaattttagaaatgtctagttcaactttaatctaaatttatcttttatgtcttttcatctcatggctttggaagctataccccttcctggctttgtccttaatccttaagggcattttgggaaactttagcatcacccaagactctaatcgtccaaattcagccactaatatatagggaacccaatgacatctgactgagaaaatcttggtttatatttgtcttagagtgcgaaccaggtagtgtccacttttacatgcaaaactgtcccagtttgaacattaatgatatggtcaccttactgatacataaatacttctcagtaagtatttgttgaatgagtaagaatacatgattaaatgatttctttctggtggatcagagaatcggcaactaaatagtttcccacacatgaccgtctttctggcaaatgtgaacaaagacctatcactcttcctcctttgagttctgggtgaactggctacaaagaaagagaataagaacactaatgcctgagagggaacaaactaaaaaaacacccaagacagacaaaaccccacaacacaggtgtggtcacttaatagaaacaagataataaaataaccaaagctattttcttttcaagcaaatcatttcttgcaactgagccccgactgatttgataccaggtggtagattaagacttcaacttctggattggcttcaacccaggtggcgaggagaagaaaaacaaaagttaaattttctgaagtgcagtcacctcaccaacataaccttttagaaaaaagaattctcccagttcagacttgagggactttaactcacctatgcgggagtttttaaatcaaatcaatgattcagaggaaacacagaattctagacagatgtggtacttgataacccagaaaccacaggtgacttgaggtgtggctgtagaagggtcaggggtcctctgaatactaggaaaggaaagggaaggaaagtctttgtggtcccccatcccaattacggataagggcctatagattaagtgtgtgtggcagcgaatgggagaccagggttctgatcagattcaccactaaccaataggctatgaggtctgggcaactaacctgctcctcctaagcttgagctcaattgcactgtctgcaaaacagtgaccatgctccctgtgctctcactatcgcaaagggtggtttggggttttgttgagatgatctgacctccaatgcatcctcctacccactctttcaacaatatttactgagtgccacacaaagtcctggagtgttcaactggtaagcagaaccagacacaggtcctggcatcatatacctgttcttgtcaggggagatagacataattaaaagggctaggtgcgcaaaagagaggatatactgccaagagggatttaacctgctcagggagaactgaagaggcttccctgagaatgtatgtattggaatgtgaaagatgggtagggatttaaccaggccaggaggggagtgaaagggagaatgtgtctgagggatgtgcaaaggtcccgtgatagaggtgaacaaggcaagagtgaaaaactgataggtcactgtagttgagacagaagtagtgaagggagctattgtgggagatgaggtgacaggctaggtaggaggcaacacccccccccaaaaagttttgccattattccaagtgaatagggaaaaaaatgaaaggatttgcaatgattgtgatataatcaaatccaggttttgactagatcagtccagatgtacaatggaaaacaagttagaggaagaatgaggtagaatttttaaagtgaagatcatacacttttggacatcaactaagggcatgcctgagttaaggcattgcgatggataaaaaagtgactttgccctgagaaacactacaccaaaatatttattgggcattttctctgtgtcaagtattcttcatacataatctcaggtaattctttcaaaagctctgtgaaataggtactcatacaaacagaaaactcaggcagagagaggctaagtcactggcccagggttgcccagctacaggaagcatagctaggtttaattcggggactggaaagtgaatgttctttccactgtaccacatcacattgaaatatcacacagggtaggtatgataaatgctctgaaagtgacataaattgccaggagaatttatggaataactagtgttactggtagttataatggtagtggtattcatagtagtgtggtagttaagaaacctcaattaggtgttgtaggtgttcatggtatttgaacagggcatctattttttcagaaatgtgtgccatgcttttatagtttgtcacaaaggagctccccacctgaagcttgtggttgctacctggttcctctgccgtcaagaggtaccagagctcaaagcaggaccccaagggtcacaaaagaaatggaatctgcaggacttcctgtggctcctcctaaactcttccccgggcctcctcagttaccgtgcattgtctgcagagatttcttgtggctgtggcgacatgggagggagcatgcagccaggaacaagaggcattacagagtgggagctgccagcccacagcttcagcttaatgtgatgggcctgcctgctaatttaggctgacatattccatgatgtactacttaatggggaagggctccgtgtaggtatctggggatggagcctctaatgctttgctcagataagacaggggggatggagagctgaatgccgctcgtggtattccaacatcagtcccaggcctacgtcaaggcttgtctgctgcccagtgactcccctcacaaggagaaagagggaagtttggtggttcaagcaggacacgatggaccgattaggaaaccacattgcgactgtgtttttcatctgctctggccacattctccctttaaggccaggcaggaaggagatccggacactattccctgagtcaggtccacagtcaattgttaaggttgtctctggaaacatacacggagagcttcttgtgccagtcactgagtttagaacccctgactccctgccccacccaactccaaggtgttatctcctccagcgccctcagtaaccaaccttccaaggaagattcctctgtttgccccattttacaggggaggtggggggaggtggagtatccagtccaatgtcacacaaagaataagctgggggctaggatctgaagccagttaatttggttcctgaatgagcacacctagccactactgtgaatgaaactattaggttgaaatacaaaactgccatgtttgcaagtcaaaaattgtgaaatatcagcaatctcatgcggtttaacctaacactttggaaaggctctgtggtgtatggatgtgacatcaaatcagggaacattttgccttagagcctcttcctaggacatcatctgtgtgtgtggtgggagtcttacagtgggaggccatagtgtctaggcctctcctccttcattattcttggtattatatgcttgcatcctcaataatatcatgctgaaagaactatttctgtggataagcaaagtatgaaagtgagtagccagggtagttcttgaaatctacagatgaggtcattgaggtctgagaggttaagcaccttgtccatggtcacccttccggggttgcttgcacagcctaggtctctgcttcctgtcccagacttctgctcccacacaccatctgcctgagccatcctccacaggaccagaatgcccttttgccaaatgacaaaagcagagccagacaaaattcagatcaggccaggacgtcttaactcagttcaaaccttgtctgagccatgttggcagagtaattgatggggctaggatcaaggcggagacaagggatgtgctgagtgaacagtggtcagtccttggccctctgagcggtcagtccttggcctgtctgcaggtggttctgtgttgagcagctggaattcagtgatgtcccccgattcaggtgcttcaccctcctctctgaccctggttgagtttcagctcattctcctaggctgctttcaaaggacgcacatcccagcactgtgtcttgcctggacacccagtattatattagaatatcaaccgaataatgtcccaagccccaaaagagcagcctgaatctaatctgcaataaagcttacagagatatatttcagttgtaatattcctgggaagctcttcccccccagagagtggcacggcttccccgctcacttcaatcagtccctgctcaaatgtcaccccctcagggaggccttccgtgaccatcccacctcaaatcgcacagccttcagtctatcctcttccccaactgactgctcagagttttttaaacacttcagcagttcctcagtgaattttcatcgctatcctatgattaacttggtagatgttacaatccctattgcacagatgagaaagctgaggcagaaaggtgaagttgtctgaaggctcacagtgagtctgaggcagggcgagtactcaggcctggcactcctgccactccttgactcaggagtctatacccttagtcgcttaaggcacactcagatgcttgggaggcagacaagtaaatagatctttcagcgagggcgatcacgctgccatggaggtcatcaggcactgcccaggccgtatgaaccaaacgggtcctgcctggggatcccaaggcagacctcagaaaggagaagactaccaagctaggcagggcttgaagggtgggtgggaggtccccaaagagaggtggggggtagggaggggagggaactgggcttcagtcagagggaccagcagtgtgcaaactcagaggagagacagcaaagtatacacataacgatgggtaactgtgcttctggggtgaggtcagtgatttagttattcattcaacaaatacttattaaatccctcctcaatagcagacatattctagggaccggtgccacaacagtgaactctctgtggtacataagttcttgtgtgtatgtgtacatgaggaaaacctgagttgggtaaggggctagcaagcgagaggtatgctctttgaggtggggtggtcatagaaggcctctctgagggagtggggtatgaacagagacctgaatgaagtgagagggggagccatgcagcaatgtggggaggagcattccagccagggggaacaggaaatgcaaaggcactgaggttggagtgtgctcagagtacaggaggaacaatagcaaagagctttttttttttttaagtaagaaatggggtcttgctatgttgcccaggctggagtgcactggtgattcacaggcacgatcccactactgatcaatacgggagttttcacttgttctgtttctgacctgggtaggttaacccctccttaggcagcctggtggtccctcactcccgggaggccaccatattaatgtgaacttagtgtggacatcctaacagcatagggcactacagcccaggactcctaggctccagtgatcttcctgcctcagcctcctgagtagctgactacaggcacgtgccatgtacctgtcagcaaagagcttttatggctggagaggagtgagtaaggaagcatggcagttggagaagatgttggatcagtagtcagggccggatcaccaccttcactgtgcgggtgaggaaagctcagggaggtgtggctacctgtgagtagctgcctgatatgggactctatcctccctcaccattccttctgtctctgctcacccgctttgagtcttcctccctcaggttcttattatctttcccgcctctcctcttgggaaataccagatcatctttaacttcccagaacgcatttactaacaaaatgaatgttgctgtcatttggcttatttggtgaccacaccagcgattcttcacaatcttccatgacacctaagtgggggttggcgggtcacagtgccttgcttcagagacatgcaattaaagcagagtagagccctagaaaacaggaagcccctgaagcctccactttaaaaaacatatgtgaaaaggcacagcaaggggaggccatggggaggactcccctcaatgcgccttcatgagaggagtttttcacagagaaaaaacaacagctgtgtttaccatggcaacctccagtagctcagtaaattgacagattcaaggcaagactcggagaagagagaagagatggccagataggagataaagaacagaaaagatgaagtcatggagaaggaagaaaagagagatgtctgtctgtaggatgtggatggattttagctgtttagtaactctaggtcaaatctcattgaggtgaacagacaaacctttgaataccattgcttgttacgtacaagcataatcaattatgttatggaaggagcatccacattctccttcctaaaatcagatctcaggagtacccacagggtaggttctccttacttttgcaaaagaaagatatagaaaatgtaccttaacttatcctgaatcttactaaggtgtactatgcaattcataaacacttctgagagggacatttgcatgatacttttaatcaaggccccatagacgaccccatccccagctcattatgatacgtacaacataatcaacattatggggtcttttgaaaaaattgctgtcaatttaaatccacacttgctccatatctccttgttagtgttcaacagatgctccccattcccctctccaaataattgagattacatttagactgacagtatatatcaaggtcatggggtttggtgggttctgtatcatcaattaggaagtgcacataggaaggttataaccacacactggccccagataaggccttcaacaaacatttattgagcatctactacatgctgagaagttgccacacagagtatccttgagaagcttagaggaggtaggcaatatgtaaccccctccttcttcttactcaaaccaccccttttgggaaggctgcttgacctagaaaagacaaagatgagagcggaagtcctgggtgtccacctcatcctaggtatacggaaaccctgaccctggtgctctgggaccacaggtttgaggcccagtggagaatctgagggtgaatatgttatcccatcttgaggcactagacggtaaatctctcagaggggcttggaaattccagattccggcctcgcttcaaatttatcaccttgccttttcactgggcttccttcaagaaacagccttcatgactttttagtaacaactgggacccagacttcattttcaaggaagagggagtaagttgtcataaaaatgggagagcattgggtcctcctataaatatcctaattccaaagaatacagctcagtggtacagagcagccgtcttcaatgagaataccattcccctaggaacagcagtggtggatgacttcctaagaactatgtgaaaaagttttaaggaaattcatttcttcgttcctaacttccatgttctccttcctaaaatcagatcttctcaggagtacccacagcctaggttctccttcttcctttttcaaaagaaagatatagaagatgtactttaacttatcctgaatcttaccaaggtgtactatgcaattcataaacattcctgagagggacatttgcatgatacttttaatcaaggccgcatagacgcccccatccccagatcattatgagatgcatttctaataaaatgttactttttatatttattcatcatttgtcagaattatatgtttatgctgttttgatgtattgtgttctattaatagtcaaagcaacaactaaacccagaagataattttaaagtcttacagtcatatattcataaaagaaaaagtctatttacatctatatttgtcatagaaatgatcaaaaaccttttaacatgatttaggggaaatgcaataaaaatagatgtttgaagaagaaaaaataataatatgaagcttttgacttaaaaaaaatttgttcacatattcttttagtgggtattggtgagtatccagtaatgaggtatttaaatcccactggatgcaaccaaaagatgatataaaagctttattttaaactgccaatgtttaaaatactttgaaatcacattttctgcaattatttaacattacaatggaaatgcttagttacctactttaaaaagctcaggaaagtacatagctattcaaaattcttctggaggtacacaagcacacaatttgaatggtataagagggtttttagagttatgtggacttgggcttggatcctggctgtgctaattaccaaccatgtggccttgggtttgctgcttagtctttcttgatatcagtattcccctccttaacgttggggatatgtaacattttcagtagcactgttaggagaacttagcatgacgattgacacataccatctaacgaagaaacatttatggagacatgatttgtgccaggattgtgctaatcatttatgcacatcatgttattgaatcttcacaatggccttatgaagtaggtactaagatcattgtcattttatggatgtaactcctgaagcaacacaggtcatgaagtttgcccaaggtcatattgttgccaaggggtagaattgtccctggatgtcagctgtctggctccagcccctatggtagctattattagcattcttaccattaacttccaattgtagaaaaatggtccattctgaaagattgcttggggaagattttctgacttttctatattgactatgaggttttagcatctcttccatccaccaagggaattcagtcatgattatataatgttaaggttgcttaggaaaagtagccaggggaatgattggtcattggatagagattaactttattgagaatttaaaaagctgaaagctctcctggttaggagttttgcaaatagctccgtcctcattgtcatgaaaatcttgaacaatatggacgctcatccaattatcaaagcaacctggggggcagagtctggcattgtgtgtacccattattgaagggtaattcagtgtaacaaaccaaatagagtatgtacaatgactgtcaaataaaataaaccactaacaaattaaattacttttcattttcagtaggaagaatgccagtcatttttcattttaaaaaatatgcatcttaattccattttttaaaaacgtgaaaagaagcatttaaaggcctcttgtgctatctatactgatgtttattttctatagatatatttctcctggtcctggggcattttccctcaaagaattagtggagcgttaaacctcactttggtcaaaaaacctgtttcttccatggatcaatggtggatggtgttcagaaagcaggagtgataggctggctctggcttacagcgacatatcagagctgttgtttccagaatgaaactgccactcaccagcaccccgccaaaaccccctgggaatcctatccaaataatataattttgagatttccctgctcacacccttcaacagcctcaatatgtccctaatttcttcttttactggctttgtcatacagattgaaataagcctgagaagaaaaacctctttgaaccaagtcaggctttgtgtttcaggtcattaaatatcttagaattatattctttcatttgacaaacatttattaagtgccaatcactgtattaggtagtatgtgtacacagtgaacaaaagagattaaggggtagaatttaaagtctaacagggaagaaagacattaatgtctctaagtaaatacattgttataaactgtcactgatgctacaaagagatgtatattgtttcatgagagaaagaaataggggctctaacttagactgaggaatcagataagttgtttttaaagaaatgacaattcatcccacgaaagcagggccataagcattcaatcctctaaatcagtgtttctcaattaggagcgattttgccactgggcagtgtctggaggtatttttggttgccacaatagaggggatgttactggcatccgtgtgcaggagctagggaggtagctaaactcattttgatgaacaaggtagctcctcctgaaacaaaaaattatctagcttaaaatgtcaacagttccaaggctgaaaaacccaagtcttaaggacactctcctggaacacagtccaaatctagggtgcatagaagaaaccaagtactaacttctacaatagaccagcaataagtttcagttcatgaagacgttttggattaaaaggtacttcatatacaaagatatatacatatatacataaatatataaaatatctatgtttaatatctatatttcaaagacatataaaatatatatttgaaagacttatcccctatggccagctgtaagaataataaatgcataaaagctgcctggggaattaatgtatatattttaaattcagtgcatcaaaaatggtttgcatggcaaaaaatttcatgctctttgtgtcattgacttcttttggcctgactataaaaaggagaggaaagatacctttttctcagaagataaactcgctaattaccaactcatgcagaaacctgtaattctgccagttttatcttattttttccccagacacttactttttatgccaatatcactatttctcaaagtgtgtttccctgttcactgcctttcctgttatttcctttgatgttttacattgtgtaatgccacaagaaaaaaagagacatcttaaaataccccagtagaggaaaatttcaattaacatttatagctggggagagtgggattgggagaggcggtggtttaatttttggttagtttggttaggattaagcacaaaaattgtttttgctgttttttaactgttattgatgaagtattactttttcctactattaggataaatatcactgaatctttgatcaccgaggattgaccaagcctccgaagtatcacactgcattctgtcatttattaccgtggaatatacagaaccaagaagataaatacaaatttgatattaacttcaagaatcttacagctggaagttacctgagaagtcatttacattaaaaaggtctggataaacacaaagatgcatttctaagaatttaaaaaacatggcctttcatagatatccatagaatgtcagttctgcctcccaccaacagatggcagtagtaattactagcaacactttgatttagaaacaaattgacttaagattgacatttcagggttacattgtctgattcccaaccttggctgcacatcagaatcaaataagacctcttgttaaaaactgatgcctgcctccccggggtgctcttttgcccttctgcttctgccatggggtgatgttgcatgaagactctcacaagatgctggcaccttgatattgaactttccagcctctaatactgtgagaaataaatttcttttctttataaattacccagtctgtggtattctattatacaaacacaaaatagactaagactatgggtttaaaatgatttttatagttctatactgattgaaggtttatgttaattttaaaaattctgattatttttataatcataaaaagaaaatcacttatggaagataaaaatgacaggaaaagggttactatttatgatatacaaagagttcatgaaaattagtaaaaagacaaacagctcagtaaaaatatgggcaaaaataggaatgaaaaattcagaaaaagggaaaagaaaatgaccaagacatagatagaaatatgcccaactcattagtaaagagatgtaaattaagatttttaaaatctttaatcttataaaagattaatctgatgaatcttttaatttttaacctttatgcataaagaatttactctatgccagtcactgttataagtcttaaaactattaattcatttacactcataacaattttatgaggtaggtattcatatcatcctctttttacagatcagcatatctgagacacaaagcagtaatgtgtcctagctaaaagtacacaactagtacttgctggagctgagacaggtactcagtatttctagccaagggagtcctaactctaaaccactatactatgctgcctctcagttggaagtataaaaagaaaaatataacattctatcctggagatggaataaacaacaagcatttactcatggaagcataaactacaacaagattttcagaaggtaatctggaagtagctgttaaaataacatatacatcttttaacttagtaaaccttactttaatgaaatccatcctataaaaacatccgtaaataacaatatacaggcatgtcccagagatactgcaagttcagttccagaacaccacaataaagtgaatattgcaataaagttggacaaatttttttggtttcccagtgtatataaagttatgcttatactatactgtagtctattaagtgtacaatagcattatgtttaaaacaacaaggtacatgcctgaagtaaaaaatactttttgctaaataatactaatgatcatctgagccttctgtgaatcataatctttttgcgggtagatggtcttgactcaatgttgatggatgctgattgatcagggtggtagttgctgaaggttgaggtggctgttgcaatttattttattttattatttatttatttattattattttttgagatggaatcttgctctgtcatccaggatggagtatagtggcatgatcttgactcactgcaacctctgcctcccgggtttaagcaattttctgcctcagcctcccgagcagctgggattacaggcacgtgccaccacgcctgggtaatttttgtatttttagtagagatggggtttcaccatcttggccaggctggtcttgaactcctgaacttgtgatccacccaccttggactcccaaagtgctgggattacaggcatgagccaccgcgcctggctggctgttgcaatttttaaaagacaacaatgaagtttgccatatcgatcgactcttcctttcatgaaagatttctctgtagcatattatggtgtttgacagcactttatccacagaacttctttcaaaattagagacaatccgctcaagcactgttgctgctttattaactttattaacacagctttattaatattgacgtgatattctaaatcctttgttgtcatttcaacaagattcacagcatcttcatcagagtagatcccacctcaataaaccactctttgcttatccataagaagcaattcctcatctgttaaaattttaccatgaggctgcagcaattaagacccatcttcaggctccatttttagttctagtttttttttttttctatttccaccacaactgcagtgacttcctccactgaagtcttgagcccctcaaagtcatctacgagagttggaatcaagtgtttccaaactcctattaatgttgatattttgacctccttccttaaatcatgaatgttcttaatggcacctagaatgaatggtgagtgcgtcccagaagatgttcaatttactttgttcagatccatcagaggaactattttttggtagcgatagcctttcaaaacgtatttctcaaataatatttctcaaaaatgactccttaatctgtgggctgcagaatggatgttgttagcaggccggaaaacattaatctccttgtacttctccatcagagctcttgggtgactaggtgcattgtcaatgagcagtaatattttgaaataaatctagttttctaggcagtaggtctcaacagtgggtttaaaatatacagtaaaccatgctgtaaacagatgtgctctattcaggctttgctgttccatttagagcacaggcagaatagatttagtgtaattcttaagggccccaggactttcagaatggtaagtgaacattagcttcaacttaaagtcaccagctgcattagcccctactgaaagggtcagcttatcctttgaagctttgaagatagctattgacttctctccagctatgaaagtcctagattggatcttcttccaacataaggctctcttgtctacactgaagctctgttgtttagtgtagccaccgccacccatgatcttagctagatcttctggatagctttctgcagcttctacatcagcacttgctgcttcatgttgtacttttattttatggagatggcttcttacacctcatgaaccaacctttgctagcttccaaattttttattctgcagcttcctcccctctgtcagccttcatagaacaaaagagagagccttgctctaggttagacttcggcttaaggaaatgttgtggctggtttgatcttctatccataccactcaaaccttctctatgtcagcaagaaggttattttgcattcttatcatttgtgtgctctctgaagtagcatttttaatttcctccaagaacttttcctttgcattcacaacctggctaactctttggcacaagaggcccagtgttgggcctgtgttggctttcgacatgtcttcctcactaagcttaatcatttctagcttttgatttaaaatgagaaacccaaaacaccccataagaattccaacattaacatcagagattaatgatcacagatctctataacaaggataataatgaaaacatttgaaatattacaagaattaccaaaatgtggcacagagacatgaaatgagcacatgctgctcgaaaaatggtgctaatagatttgcttgttgcagtgttgctacaaacctttaacttgtaaaaaacatactatctgtgaagcacaataaagcgaaatgtaataaaacaaggtatggctgtatgtctgagaacacgtattgtagcattgttagttatagcaaaatttagaaacaatgtgaatatctatcaatggagaaatgatttaatgtcatagcttatctatgctttagaatatctgcagctctttcaaggaaggtaaattggcctggagggatgtgtatattactgagtaatatgtctagtgtgatctcagttttgtaaacaaaacaaagtcatatctgttcattcattaatgttaatatatgtattcatagatacagagaaaggtatggaaagacatacaccaaactagcaaccttagttaccctgagatatggaaccgtaaatatagtattatttgactggatgctataaacaagcatttcttttgtaagaaaaggaagggaagacatcatgtttaatgttttgtcagggcaggattcttaagattcttcagtctgcactggactcttcttgggaaaacttaagcatctttaatgagcacaactttctcattcctgtgagcttaatatctgctttactgaactgtccacctgttcccagagtggacagggagtcagcccattccctttctttgcacaacagcacttcagatacttgaggacagctctcaacccatctcctctccactttcatagattataccaagactcagcctccaatcttcacacctcaataatggtgagctcaggccacttggcctccacaaatgctttgcttcactgaacacaatctaccagcacaggcatttattattccaaagaagacatgtgctttctgtttctgtatgttaaaacagacttccctttgtaatcgtccatatcatgtcatcaagtaaaattcccaggtcttttttcaaatgaagtaatataccaagttgaatctattctatactatttgactgttttgaacttgaatgtgatttcctaacctctcctcctagatctgttgctttctcttaaaatgcagaggtaggaaatggtatgtgtgtgaatgtgggagatggtggtaggaatctactgaacagtagattctggataattggatttttctgtctaataaaggctattggtcagaagatgaacaaatgagttagggaggtggagaagacaatggcaatgttctgaattcaggcatgagggtgggagagaccgtaaatcttctcttcctcaatggctgagctgaatttgaatgtagtgattctagaaaataaattgttatatgaagtggatgaagatgaaataactccagagaagaaggtttgctggttccaaggagagacagcaggaataggcgtgcgcgcgcacacacacacacacacacacacacacacacacacacacaaaggagataaaaagtaaacaggatgggatgagcaagagaagagagtatctgagaaaagaagcagaaataagactctatagaataaaaagatgccaagctttcagaaataagaatggagaaaaagaagaaagcagggaggtgaagtaatattctagtctgggctctttagattttaagaacagaaaccttcctaaacttacttaaaaaaaaaacccaaaaggattactgaagtacagaaaaatattacagatcatcgagactgaaatggagcatatgaaatagaacagggacttggcaagctgttaggaacctcgaaaaatgtgctttgtttttctgtttctctctttgtctgtcttgcttaggggccacctggtctcttaaacgccttctctctgcatgtctggccctttctcctctttttaccaatgacttcatctgtttaccagtctgaatatggcctccaatgagtcactccagcccagattttataacactttcagcccaattgctcagtgctatcagaaaggagagaaggaaacaagcaggcagagaaacaaagtgggaagaaggaagcatcagagccctgtaattgggtctcatccttgtcccttggacatcccatattcgtaatcacatccacaccttttcctaggatattcctttgttcacctcacttctatccacccatccatatccctaaatcatcccagaacctgactgctgcagttaacagagctcatctcattcctcctttcttatatgtacccactgtgatgaagaataattggatacatttaagagtcctaaagaaaacgattaattctctagcttccttcttcaacctgtcactattttgacaaccctcctggaatcattttgtaacttgagctcctagtgttttaatctagatttctaacagtgtcttgtataaggagggcaaagcacaagtggtcactattccctagctagaaattttattttgtttggaatgttataattgcctttcaatcttctttaggcaatgaacccatttatgtaattctccctcataatttccccccacttccctgccaatcttagaagtgctatgagcccttttcatggcaatcacattctttttaaaaactagatcctcaaaccatattagagtaagaatttatcctgaactgaagaaaattacgtaattacttcttctggaacaacacactatttggggtgacttatgcctggtctacttttaagtaacactttcatgttattcactaaaaccctgagatcttttttctgcaactttactttggctgtgtttccactttctacacatgaactgttgagttttctccccacatgtcccagcactatgctctgtccttttagaactctgaatcctatctattcccttcaagttttcaaggttgtcatccatttctgtactgctttctgacctctttgcccccaaatgttgtgaactgcattgccatagaatggaaggaagcagggcacgggtggcatggacagaggttattgcctttgaggactgtagactccattaattcattttcttcctgaaggaaggaatataaattattttctccaatagccaaagcagaggacctttttaaaaaaccatcaagctctgaggctaacagaaaggaaaggaaaacctaaaaagaagggaaaactaatcatagagagggaaaagagaacaaatgtgcagttcatttaaaatcactgtagttgaacatcaaattatggtacctgacttccacctattttacattctatttagtatttattttgcctctaatctaggaatacaattatgtactgaattgtatcacatatgcatttaatatgtgaattcaactatatatgcttagaataatatgaaaaaaggaaagaagcaaatttaaataatgggtcagaggtcccagggagtatgagatgggggaggggagttaatctgctctttcttcagaccaatggtctgggtggatctcatctctgagcatcgtgggatgttgaataagttactaaggtttaaggaagtatatttttcacaaatggcccctcatattgtttgcatagtttatattctacattattctttatatcctatatatttatatgtatatattattctatatagagttaataaaaacaaacaaatcttatgggtgatttatgggatttttcaagagtatttttaccaaacctggtgcttgctttatggggcgactttggaacctaacctctgtaaaactgccactttaatgaccctttaaaaagtgcttactgtcccctgtatgctttacatacgttacctcctttaagcttcacaaaaatcctgcatagttgataccatacatattttacagactttaaagagctgaggctcagtgaggttaaatgacataataagtcatgaggtcctcgggatcagcagaactaggattcaaataccatctgaaccttacagagaatggtcaataccatggcatttttttctggtgacgttactatatttccagtataaagaagatttatggattatctagatctttaaacatgaattcctcttgtattagagggaaaataaggctagcttcaggtttctctctgcagtaaactcaatgtcagaatcataaccaaaaaatgttcacaaaattatgacacttttatatctttcaggttgtgattagcataggagtaaagctcataagcaggcaaaaactcagtgaacacagtatctgtattattttccatcatatccttggcatccaggacacaggacattacacagaacaaatattcaacaaatgtttgttgaatgaatttaaaagaatttaaaaacaaaatcagatttttctcattcagagattcctaaactggcttttaaaaaaatcagaatcacctgagagttcttaaagagcaatagaaaatacagacttcgagatgaactcagttggtctgaggtgaggcttaggtatcctgatttttttttaaagctctccaaataattgagggaaaattagaatagtgttttctaaaactcagtccttttagtaccccttcagattttcttatctgttttatgtgtactattatttatttatttatttatttatttatttatttattgagacagaatcttgctctgtgacccaggttgcagtgcagtggcgcaatgtcggctcactgcaacctccgcctcccgagttcaaacaattctcttgttttagccttctgagtagctgggactacatgcatgtgccaccaggcctggctaatttttatatttttagtggagacggggtttcatcatgtcagccaggctggtctcgaactcctgacttcaagcgatccgcatgcctggcctcctaaagtactgggattataggcatgagccactgcacccggcccacttagtattttctttaaactgatttgcttttagttaactaactttattttgatagggaactttacactgtaacacatggaaaaccagttttctatgaattgtcaaaaaagaagaaaattataaaaataaatacaataaaaattgtttttaaattctagccagatagagtcatctgaaaagacagagtgtaaggtcagttctcagtttaaaaaaatcaagatttgtaagtgttatgagagaggttaaaaaatattaacatcaaactgagactttgggcttgatgtcatcagaataatttataaagcaagaaaggagggaataacttcctcaattatgtgattcaatattacttacagttgtgtcttacatcaacagaaacacatatcctagactttgggaaacacaatgatatacaccaaggtagtatgttaggtgattcatgtatgttgattttaagtatttatagaaaatgtactgtgtcaggcaaaatattgggtcttgagaatagaaaaacacgtctctgtccttaggttgtccagtgttatttcacataccttctccccattaagaaccgctaaatggtgggtttgatgagttatttgcataaacaaatagagctgggattcctgtctggacactgaaggcctctgtctctcaaccatatgtaactgcagctttcaaacctggtaaagggtaggattgtcttttacatttgcttcctataatcatgacacagtagtgcctaatacttactgtgggctttctgtgtgccactccatcaaacacattgtgtaatttatcccatctaatcctcacaagtactgcatgaagcagatactataagtgacggctgacttcacttctcagatgagaaaactgaggcacagctgtaaaaggagacattatacatcccagagagcacaaaactacatcctctgttttacctgactggctgaatccctgcctatggcttttcttctattgtattacctgctattgctatttaaatcccatttgcttatcctggtgtgatcagaaaaggagcatgtgactccaagggtggtctcattaacttctggttattaaagaggaaaatgtggaggactcggggacaggtacagatggggatggttggactaagaattaagttaaacgataagcaaaacggagagaataaagggaatatttcactagaggttaagagaaaaataatgagctcttttttaaacacaaaaggagaatataagtggtgaagacggaagccaggctgctggagcttggcagggggtaatttattgatcgacaagtaagaatgtgccaaaaagaaagacatagggaagcaaaattatttgctgctgctttcacaatgggagacatccaaggaggcaagaggagatgtaaatttcccaggggaagaagattatgaagcaacattcttgttttcgagtcctcaaaaggcaaagcattggtttttgatgttgaacaaggatcaaaccacacaattgcccctgggtactgacagacatctgaagctgtttggggtacaggaaacagagactaaatattcctgagtcttgagtagagtcagagaagtcctgaatttgctcagggaaggggctcaaagggtttctgtggattttcctagagaaaggggtagagtctggaattagaggcaaaaaaatagctctcaaggatactgctggagacatgggggtggggggaatgcttgaaagacacataaagggtaagcagactttgttcgcatgtaccagattaaagttacattatctatcccaacacagaaaactgcttgcagaaactgagatggataaagacagctagagaaaatggacaccatagtttggttcagcatgcaaacaaataaagatggcagaccaacctccctccctctataagtagtatatgcagctgttctatttgagtattcatttaacactttcttgttaatttccaagttctataaagactctgactcacaactctctccgacgatttattttttccttcacgagaactctctagtttaaaatgacattctattctagatatatttataggcatgtacatttttttgtcttgaaatatagaaaatgggataaacccagatcctgagatatgacaccaaatatagggaggcatttttattttttaaggttgcagggaagctaagtttacagactgtttggaattttattctctcaacatatatggcacttgcaaatgcttctgttcatacatttttctttctttcctagaagggaccagtgccaataaagctcatctgtctgagttatggttttttccttctgataatcagcaagaattatgcaaaggcacagtgttgttatcaaacagaaatatagagcaatctaattctacctgataatttggcatggcacattgtttttccagaatctatcttaccacagatgctggcgggatgatttttataggaaagcagtccaattaagaggaaaatttctgtaaagtaagtacaaatgtctaatgttgtatcttaatttgcaaacgttaactgggttaataatgaacttgtgctggaagaaaagattatttttttcccttagtggtcaagacaaaggagaaaatatcaacagaactttttttgggtttgtttttatctaaggaaaagtaacctatttagaagattttttttttattgctactagaaaatagacataaagtctaatattcgatagtggatcctttaacctgaggggaaatgcatggcccaggctgagaattctgcatttttggtgactaatgattgaagcagagaatctaaaggaagattcaaaactaagacccttgactttaacagctttccagacaactgtacctgccatcagcccagaggcccctcacatgagacttaactgcagcttcttccctagaaaggagtgactcctgagcatgtaacctttcttagctcagtgagaacttgaaagtttactgagctttcaaaaacaggcattagaggttgaactcacttacctccctttatccacagaatctcaaactgaggatttttttcatcatcatcttatctgcacttgcagtttcccattctcaggggaattttcttccagcaagggatagaaatattcactaagaagtcttacatgttgaggtcagtatgtcttaggcaaataaactctgaccatacgaccaagttagaagtctcttccctcttatctgtccttttataaatgtattcttccatccaaaagtagcaactggagtctcccagttatctctctgttctgagcattcctgatttccatcttggagctagctacatattattgaatggttagtactaaaagccagatactgtgctaatatttttttctgataacaagtcctatgagatactttaaataatattatccctactttgttgatgataaaactgatatggtgagagcttaagtaaaaggctcagagtcatacaaagacagagctaggatatgaacctggagttgtcactctaaagccctagactctctcccatgacgatttcaactatgggatttctgcccctattacacaataagtagaaataagtctgcccaacacttctcctggcagtaagaacattttgctcacaattttgaacaaacaattattctgttttaaagtatccatgtgactcattccctcagctcctacatccctttgtgtactgtcttgatgcactttttgggtctgttcatatatttcccttctggtcctaaggaatgtaattgacagctcatacatcttgggttgtgttgtaattttgagaatatgcttccctttaaaatacaccaaggtggaataaaatgtctcctccatcattggcagcaggaatatctgggctggacaaacatgtggctccctttcaatgtaggtgccaaactccctctcaaaagttctgggaacttagtttacatctattctgaagaatgaaccagtctcccccaaagtgttatccactctgtttagagtagcccagaagaagcacaagacttagtatttcttgagctttgctgtacaagttagtagttactcagtgttggcgcttctccaactaggatctttcaggctttcacattcagctagatacttggtggtattatattattattattgttattattattagagatggagtctcgctctgttgccaggctggagttcagtggcacgatctcagctcactgcaacctccacctcctgggttcaagtgattctcgcacctcagcctccaagtagctgggattacaggcatgcgccaccacacccagctaatttttgtatttttagtagagacgggatttcaccatgttggccaggatggtttcaatctcctgacctcgtgatccacccgcctcagcctcctaaagtgctgtgattacaggtgtgagccactgcaccccgccgatacttggtattttatacaacataaattgtgatgaaaatctgagtattgcccaaacaacttaagcttttgaatctttattgagcatcttctgacttgctatctttcattcaatctttgtttttatgttccccctcaccccgctataaataccctggtatcctggactgtgggatagcaggttagttgcaattggtctgtctcagagatttttgcccagtgaatgaaaggaaaatggcaacaataacaaccatgattgttatggcaattacaaggtagagaaatctaggatgaaacatatagcaagtgcaatattaagcatgctccctgttaaagtctgggaaagccttggtggctgctattgttagattagcagtaaatgctgttagcaaatgccatagaaacaaattgcccctttctggagccagtgggcatttgtctttgtcgttcctctgggcatggggctcagttttctttgcatggacagcagaggaaatcctgctttggaggaaagcagcagctcttttttatggttctgcactgttaaccaacctcagtcacttctctctctctctctctggcccactgcttgcacagaaaattgaggtaatgatttatatgtcgtaagcagttctgacaggtgcactctatcttggcttcctcctgccccaggactaatcggaagcttatcttttcctttgtgtaatagggagctgtcaggttctatgaccctccaaacaattcaatcactcatgggcggattcaccttggagggaggacgccttgatattggagaaacccggtggaggccatgccctgacatgtattgaaacaatggcagctgggggctagagggcaacatggccaaactgacaaaatgtcatttacttcctaaatttaaactcttctgccaggaactatctaggcggcttttccatgttggtgaacatcctgtcttcagtgcagaacatttagctatctgggcaaagtagggctgttccaaaaaatgacctgtacagagaagcgagggcttgcattgctcatggggaaaaaagcgagttccttaacaagacctatggtgcccagcatgatctggccataagctgcctcaccacctgcatcttactggtaccacacatcccctgcactcagcttcagccacctgggccctccttccacactgtgtttttctgtgctacctcctacctgatgggctttgtgcatgtcaccgcctctgcctagaacattctttctgctcctcttcttactttcctcctgctgtggtttaaatattaattgctcaggaaattatcctctgctctccctgaaaagatcaaattctccccatcatctgctctcctgtacaccattcacctttcctctagaggccccattacactgtcggctttacattaggagcattttatgcatgctttttccaacccaaagagatggctagctccatgaaggcaggaaccatatctttcatgttcacttctataactccaggactaatcatagtacctggcttacagtagggacttaataagtgcttgtggaattagtttttaaaatgcatagcaagaaaccgaggtggtgcttatgttcttaattggtttgaccgtcaagtagtgcaacggcatatctaattgggactggtgtggcggtcacctctgagtccatctgcgtaaaggattttagtatgggaaggaataatgataaccaagtgtggctttgttttgtcacttctatcttaatctctaaccttataactcctgaactcctatctttgttgtctgctttgtctgctttgacgatcttatgtttccctcataggatgcttttcttagatgctctttgaatttggagagcctatgatttaaaaattcaagctttcagaagtttctaaacatctgtatatttggttttgaactggcaagataattggacagagttttcgctttgtatctggatgttttcgcattaaatagtcagtgtccttatttaattgaatgttgcagaactctcactccctgaaaataatgagaggaagtgagatcacagagtagagaagaaaatgttgagaaagaactcaggcagtttctaaatacacaatgggattgactgtaatgttaggcaggggcaaatgaagtacatgccgtcaccatttttttttgtttgtttgtttgcggttcaggattgctttatttttcacattaatggtatcatgctatgatcttatactttttaaaaaactcatccctccctccctccctccctccctccctccctctgtctgagacagggtctcactctgtcactcaggctggagtgcagtggcctgatctcggctcactgcaccaggctcaagtagttctcccactgtagcctctcaagtagttgggactgcaagtgtgcaccaccatgcctggctaactattgtattttttgtagagctagggtttcaccatgttgcccaggctagtcttgaactcctgagctcaagcgatccacccaccccagcctcccaaagtgctgggattacaggcgtgtaccaccactcctggcccgctgtgactattttcaaaccaaagattcctagtcactggattacaagccccatgagagcagagaccatacatgtccatcatgactatatgtatggaatcctttttaaataagtggcaggtaagattaatgttaggttagacagaaggaaacatttgtgaacagtgatttgttttggattggctaatggttcttttctgcttcaagaagtctctaaagtaggataaagcccccatggctcagagggttaaaagccattgctgttgggaggccaggtaacatggtggttaagagaacattgatgcaaaaatcctcaataaaatactggcaaaacgaatccagcagcacctcaaaaagcttatccaccatgatcaagtgggcttcatccctgggatgcaaggctggctcaatatacgcaaatcaataaatgtaatccagcatataaacagagccaaagacaaaaaccacatgcttatctcaatagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttggaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtttcaggacacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttgaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgctgcatatctacaactatctgatctttgacaaacctgagaaaaacaagcaatggggaaaggattccctatttaataaatggtgctgggaaaactggctagccatatgcagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatcccatttgacccagccatcccattactgggtatatacccaaaggactataaatcatgctgctataaagacacatgcacacttatgtttattgtggcattattcacgatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattggacaatgagatcacgtggacacaggaaggggaatatcacactctggggactgttgtggggtggggtggggagggagggatagcattgggagatatacctaatgctagatgacgagttagtgggtgcagcgcaccagcatggcacatgtatacatatgtgactaacctgcacaatgtgcacatgtaccctaaaacttaaagtataataataataataaaaaaaaccacagcgttgcacacacttaaaaaaaaaaagttcccagaaatcctgaagtaaataaatttgcttaactgtgtttaagctagggtttcctatattacttgagccagagacatttgtgtgagacagtgtgtgtatgcatgtgtgtaccactgcttttaacagttttctggtaaaaagaaaataaactcatctgatcacaacaacaaattacaagagcatgacccaccttcttccacccaaacaaacacaaacctaacacctttcaggtagaaaattcctttccttgttgctaaaccattctaaggaaaccagagaataaaatatatttttctgttgaaaacagtctcctttaacatgaaaccacccttgtaagtagttttctccaaccaagatcttgtttttatgcgtcaaagacaagatagtatcttgctatgcacactacccctagggaaatatttaaaatatttttctctggtaaggactggtatttaaaatgcttacatcaatgcatcagtcgaagcccggcttgcaacgtactaggatcaaagtgatcatgtcctctattgagttggattccaaatccatttgcactaattattttctacaaaaatcctaatgcataatgagcagaggccctagaagtcctctactgatttcaaattagttctttgcataacctagtagcaaaaagggatctaggcatgtatttttgatcttctattagtaaagtctagttgaaaaataaataaaagtcagctctttactttgttaacatttttaggattcttgagcaatgccctgcttgggtgttgtatgccatgtacatgcctgcacgcacccacacatgcacgtgtagtttcggggaccggagacacacccattgctctagcaacagtgagctcacacttcagaaatgggacctggtgtgggctgaatgtctttcccattacgcttataattcagataatttcatctgaaaaattcagaaaataaaagtattctctccttcaatcatccaattatccttgatttttcacttcctttgaaaagtatacagagagccctttaaatgaaaagatgggagaatcactctaataacttctcatttgagaaaatcctatctgggtcagtgtgaatcaggtttggaatggtgacaagatccttacttgcaaagccctaaaaaggccagaactctgccctgtcaaccttcccacatctctgaaattcagaccatttaacaaccaaggttagggaaagacaatgtgtcagagcctgtaacactatcaggctttatggccagggaatctcaagataaatggcaccagaggccatggaaacatccagattttcttctgtaatgtgattcttttctttttctgacactagtggacgtctcagcttgccactgccattgagtgtacatatgggaggtgtcctttattagttcctatcacattcaagaagccatggacaccttccaaagggtttgggagcaaaagacaaagagaactcgatcctaaaccaggtatagggttctgcttatatttacgtctatgttggatctaattactacatggtaagtgcagcataacaaaggtacctttgggatgaaagaaaatattttattgtcagtgaatacactctgaatgcaaggcagcgtaggagagtcagtacaaaggcagattcaaagcataatgaattgctagtctctagatgtaatactacttcgaacttttcaatatattcatcatgctttcctgaaactcctagtctctaggtaaaagacaagatgggaaaaaagaggagaaagggattaacataaactaagcgtctattgatggcaagatattatgctaaacacttcaacaagtgactttatcagcccaacctctgtaagaaagtatagttattattctggagtcagcttgaacctggtttaaaaatatggctgtgccacttagtagctatagacatgagcatgtcactatagctctctagatcaaatgtcctcatctgcaaaatgggaataacagtagtacccactccacaggctgccgtctgggcatagtgagatggtacctgcctagcagaaggcctggcacataatacatacttaataaatgtctgcaatagtgttactattatagcacactggcaactaagtaggctgtcccccatgacttgaccaggagtaagaaggggaaagaagttgagttataaaaggcactaacagctcacaatcacagaatcatcatggatgctcattctaaatcaaatcactctcttagtgtaaaggcaaccacattttgataataatgttgtcctcagactgatctatacagaaccttgaggcaggaggagacaagaggaaaaaggaagggattttaaaaatcaaatctgagaatctctacttttgagtagagagatcattatgccaaagggtctcaaacccatctgatcttcaggatggccaagaatatggccgagaaatacgggtgggtgtcttggccacactcctggagattctgagtcacttggttggagatgacttagatgttcccagagtctgatgatcatccagctttggtaagccatgacctagtttcatgtacccttcctaccccgccttttcccaaaattaaacagaaagcccacctgtgcccaaggcaccagtaacttttacaatctccttgaaaagttgttttccagcccctgcttactcatatgtgttttggcttacactgaatattcagatgcatatattaggcattctattttagtacaagaggcaggacagcagcttgggttttagagtcataaagacgtgcactcaagtccaagcattaccacttactagccgtctaacctaaggcaagttccttaacttccctggcttcagctatcacatctctacaataaggataatatcagtgcctatgttataggtttatcttgaagattaaattagccaatgcatgcaaaatgttcttggaacattagcataaatgttagcttctcttttaattccaactgaagtagttcctttggctgacatggaactcaattatcatcatgtctctgaacattagccaaaaatattagccaatgagcagaacagaaacatcccaaactctcatcccccaaaggcgaaacatgtcaaaacacaaaggcttgtcagtgagggtagtggttaaattctcgtggagggctttctgatcccataactgaaaccccatgacactgacagatacaatcagataatgatggcaatcaataatgataacagaaattattatttattttcataaacacagagtatgtgcatcccactgagttacacacatcacatgccagcattcactttcagggcagtcaatcaatgagagatctcaatatccacccgccgaggcaggatggggaggatagagcgaaggttgagaaattacccatactagaatgacacattcacaaagttaatctaatccaggagccgttggtgccattgcaagcctgtgaatatggaataggcttgattgatttttcactgcagtagctaaacacgccattgttatatgcaacaaatgtaaggaaaggaaagatgaaaccataaaaggattggatgtgaagcccccagagcagcaataaatcacaaaatgaagtctaaaaaaattaaaaatggtagaggaaggctgtatctatgtcctaagaggcctcagttatcaaagcatataccgaaaattaaaacctggggcagtaaaggctgatcctgactcaaccaataatttgcactaaatctggcctggggttccccctcctcccagaatgagtattacgacataggtacctcagagggagcaagaaagcctaaaggctatagacagacagaacgtgcttcattcccagttctgcctctttctagctgtgtgatcctgattagatacctggcccctcagagccagttaccctcttttataaatgggataatcacatccacaccactagaaagaaagaaatggcaatgcacatcctgtatgcctcaaaggatccttgggagcatcaaatgagatgcccaacatgaaagcccatctaccctccagatgcatcgtggaaactccttcctaatcccgtctcctccctttgtgcttcttctgaactgccatggttatcttctgtgcttttctcaggacagttatccttctccatgatttctcaaagtgtggtccagggaccacctgcaccagaatcacctgggcattttctgggaggggccttgtcaaagatgtcatttcttagagtccaactcaaaccttctaaaccagcatccctagtgacgaggccagaaattatgttctaggcagagtccccggtgaccatgaggcacacagtcatttaagaaccaatgattgaattcattttatgtttcagccacttgtaacttgtctcctccatgccccctaaggacagagagtgtgtttcattcatctttgtaagagccacactttgtagtgcatgcttagtacagtgtgtagcatagtagacactgagatacaaaatacatggaaaagtcctgtacatcagatgttgtcatcctcactgttgtttaaatcaagtgccatgccataaatagtcctaataatagtgaggaacaggagctctggagtcagacagactctggagctctggactccattcttggctttgctgtttactatttgcaaggccttaagccagtacttacctttctgagcctctgtttatacatctctaaaatgggcaggatgcctaagtcacagaatgatgataaagaaaggacatcaaacaactgcgccccaagcctgtcactaagaaaggctgaatatgcacagttgctactattagtaagcctaaaccaatagtctgtttaatcagttctctaggagacaaatcaagtaaactgtttcactcagaggatctctcttttgggaaaactagctagtcttttcagtcaacttgcctaatctcatgaccttttagcaatggtcctcaggaagtcctcattcaggagtcagagctggtaaaactgaatgccagttggccagtgtcttagacggtacctatggttgtgtccaaattgccaccaatgggatttgctaacatcagggtcattttaagtggaaaaagtttagttctggagattcatgagactgtgagtgtcctgtgctgacaggaggacagaaacagccattgtgtaaaatatgatgtcatttgatctttcctttaaaaatcagtgcatcccttgtgtacccaccctgtggcagaaaaggctctgcagccctcaccccccgccttccaccccaccaaaatctagcttgtatgttaagagagctttgataaaacgttctgagagacatcaatcaataataaaacattcctgccccatggtcaggaatattttcttaaaaagcagagctgtagagaataagatgaaaaacatcagatttggagtcatgcggactaggtttgaattccagctcttccgttttctagccatgagattttgggcaaacttcttggctactctaaaacacggtttccatttctgtgtaatctgttcacttgacagatatttactgaaagtctaccatgtgccatggattgttccaggtgccggagttgcaggagagaacaaaacagagtccctgctttcatggagcttacagtttactgggggtgaagaggaggcagacagcgaagaaaatgctagacagtgacaagagctaagcaaaaaagggcagagagaatgaatgggaaatgtgggtgtgctcttttccataggataccctaggagggcctgataggtagcacttgagcagagactgaaatgaagaggaggctatggcttcagatgatctggagagaaaaatagaacctaaccgagagagatattatgaggactatgtgatattaaggatataaaatctagtacctggcacatagtaagcactcaatagatggttgctataattatttttatttgttgtaaggcatgtttgaataaaatccattcgaaaaattgtattcatcacatcaccttcattttgggaaggttatgaccagtcacagcttgggagctcatatttgtaacaggtaaaaatgccgatttcaacctggcctaggttcccagggcactggcagctgataataatgagaaaaagaatacctccaggcttaccctgcagggagaagtatgctaagtgtgatttctcaccacccaacttccatttcaggctgattaagtcactttaacgatgagctcccattacctagaaagagctctaagggtctgttactcctgggcagcgggaggttggggaagaagggcatggagggtcttctgaagtaaaactgcatagggacctcaaggcctttgtttctccattgctgaggtcagagatctggaaagtcaatgtgtaagtgtgtgtgtatgtgtgtgtgtgtgtggcagggacagtggtagcggggagtggtggggggagggagagagagggagaggaagagagggagagggagagagagggagcgattgatcgattaatcccctcacctggaataataatggcactaattattaagacaaacatttcaaatgcccagatgtatatgtctaagtttaagagcctaactcttgatttttagtcccagtcctggaataaccagttgagggatactgggtaagtcattttccctctctgaggctgcatcggatcgaagggctcaggtcccagagcaaagtagatcaaagcttggttctcagccctgcatgatcttgggtattctacttaactgcttggagcctcatttgttaaatgggcattttaacaccctttgaggtagctagtgcagatagagagtgcagcgtggtgcatggtatatggcaaatgatcaataagtgctagatacccgcattttcacctgctaaatacctgtcctgccctcctcattggctattctgaagatgaatcaagggactaggtgagaaaacgcttgtaatagaaatggtacaactgtaaggcattattattaaattattaccatgattattgctttatgttaagttatgatattgagcaggggatatagttttcatagacatgcttctcatgggctcttttggtaatgagattgattttgaaaggctatcttctatgaaagatatagtcacattcttgctttgaaaagctgagtctctcagcgctgaaacagaacaggttcattacacagtaaggattaattagctgtcgggtattattaaatgttctcactctcaatacccacatagaactggaaactatgaaagtgagcaagaagtaatcatagtacagggaagggaaaaaaagacacaattgctggcaatgcacatttcaagaggagagcgtgttagtaaattatagtctgattaatatcacgtcagctcattctctgtttggagtcattgttctgaatctagtcttcagggttgcctgctttttttttcttctaccactgggatcaaaaagaaaaggaagctggacttttcagtgtttaaagagtgctgtggtgtggatgtttacactgaaatgcaggatatttgagagcctaggaaaggagaggaggtaaatacagatactggtatttataattatatagcaaatataacatgtccctccaaaatataacagaggttatatagcaaatataacatgtctctccaaaaaataacaggttcataaaaatgatagcttgaaaaaaaaaatgatagctcgaatgggccttagggatgatagagtccagtgaccgcagacccccttgtctcagccaccagggtcaagtgttgaaaatgcagattcctctgggcctcctctctggagtgggtctcaggaatttacatttcccagtcctctgcttggcagcttagaaactaagcttggagggaagaagtataattcatcagttaggttgttaggttacacagctggttagtaagaaagcaagaaccagagttggaattttccaactcccagccacacctcagggcctccttctctgtttcatctgaagtccacttcattggcatcactggcttggcatggggaggatctctgctctcgtggaaactgaatagaccttctttgctctttatcatagggatggaattctcccaggggttaagcacagatatatgaaatcccataggatgccatggacagtaggattccacggtggggtctacagatgtcatctgagaaattccatccacatagcaaacaagggcaaggtaaagtctgggcagaagttcacggtataaactctacgtggcacttaatccagttgttttctccataagattgccatgtctcgaggggcaaaagacagtcttattcccaatatattgccagtacggtgtttgccacttagtaaatctcagtgagtagtttgtagaataaatacaacagtataaaaagtataaaaagaaaaataactgaattgtctcatatatataggcccactatcagtagggggtaataatagccatgatgacgatgatgttattaatactaaaacaacagaagggaactaacatcattgagtgctttttgtgagccagcactacacaggctaagctgtttcttacacaaaataacttattgaatcctcacaacaattccaggaagcagtgactatcatcatccccgttatatagatgagacattggaggcacaaggtattcaaatatagccacatgccacatgatgttttggtcaataacactggttccataagattataatactgtatttgtactgtgtcttttctatgcttagatatgtttatatacacaaataccattgtgttataattgcttactattcaacacaggaacaggcgtacaggtttgtagccgaggaccaacaggcaatgtagtctaggtatatagtaggctataccatctaggtttgcataagtatactctatgatgttttcacaacaatgaagtcacccaatgatgcatttctcagaatatattcccatcattaagtgatatatgactgtcatatgcccaaggtcactagcggaaagtaacggagccagaattctaacccaggctggactgactcaacaataatactcttcactacgctactttccagcctccaaaacccctgcacattcagagcatcaagcctggatttatgccaagtccacccagaatgataaggtggacttacatggaggttctccagagctgaaagcataggctgatcagaggaaacagagtcgccaatgcttgtgagctcagaagcagctcaactgaagaccatgtgcccattaggacagggtaaacacctaatagtctagcatggtggtcagcacagagtctatattcaaaaagtaactgctgaataagcagatgtatcaataaatgaattattaaacaaataaacaagtgagctaattaagcatacaatgaccatcccattttggctttcaaacatagggcaagaacctattttcctcacatctacttcactgtctcccttcttacttttggtctttagcagagctgctggtgtctgaaatcacatattttacacagttttacaaggctgttggggctagggctatcccaacatgtgcctgctttactgctcacattgaacatgttcataactgagctcatcatccagtcctaaaccactttaccttacatctagagacccttcccttaaaagatcgctttgagaaatccgtttttaatgccactttcctatgagaacttttctggtctccaaaaaccacagctaattttttcctccttttatcaaattgcaactctccaacactttctcaatgcatttatcttactatatttagtgccataatcatttgtatattagtcttacaaatcctctttatcaggctatgtatttctgaggaacaggaaggaagccactcagactgagtagagatcatatattgaggaccagccatagaggaagggttttccatccttgcacttcttcctcataagtccacgagcagtacgtactgtgttcactgttttgcagatggagaaattaaaattaacttgcatgttgaaagctcgaaaaggttaaatgactattgggaaatttgggtaagtggcagaatttgaagccaggtctgttagattattaagtttgtgttctgaatcacaagactgcaactcgccatctggattctcatccctgtaccttcagtacagaaggtgctcaagacattttagataacgtgaacaacagaggctaagattatagtaacgtctggcagtggccatgtgggcaagtcttctgggacaaaaggaaaagcatggatttgtagtcattagaaggcttggcacctttcctgcttctccatctgccaccagagagagactggggtaggctgagtctctgcctacgttccctcactggcccattatagttgcaacctacagtaacaaccagcacatggccaaccttaggagacctgcccctgactgtggtggccagggcagctgtttgcactcacccgcagggttgtgatggtggcaggatcccggagccggccctcctcatctttcagattgtagccttctggcctcttatcacgctcgctgactttccacagcttcacagttttatctgtagtgggcaaccagattaagtcagaattatagtgaaaagcaagctcataagggagttttcctgggggcaatggggagaggaagaggtaaggatggatagaattgctacagaagctggctcacataaacgtttggcgtgcataaatcccatgtcatttgaaggcagagctcatatttcaaaacaaaaacatacattatgctgggacaaatggatttccctgataatgggctcttaaatctatagcttataccttaattcagctcattcaataaaagcatttattgagcattgaataataagagtgcaacatacacagagcttacaatgtaactaagaattttacatgaaaaattggtttaacagtcataactctggaagtaggtgctattatctctattttagcatctcacctcactaacacattgtccttaccatgtcctaaaaggcccttcatgacctgccctctccactttctccacctttctgacccccctgtccatcctctccctgctcactcactgtgctccagacacatggcttccctactgctccaggtacacattaagctcactaagcctcggggcctttgcacttgctgtgtcttctgtctggaaagtcctttaccctctttttcgtataatttgctcctttactttcctcttgcgcttgcatcccaaccttagagaagcttatgtaatacctacctaaaaatgctgtcctcagaaccattctctatctcctctctcctgctttatttttcttcatgataccttttactacctgacaattggttgattatttatcaaataactatctgtctctttcactagagtgtaaaattgttgaaggcagggattctatctatcttgtttatcactgtaccaccagcacccagaacagtgcctggcacacaatagctgctcaataaacattagtagggcaaatgaacaaatctcatctacctgcatagtacatatttctagcaatattcagggaaataaaatggtaaggagatacactgaaatgttcctttccttttgctgcctctatggagtctccagctggaaactacctttctcacctttgtactgccccagcactttttacaacttgatgacacctggcattctctatagcattaaaacagagaactcctatccctacagaactcccatgagaactcccatccctacacctgtcatgcaggccaaggaaatgagtaaaaagggctaaaggatctgtggagctggaatggcgtgccctacatgcaggcttttaattcaattttttttttttttttttttttttgagacagagtctcgcattttcacccaggctggagcgcagtggcacaatctcagctcactgcaagctctgcctcctgggttcatgacattctcctacctcagcctcctgagtaggtgggactacaggcacccaccaccacgcccggctaatttttttgtatttctagtagagacggggtttcaccgtgttagccaggatggtctcgatctcctgacctcttgatccgcctgcctcggtctcccaaagtgctgggattacaggcgggagccaccacacccggcctaattcaattatttaaggagacaagatcaggcaaacaaatcatgtctgctggccacatgctttggtgggcttgccttatcagatccagtgtacattttttatacttgttttaacatatctttttgaaggcagaacttggttgccttctttgtatcttcctctgtcttgcacaaggtagggtttggaatcagacaaccttgggcccaatccccactctgacgccagtcacatgtccaaggacggggattcccactcagtaggtacataacccttcctcccttccctctctccttccttccctccctcccttttttccttccttctttctttccttccttcccttcttccttcccttcctctctcctttcttcccttcctctcttcttctttttttaaattgagatagagtctcactctgtcacctaggctggagtgcattggcgagatcatggttcactgcagccttgtcttcctgggctcaggtgattctctcatctcagcctccagagtagctaggaccatagtcacatgccaccacgcccagagaatttttctattttttatagagacatgattttttcatgttgcccaggctgatctcaaactcccaggctcaagcagtctgcccacctttgcctcccaaagtgctgggattacaggcatgagccaccacacccgaccacaactagtatttcttaagcaacaaataggattgccagatttagcaagtaaaaaaatatagaacacccagttaagtttgaatttcagataagcaaaaaataatttagtatgagtatatcccatatagttcaatcttacaaagaaagatggtgcctcagtttctttatttgtaaactggggaaacagtatcttcctcatggggctctgatgaggattaaataagtcacagcatggagaatgtttaacacagtattaggcttctaataatggtccgcaaatgacagcttttattagaattagcaaattgggcaactattctgccataataacatgttgctctgacagctttagcttcaaccctcaatgatgtcagcacatcctatttcttatctgtaacactgtcaggggagaaaagccgtccctctgggaattccttcctcttttgccccttgctccattcctccacttctcctcacctgactttttgccaccacctcccacttctcatgcctttgggcggacagatcttctaagcaggagatgtggatcacagtaccattcgccttgaagctgccagaaacaaatgccttgttcttggaggtcttaatgaaccacattgtgaagtgggctttcagcagcaaataagtgccccattttcttgtatctgggcatcacttgggctgctcgtgtctgacacactggcaaggctgctaagtgtatgatttgtgcgctctgaattgtgccgtcaccctggcttgcgctggagcgaaaggagatcctgctgcataccgaactgctttttagggtgagaaaatgaacatgggccatatttatatagtcacgtgattagctcttgatcagctgtggcttagaacatccccaaaattttaataccaaattttttttgttgcgtggctttggaatgtatcccatcccatttgcaaagttaacatcgtatatttttcttatcatgaatgataaattgctatacagagaaacagagaaatcatgggtataacatgaagaataaaaatcacctacaacctctccagtcaggaacgatcatcgtcaacattttgcataaatccttatagtactttttctatgtactttggggggagaatacaaatctgtaatattgcatatatagattttgtattttctcattttatttccttctttttattatacaagcgatacatggaatgtttattaaaataatcataaaggtaaaaaaactcccttaattccactagatagagatacctattatacaaattttgtgatttcttttatatttatgtatacaattatgtaactgtttttagtaaacataatatggcatacttagtttacagtatgcatttgcctaatcatatttatctataccaacgtctatccctgcaaatatatttatagggatagaatatatttgtatactataacgtattgcatatatgatttataatagtgagaatttgttaacagctaaaggactaatcgtaggaggcttactagtaaactaaagaagaatcatacaaggaaatactatgtggtcattatgatattttagaatatttaacaattgggaagatattcctattattaagtgttatattaataaaaacctagttacaaaagagtttgcagaatatatcatatttccattaagaaacaaacaaatttatttgtatctttttgctttttactttaaaagacttaacagtggttctctctggatgggaacacttttattatttttgtttttctatatttttttttccatgaacatgtactaatttcatagtgagaaaaacaaattcagtataccccacttctcattataggtattgaagtggaagcagaaaatgaggtaaaacaatgtgtttttatgtcataaataatttgagagtctagattcacaattgaatgttggttttattttttattgaaattgtaagtttgaaaatatattctagcagaaagtaaaaattgttcctaactataataagataagcagtatattttcttaaagataattgatagtgaattcaatccaattccccatggttgggttgcctggagtcattcttgactttattatcacactttttttcttgactcagtatcttgaagctttgtgaataaaaaagtctaaggaacatgtggctgttaatgagtaatgactttttctttcttcttgctggttctctgagtagtttatcatcgcttgtggcagcttttaaacacaatcttatcatctatcttcattttctcttttgtacagtaattccaattgtcttccattaacttttgcatgttaacctatttggcctaagggggattctcaacctcaatattagtataaaaaagaaaattacataagaacatgggaatttttcttagaagaatcattttgagatgctgttggcatatgaaacagtatcccaaatgggaagataatatccttgttaatcaaaaaactatttaaaaactcaattaacagaatattatgctatataattaatcttcattgcatttcactgattttttcccatccccccgccaacaaagtagttaataaatccttgagttttttttttttttgagatggagtcttgctctgtcgcccagggtagagtgcggtggagtgatctcggcttactccaagccccgcctcctggattcacgccattatccggcctcagcctcccgagtagccaggactacaggtgccggccaccacacccggctaatttttttgtatttttagtagggacggggtttcaccgtgttagccaggatggtctcgatctcctgacctcatgatctgcccgcctcggcctcccaaagtgctgggattacaggcgtgagccaccgcgcctggccaagtcttcgagttttaaatgcaataatcaataggctaaatttgagaatataaagtgagttagctatagaagacaatcagacatttttcctctgcctaaagtaattaagtcaaaatcatcagaagtctcttttattccaagtagtgttgaatctgcaaagcccgttagtgaaacttaaatagcaaaattaaaaggaaagaaattgaaacaaatttatgtggtttggcttccaagaaatcaggattgcaaaacataaacagaacaataaatatagttatgagaaagaatcaaactacttggagtctggaaaaacagatgagtagagatctggtcatgaggagatgagatatgcttggataatcctaaaccagctgcgtccgaattgtcatttttttagacttctatgctggctttatatttgagagatttggggttcaaatgcattaaataactttccgcttttttccataagattaatatgagactcattgtaaaactttacaaattaaaatgacaaaaggaacaaattgacaagttgcccatactgcacaaaaattaatcatgatgaaccttatgttgtatttccttccagtctttaaaaatattcatgtatgtttgatcacattattgacactgtattttttcacttgaaatatgaacatttccctttctttttaaatcccttgcttcttgcttctcgatttaaattaaaatgtatattcctcatagactcacatatgagataaaatgaatcattctccaactcattttcttgggagagagtgtttaatttttaaatacgaatcctcttaattgttatgctattcaattagcaccctttaacatgtgactttatgccaagttgttttgagcttagatggcttcttttagcaaggatttaagaacctggaggttaggtaattccactgtataaagacttacccagtcattatgtaatttgtctctctattcagtacccaacatcctctctctctgacctatttatgtcaactcctcctcatccaacaaatggtgttaagtatggagggagataggaaaagaaaccctttcttgatcagttttttgataaagtccctatctcttcttgccttgtgctcctatcatagaagttaatttttgtcagagagacacacagccatctgctttacagaccctaaaatatattcagggattaataacttctattcaatatgccaacctcacagagacagcatgttgagtttcctgaaatgtattcccagaataacattcagtgaatcttaagacaggaagtcacattccaaaaacacctgcaaataatctgcaatagttgaaaactgcagataatgggtctcacataattgggtcataaatttaatattttaaaaaacagtagttactatttattgagggccgaatctgtgtgtgccaggcactctgctaagcatcttgcaaatgttatttctaagtttttcaacagcccacacagttcaaaggaaattgaggttaagagagattgaagtatatagtttggccgactgtatctctgaaaataccaaacaggaattccacctaccattagtagacagaagaaagtaagctgcattctgctgggggagccatcttattttattgattttttcttctatttctaaactcttcaggtaatcgaactcgggttcatggctctggaatgtgctgtaaacattgtattcacccctacgatgaacctgatttttactctgtaggaaaggaaaaaaatacacaacagattaaatcacagtagccaactgtaaaactcgccaactcccttttttttccagcagtcattgggggtgggatgagggcagggccatgaggatgagggcagggccatgatagtcactagcacctctgaaaaaaaaaaaaaaaaaaaatatatatatatatatatatatatatatatatatacacacacatataattatacacatgaacttctgtactatcatatagtatacataatacatacatagaaatattaaaatagaacaaaattttaaaatcaatataaatagaagttctaatattttctttttgcatcctaacagatgctgcagtcaccctttggagtgagtcatcccacagtggcattcgtaaatacttacatcgaccccttaaagagagtacaaaattgtagcatctatgactttcattggccttttaagatctcacctgattctcatgaaatctctgaggtagggtggggcaaggaaatggacaaaagaggctcagatattaaatgactttccctaggtctcacagctcataaggagcagatttgggcatcagatatgcccctgctccttttttttttttttctttccaacatgagtgacaaagcagacaggagctcagggatgctacctgcatcattaaggaatgatgagactttacctcttggctttcctctagcgctgattatgcaatgagcaaacagcagggactacatacatgatgagagaattaaacacaagggcaagggtctgcagaaacaggaagaaaaagaagaaaggaagagaggagaaaaaaaacaggatgtgaaagaaagaagaagaagaggaggaaagtggaaagggaagttttatttcagatattttaggtccttattaccaagagcttcaagaagcaggctttgaaaaactcaaaaattcaaatatgagtcttattaaacatttgttataaaagcttgactcttaataaaagggttaatttccaaatgtatatttctaggtggatataaaatatccaaacccaaatctcaacttactgaccagtgagagtgctgaaccctgggtgtgtaatgtatttgtgcagactctctgggtgtgtgcctcctgagaattcactcctggagctcactcactgaagtcaaaagcaggtctgccctagatgatgtcacatgggtttgtttctcggatttagtgctcattttaatcccaagactggccacaaagcttaacgcttaactgcaggttctttatcctcactgacatttattttttattgaacaaaactaccctgctttagaaaatgtgtcccccatcattctacgaatgaatcaggcttcccaaatatttcactaaattaaaataggtgaaacctataaatagctaatggaaaatgtagagcagaatattactggcaacatgctgccttgggtaatttatgctaaatagctcctccggttcctctttatcatcactgcgaacttaattggtttttttttttttttttttttttaagaaaaagctggaaaaggaggtttgaaaatgagtgttcaaaagactttaaatgctgacatacttggtactatcctgctcatttgcagagagagccagtccaccttaacaatacatttataagagtgttgatttgctaccatccaaatcagactgtcaagtgtgtgtagtatgtgccagaccaattagcactaggcagctctggaaaagcaggaaaaattccaggtcatgaagagctattagtttctacttgccaaccacattttcgtgtttccagggccaatggaataggctggatgcctgatttaatgctgaacacttgaatttatatggaaccccgagggattacgatgcccttatagaaattaattgcaaataatgtgcaattactaaatatatcacctctaaatgaggctttccttttttgaggggaggtgtactgcaagtggctttgaggcacaaagcaggctttaaattgctagggaagtctcttgtgaaaccttcctctcacactgggcctctctcatgcttcccgagtgcccggtgaatctcagaggcaggcagtggcagatgggagagctactagaacacagactggcctgctggaagctcgaagaccatgccaggggaggccaaggaaatcaaattgggccataattccattttgacaaacagaagcagacaccaaaaacctcaatttatatgaaaaagagaaacaattcctagtgaaacccatgtctcaggaagaaatgggtttatgagagttactggaagttagaactcctgctcagaaatggtcctatatgtagcactcagctccagggccctctgtgtcacctacagtgatactgtgatgtgtgtcataagctttactcagacgctagtttgtggccttttacccccttaggtgaggtaagctatcattttcttctctgctgtcccaagttgtcctcttcacatctgttggcaaataaactatgtttttttcctcctgcatattctggcacacctgaaatcaagggagactgaatttcaatggctctatgacagatcccattgaaaaaggaggagttacgctcaacaagcacccatggaattttgcaggtcaggcgagaagtgaagttgttttgcaggtgtaacatccaggcgtagaaagataaggccatgcccagaaaaggctctcttttacagggcttttatgagtctgaatgtataacagttgatgttaatgacttttttggcagtttttagttttcgagcaaagcagcaaggttaagggcgacacataaggattaaggaacagtaggaggcctcctttaaaaagtgaagaaaatgggcattttgcattcaccaccacttacctcctgctctcgttgaaatattacaacccgaccccccttgtcccctgtcgctagtaattctcccgtgtggttgaattctaccgtagagataatgtcagctgcaaagaagaagacaaaggcaatttaagtaactgcacacttactttgaaaggatagataatagatatacttttctgtgcatttaagggcttagggctttgtctctgcagtggaatttacaaggatgttatgttctgggttttaaatgccaccagaagtggcacttgggaagtaaatttcctagatgcccacactgcacagtggtctcctggaacatctggagagaataaaagggaaaaacacatttatacccttttaaggaagagaaaattaacttcatgatggctgaaggaaatggctattttctttgatgatttctaccaaccacagacccttcgtgcatccacggcctttacaccaagaatcttccccacacaggcttcagttctggctattcaaatcagggctgggggctgtgatgaagcagggttaggatgcttgaagcttagacatggaaaatggaggaacagagcacaaagaaatcattgggaaaactctgccagtcgataattcaaggaaggaactgacgaatgctccagcttggcccgtgccccttctttttttgtgagcccaacacatccttctggaagagcatgacttatttcaaccccaggagaagggtgctgagaaaacaaggtcataagggcagagaagtgagggcaatttgtactctgtatttctaatcagagaaaatgcacaggcaccaggaactcagatcacagataattgctgaaggaatgccagcctgccaagtctttcttctatgctggttacccctggaggaacatggacaggtaaattacctatgattggatttattagggctatttttagaaaaatgtcagaggttaattcccccacaattattcccctgcagggctccaacaattgctaccaagagtgcaaatgagttaaaaaaaaaaaaaaaaaaagaggcaggggaattatgactatggcctttgacaggaacattctgaagataatgtctaggtaaggaaagcaaaggggaaacagtgaggtggaaaactaaggcaattacccctgagtaattctgatctcaaatcttacttttatatcattatttcaggattttctttgtatgcctgatttattcaggtaagtagtgtaaaattctccacttcacatataactgttcttttccatgtatgaaaaggctccttatggtcattcattgtgcagaagttaacaaaaataaggcataaaccttggtcactttcaagctagacacatttaaaagaacaattcttgatttcttgttttgacttcttagataattgacctcctagatagcaaatacaaaggcctgcagggccacaaagtaacataggtgaactagaaggactatgtatgtctcctttaaaggggcaagaggctattcagcttaagctgattggggccatgattgcctgtattgccatgtattgcctgatgttctcattgtttaaatatatataggaagctggaaatcaggacttttatgcaaaaatctcttaaagtttatacattggcaagtattttttccaatgccatgagaatgaaaaagttaatcatatctgtgggctgaatgtggtttgtgggttatcagtttatgacttctaatgtacagagtcttcatttggaataggctatctcattccaatactgatgctcttaactagaaatctagttcattttctcgagaagactccagtgaatactaccttaaggaaacacaaaataagcaatatggttactaagttccagatgtaagtttagaaggtccatttatgtaaccaatgcccatgaattgagaagaaagtccagccagtgagaaagccagacacctcaagtgagttatttgaccactttcctttgttacagtttgcccatcttagcaaactactcccatgtttagacgagagaaggcatctacttaacatttgcagttgcttcagattgccctgcttgaaagtaccagtgctaagttacacttctaacattaaccactgcttctggcttttcaatgaatggttagcaaagggttattcatggggcttccaaatttgggtacagcctaaagcgggcatgtctattgcttttcactttttgtctttggtcaggtacaaaggctggtccagttcaaggctcttgaactgctcaaatacaaacatttctcagaaagaaagagtagcaggaaataatgagagggtggtgggagccaggcctgaggtttacaatgcctggctcttgtctcagagctacgttctaaagttctgcttacatgcagtctatgccctttcactggacagtgattaatgcagaacactagagttctgggtgggctgcaagggccttacaatgagaactaaagatgggcctttccttttggtgaagttgggtatcagaagagagttaagtagcttttcccagtgtgagctcttggctcagttgccaagaagatattactccaagggcaacacttgctttcccaggggatgacacatacattttccttcttcctagactctgaaaatgtctttactctcactttaagacccatgcaagtcaaaacaaggcaggattcaagtggaagtcaaagtcacatgatttaagccagtattattagaattctgcattatggagtattaggcatggtcccaggtaatacaaatatttcctttgttttccaagtgttattattttgcaatgctatgtctccctcaagaaccttgtaagagaaagggtgatttgcatggcaggattctgaaattccttagccctcttgcagagtccttacctttattttaattctactagccagctgctctgtacatgaacctgtttatatcatgctattgtctacttcccttcagagaataagccgtggcagctcaagttaatacttgttttgaactttcatgtttcctgactcatttatcattgctaagccagtaggtgtaactggaatactttactgccccatccatctctgcatatcttcatctatgactgtttaataattgatgcaaaactcatgaatcattatacattccaatttcaagatactgaaacttctgatacaaatactcttgtgtttgcagcatgctctttggtaaggcagtttaaactggaaaatatactgctcaagacaaaataattttgtgatatggtaagaggatgtagtaataaggtagcaagtttagagataataacgtcatttgaaatcatgatccacagaaatcaattcatcaagttcaacatggctttcacctttaaattgtaagtttatatgacaattccacatttcattaactgctcagcctaatcatgctgttgatcaagaaactacaaacttgagcatttttcctctgttgtatatagatgtggataaagtacacaatgactaaaaacaaaagccagaaacagctagaaaggtcagatgtagttaaagtgatttttaaaggaaaccctgggtagtgtgaagtttgccttgctccaaatctatttgtgctgatttaatttccacaagatggtggcctggtaaccccatttctagctcaataggcactattaaggctgagtttattattttttttttaaatcaatctcagcatcctacaaaagttctagactggtaatttcatacataaagtattatttacctgaataatagatattgacttaacaatgatacgcatgtgaggctaatgattgtgaggcttacggaaacagaggaatctcctagttcatccctagtctcttgcagtatcatgctaggctggagtctatgcaatgccagagaattgagttgaggcaggcacctggattattaggtgatatacaactcacataggagggtgactgttttgataaaatggagactcagtttagacttaggatctaaactcaaagtctacagatggaatatcttactgaccaggtcactagcactgacctctcaacatcaatcatagagatggaaatgcaagggtaatgcaatttagttttcagagcccattaaatgttttatctttcatctaagaaacatttggtagataatatcataaagtcatttaccctacttgcatcagctgactagttctgcctactcaatacctggctttatttctgatgactggattgggttttggtagttttcgccttcagctaagataagaacagaaaatatatttcatagtgaatgataatggtgaaatgatcatagttaccaggtttgtgttgagaaggttttgcggggtcacttctaggctggggtgccatgattaatgggtaatgaatctgggtgggtggtgggggaggtaggatgtgtatcatttgtcatcccagcacagaggcttctagctagactggcaatgactactttgtggatcattaaacaaacgggattcttaggtgtcctgatgggaattacagttgttcctcccatccatataaaactgtggtctccttcttgggtcctggatcacggtccaaagtcagcatccattttctctgataaggtttactttaccaaagtaacttaccaagttttggtaactgaaatagtgcatttgagcatattttccacaaatagggggttggggaggggataggaaaaaagtctggttatggccaaacccaaatactcctactgggattatgccaagatgaccttgttgaaagatgttaatatgtcataaaatttagaaaataatcagtcaataaaacagtttatgtcaaatgattgcaattttgtcaaagtgttttcatttcagaatatatcttttctcttttttttttttttggcagagctagctgaggttttattttggacagaaaaacaaaacaaaacaaaacaaaaaacaattgaattgttttgtggctggaggcatgggcaaggggcgggggtccccaggcagtgaactcccccgcgggtgggctgagggctagggctgagcctcaggtaagtctcctgttccctgtgcttccttgcacagcagcctccctcctaggctttggggcagccgtaggaggggcaggctgggaggggctgccgcagctgttcacttgagcaggaaatcagaggacaccagcttcccatctcgggtcttgatcttcttcacaaccatggccctggtggagctggtgcggctgaaggagctggaacctgcgccagagcgagagctggagctcaggccgtagctgaggccagagcctgtgaggcccccataggccaagctcacaccacctgcatagccgctggtggtcttcgtatggatactcatgttctccatcttccagcagcttcctgtaggtggcgatctcgatgtccagggtcagcttgatgttcatcagcttctggtaggcacgcagctgccgcgccatgtcctacttggtctgctgaagggcggcctccagctcggacagcttagcgttggcatccttaatgaccagctccctgcgctgctccgcatctgcgatgccggcctccagggaaatcctcccgcctttgaggccctcagtctcagcctggagccagctgatgttccggttcatctcagagatctcagtctttgtaagacgcaggtcttcccagccagcgtctgcagctcctcatacttgatctgatacatgctctcggcctcagcccgactgcggttggcgatctcctcgtactgtaccttgacctcagcgatgatgctgtccgtgtccagggagcggctgttgtcaatggacagcaccacagacgtgtccgagatctgggactgcagctcccggatctcctcttcatacagctgcctgaggaagttgatatcgtcagcccttccaggcaagactccagctctacctcgttaatgtaagcttcatccacatccttcttgatgaggacaaattcattctccgtctctgtactcttattgatctcatcctcatagttgttcttgaagtcctccaccagcccctgcgtgttgccaagctccgcctccagcttcagcttctcctggcccagagtctccagctgccgcctaaggctgttgatgtagctctcgaatatgttgtccatgttgctcccagccgtcttctgctgctgcaggaggctccacttggtctccagcatcttgttctgctgctccaggaaccgtaccttgtcgacgaaggaggcaaacttgttgttgaaggtcttgatctgctccttctcctgggtgcacacagcatggatgttggggttcaccttcaggttaagggggttcagcaggctctggttgactgggacggcagtgatgcctcccatgccactggccccaccataggccaccccggaagctgctgctgcccactcaggagaagctcaaggagctgatgcagacaccaggcccactcgtgtaggagcagctgcagaaggcccgggtgccagaggtggacaccttgtaggacttctgcaccctgatggacatggtggaggcaggagtggaggcaggcgggctgaaccaggcggagattccagaaggagtggagaagctgcttcttggtagaatatatcttttctaacaggtaaagcaatatgtacacttacagaaacttctgttaatgacaaggtggcacttaaaatataaaactaagtttcctttacaatctgactctcctacaagtaattgttaatgactacacatacccacacactctctctctatagacaaaagtttatcagagagaatccaaaattgtactttttggtgtagaacgtacataatttattttcttatggtctttttctaaatcttcggtattttctatattttgccataaccataaatacttgaacaatttttaacttgtaaacaattttaatttgttttcaaactgaatgaaagattttagcactcatctcagcagctttaaaactttttaaaaatttaaaatttatatataggctgggcacggtggctcacgcctataatctcagcactttgggaggctgaggcaggtggatcccttgagctcaggagttcgagaccaggctgggcagcatggtgaaacaccatttctaccaaaaataaaaaaaattagctcggcatggtggtgtatgtctgtggtcccagctacttgggaggctgaggtgggaggatcacttgagcctgggaggcagaggttgcagtgagccgagatcatgccactgcactcacacctgggcgacagagccagacttggtctcaaaaaaaaaaaaaacactgtatatctgtatatctatgtatgtgtgtgtgtatgtgtgtgtgtgtgtgtgtgtgtgtgtgtgtgtaaaattcactttttgtggcatccagttctaaaggttttgacaaatgcatagagatatgtatccataaccactatcatgatatagaacaattccattgaccccagaaagttccttcatactgctctttttagtggacaattcttccaaaagaagtaaaattatgggaataaaatgaactgatagatataagagcttgtaagagttaaaaatgctgtgtagatacagtgtctctattgatatgactcaacttgatttggcaccaataattattttcttagtacacagagtcaaagattttttttaatctttctgtctagatgttattactatttgggattctgtttggatggtatggagctaaaaaaaattcatcaatacacttttgccaacctgcatccaagctacgttatccatgaagtattctaccttttcacctatgcccttgtctaaatggaactatgtttgagttcctgattcagtagcgttaccttcttaacttgacactgcttctcacactcatttagtttggtactaaagacagaagtagtaaatacacagttctgattacacatgccacatgcttgctatccttgacctactgtgtgtaatacgttctgtttgatccagaattgtttcctctgtcatccaatcagtgtctagtatttggatactgaatattcttcctttcatttaattaattctgtgcatactggttttatcttcaacctggtgctggtttacctcttagatgaaagaatacagatagaagggtccaatagctccaagtcccaagctcttatcacaatggctgtttcctacttaaccataagtgcagtattaaaaaatgggcactgcttaaatgtcagtctgaccctgtagatcaagcccattaatggcatgtgttatgtcatggcagatactcttggttggctactcctactcagaatctttcttccttgcctgcctcctactgtcccactgtagaggctggaaaacccacatacttgctttttagcctcccttgtggctaggggtaattgtgtgacccagatctggccaatgaggcatacaggaaagtctactggggaagcaggagcgggacagagattctgggaaagagttttcttccctgaataaaaggaagtaagtgagggaaggccttctgaccggactcttcattgcttcctgcctttgtttgtaattaaatgtgttcataatacgtggggctgtggcagccatcatgtgaccatgaggtaataagcctatggactttaaaaggctaagaagctgagtatgacagatgggagaatgggacaatatctttgatgacactgttgaacaactaaaacctaccttaagacagcctatgtctgaaattgttaaaccctgtggtttaagctactgttagtaagttttctgttatattcatctaaattcatgctactatacatgtctttccatctttgttttccttatagcactttgcacagggccaggttattaatgcatgttgagttggaaactcccttgccttacaacatatttgcacaaactctcacatgcacatttccactttactctaccacacaaccaattttccttcccacttgcttgattcctagtattaagatgatttgtgtttttcctccttcccctgctgtggagatggtgtattatttttcaaccattcagatatgaaagcagcttactgggatagaatgccaaccccaatttattcatggtgttcattgtaaaattatgacttcagagggacctagccacaccctctttaggagccaagctttccctgctaatatgcaggaagcccaccatgcttgctgagctgtgaaaatccagatggtgggaagcaggtgagtaatgaatgccatgctgttccccttaaaatgcacacagcttccccaggctgaccaaatctccaacactaaacaggtttgaatcaacccaaggacatgtgggttgataaagattgccttttattcaaaacaagttcctgcaacatagaagcctagaagataaaattttcccatagttggaacaaaacttgcctaaagggcaaaggagtcttaaaaattataagtctctgagtacagaaaaatccagtgggaaattgatagcagtccagacttgcctacatgcctgtgtggtttacagtggaatctgctgtcaaggtgtttaccatctgtcacccaatttttcaaaaagcagaggagtaattaactgctcaggcaatacaaactctgtcaatcattcagatctattatccgcacaacatgggacatctatggctgaccccaaagtcagcaggactccaggtccaaaatgagaaagttctcacatctgtgggggaatgggagttcttgggcaggccctgtgctacctgctacccaaacacacatattatggcatctggcacatgtttggtcagaaattttgctttgccagatgttctgaagtcagtaagacatggtatccactttgtggaagctaaaattccccatattttgggactggctcaggtatcacttccttaagaagccctgtgtgacttcttttaagcccaacacagctccctttattatgcagcctcattgctccccatactttgcctttataagttatcaccactaatcattagcatttatcacaatgatattagaatcatttatatgcctgtttcagtctcttcattgtaaacttcacaaggaacttgttcaccactaaaccctcagtgcctagctgagtctcttagtatataacagatgcttctcaatctttttttttctatgctcacaagtcatcaagcaatcaatcttttttctttaatggatcactgaatgggcactgaagagagccaataccaaagtggaccaacatatagagaatggataaccctaaacaaagtatcaataatcaaaatatgtatgctgggtagatgtaaacatttacttaagatgtgaagcaagaaaaagttctcatttggaatagtgagtgtttgatgattttagaatgagatacattgctcaataaataatagatcttgtcctaaaaagcctttgcagcactgtcagggattcagggtcctatgaataacaggaagagaaagcagatgggttgggggagagaggatgtccaggtagggtcctacttgggagagggcatggaggtggtaataagaaagccaaagtggatgagcaaatacatctgagatgaaaggactcgatttaatgaatgcctattatgtgcatgtcactgggctgggtaccagagatatagtaataaacaaacactactggtacttgcccttgtgaaactctcagttagaggactgggaggtaatgggaggttgggatacaagtacaatgttggggaaaggttgttcaaagattctgatcatagagatttttaagtcaaagaattttttttttcctagagggaagcagaagtccttatcagaactcaaggaaacacatctcagccatatccttgcatgcaataaatctcttttatttctctaaaggacaaattgaacactaaatacaatgcatatttttgttaaactgtaggtgggcctaaagaaatgaatgaagaatatgataggcaaggatttgattttttcctcctaaaacatgaggtcccgatgtcaaacaaaataaatatgttgctaatagttcacaaggtattattatgttacgatggtttttcaagggtcttagcaaataaaatggaaagtattagaaacaagcgtgccagttataataccatgaatcacttagtattttttctctttctccctccctccttctagtttctggctaggagttgtggtattttgaagaatattataaagtatgctctcttttggataatatgcatattttaaagcactgaatgcaatactgtacacacagtaggtaagagtaaaatacagaatgaataaactagtgttgattttcatcagcagcaggacccaatctttaataaatattcatcaggataaaggcagtatagtaaatacttactgcttttatctatccactgaaaatcggatatttagaaaatctattatatttgacttcatggtcatgtagcagtttagataacaatgaataatattaaaactagaaaagtcaggaaagatttaatgttaataggacataagggtgatctggttgcaacatctgtcaccccactgatcaccagggttgatttggctgatccggatggctaggcaggtgtctccttcctccctcaccactctgtgcatccctcccagagctgcacaatgggttgaagagcatgatcatccccaatagaggaggactggtcttcggtcaagggtatatgagtagctgtgttcccctgctagaatctccaaacaacgtctcaagatttagggttaattaattcattcattgacccatttattcactcaacaaatgtacattgaacacaccaactacgtgtaaagtactattccagatattaaagaaagatcaattaaaaatagataagatatctgtcctcatgcatcttacattctagttgtggagaaaagaaaatcatcaatgaacatattaaattacattgtatgttatgtactaaggaaaacaaatagagctgagtaagatgaacaggactggcattttcagggaggctgcaatttcaatagggtggttgtgacagacttcatgggggagacttgaaggagtggaggcgttcacgatgcaggtatctgtaggaagagtgttccaaagagatgaaactgacaatggaaagaccctaagagggaaatgaacatgtgttaagggatcagtgtgcctagagcagaacaaacaaggggtaaataggtaggagaaatgggaggttcacatgatatagagtcttgtataacacagcaaggactctcttactaaaagtgaaatgggcacaacaatgtgaatgtatttgatgccaccaaactgtatactgaaaaatagttaaaatggtaaagcttatgttacgtacattttacaacaaaaaagtgaaagggatagctgttggaaggatactaagtagacaagtgactgcttttacaagactcaatttggctacagtgttgataacagactgtagagggctgaggtagaattgggaagtgtattgagataatcaaggggagataaaccatggtgtaggctgtggaggtgaagagaactggctattttctggatgatattgaaagttgacctgtgaggatttgctgatggattgattatagggtttgaaaaaatacaagaatcaaggatgatcccaaagtttttggtctcagcaactggcatgttagagttgccatcactgagaatattgtgagtaaagcaggctttttgaggaccagatgttcagttttatgcatgtgaaatgtgagaggtttataagtacagatgttgaggagataactggaaataagaatttggagttcaggagaggggattgagctggtgatataaatttgggagttattagcattcagatagtgtttaaagcaacaagaccagatgaggtcttggggagtgagtgcattaaaataaatgaagaggaccaagagctgaacagtagggcactccaacattgaaaaagttggggacagaagaagaaaatccagggaaaaaaacaaagagaatgaccagtgagataataagaaaatcaaagaaacgtaatgtcctggaaaccaagtgaagttcagacaagtgaccaaccatgtcaaatactgctcataggcaagctaaaagtttagagtaaaactttaagcttagtactgtggagctcatttttaactttgagtaatgtatagtttctatgggatggtggccataaaacttgatcggagtaggtttcagagagaatgggaggagaggaattggagatggtgactatgtacaactccttgaagagtagcaaagaaatgaggtgaaagatggtaaggaaagtgggatcaagagagtactttcacagtgtcatagaaataacagcatgtttatatgctggtgggaaagttccaactgccaggaaaaaaataacgatgaagaagaaagaaggtggaattgctgaatgaataaaaaaataaatgtatagatgaacaggccaggaatgaggactggtcgccactaacatttgaaataaaatctgtacaggttcaaaccctacccacagccaaaatctggatagtaagaaaaatgctattgaaatcttctcttcatataaggtttaacaggattcttaaaacatttagtattacaagaatttctctcatatatcagcatttcagagatccatgtgattgctatgaataaaagacctcttgattttttttttgtttcttcctccttattctctccctctcccctgacctcacacctcttctttcttttctgctttccactcatctcttcctcccttcccttctccttttgaagctgagagcagaaaggactctgttcttttagctacctactatctgcctaccaggcagaaggctgctaactcatatacactttaaagtgatgagaaatctactacaagatcacttccacatgggtaggctgacctccttttggccttccttaactttcaccagtatccttaatatcttatagaaacaagtctgtcagagtggggaaaaaaaccctacactctcatcctttccctgtgcaagatttacagacacattgtaaatggccagacccaggtgatggtgccaggaactttccaagtgatttgtagatctcccttccaggacatcagtctttaatggaaaactcttttagctgcacattcctttcctgcagtatgactacaggtagagaattgcaactgtcataaagaagactcactgaaattaactagctattgacttggtctcaagacattacagtctaagagaaacaccagcactgcacagtttagaaaagcatagtttttctttgaaactaccatttattgagttggcctactgcaagccaggcacggcgttcgaccctctatatacatacactctcttcctaaatctatagatccatcgtcatatattggatactgactttggtcatgatctgtgctttgtgttttatgttatatcacttaattgtcactcaaactccatgagttttagtatctttctccatttttcagttgggaaaatggtggctcagacaggataaataacttgctcatgtttgtaagactagtcgtggagctgggatttaaacccaattgtagttccaaagcttgtgttcagaacctgcctttttgtgggctgcttcttttccctccaccttctattatttcttgttcctattctcttctgtatactatctcttcttttttctatataaattcttttttcatctttcactcacagttgtaggttttacttcttaacacagcagagtgtatcttctgggctcagtcttcacttttccatcattgtcacacactccatcaaagtttaactcctcagactctcaaagcaaatacaatctttgctgaccaactgttcatgccatttcatttatctaatatattcttgtcattaattgtgcctgttgacatctcattctttgagacagcatgtcccttgtgggcaggatcttctgcattattataatctgaggacctagcatagggactggcatctagtaggtttgcaaaaaacacttgtttactgactaaataaaaaagtaaatacacaaatccttcaaggccagctcaaatgtcacctattccatgaagcttttctaagcttcattgattggaaaaaattccttcttcctcacaaaaactgtaactctttgtacttttacatgagatccatgacattgtcacttacatgtgtacttgttctattttcctaactgaaatgtatttcattaaaggcagaattcctattttactcaattttgactctactaagcacaattaatgtttgatgaataaaagaatgtaaaatctgaacctttctctaataatacaatttagctcttaacctttattaggagatctcggacatctttgaggatccaataaaagctataaatcctttccccataaatatgcatgtacttatatttgtgaaattctgcatcttattttcatggtacttctgaatctctggatccctagtgggatctgagaccatcactcaatactaccctgcattcagacctttgcttaaacaattcttcaatctggaaattatcctcttagaacttatcctgtttcccttcccttctaacacccagttgaaaattattctcttctagaaaccaagtaaggacagtttacatttaaaacttcactaacttagctggcatcttcttatcaggcatgactcatttctattggattatggtctgaatgttgatagatggctcaaatatactttgtgtatgtgttatctgtttaactagattataagttccctgaaaacagaataatatttatttctttagtagaaagcatctttttcagtacctaggatcttattctgtgcatagcaaacatgacataaatggttcacaactggagatttaggattctcatggggacaactgactttgggtttatgtaatgcacatgacagctctctgcttagcttaaagtcacacatgttccatttttacctacaacttattgttatttttaattgttcattgctataggcttatagcctgggacacctctgaaataaaactagtatttgagaaatctagtaccaaggccattttcagaaatgctttctccaggaatagcagataggagaggagtgaaaatcagatcacatttccatacctccaaggactctatttttggggaacatttcaaatactgattccaacaacctaagttattgcctctggaggatatgaaaaagcttcaaacttgaaaaagtccataactattaaatgcgttggcaaaattcctttctttccaacacacaccatagcaggtttctagcactgactgtgatgcattgctttctgcaaagttcttggggaataaaaaatgatatgtcagtattttatcaggtaacagaaggaaccaaaccattaagcactgaagatatagactcaacactggccacaatctcaaatatacctcctgcttcttcacctgaacttgtatcaacagtaaaatgtactagacaccattttggggaagctttggggtaatacaaccttttggtaggtcatcattaagaacactttgtgaacgggccctttcctccctcgcaaactatcccctgacctccctccttaccattttctagccctacttttgctttcaggatctcataaatttcctgctttcccccttaatttggggaaacatgctttgcctaaactagtcccccgtcctcccttttccttagccaacatctcttcattttaaaaaatttcagcttgaacaacagcacttcctgagagtggacttttctgacaacctattttaaagtcttcacattgttctttatagtactctatcctttttctttaatgcatctaccataattcatcattatgtatattatgtatgtttttgagtgtttattgttaatgtctgtctcccttgtaagactacataattcacaagaattcataattcacaggaagcacagctgattttttttttaaccaacggtattcctggcccctagcccaatgtttgacacatagtagacatgcaagcattgttcaaggaaagtatggttttctaatcctatctctacaaaaaatacaaagattagcctggcatggtggcacacgcctatagtctcagctactcaggaggctgaggtgggaagacagattgagcccaggaggttgaggctgcagtgagctgtgatcgcaccactgtactacagcctgggtgacagagtgagaccccatcttaaaaaaaaaaaagtacggtttcctagaatatttattaatatttgtagcctgatcatttggattatatcctctaatgttgttcttacacacacacgtacatttggttttcagttgaattgagtgtagcagaactatgggatcatgaaaatttgaaaaccaataaaatccacatttgcttcattctagttaataaggtctatgctgagctaatcatatacacgaaaacacatgcattataaaatgcacacacacccttctgctacttaaattccagcccttgtctaaaccagtctccaccctttcaatttgcaggaagaaaggcaatcgaacaccagagactgggtgggaagatctttatatgccaagaagtctgacccagtgaactatttcagtcacatacgcagtttgaattggattgcccgatccctgagaagggatttctggattagacagttcattagaggctgagccagcttctagggcttgtcagtctttgctctgcatgcctggaattagcaaagtgatgcagtgaaggctgcctgagtgacagctgccagtgagtcacatgaaataatggctgaaatagcagctacttagaggcaacaaccacacctgcagcacagaatcccaagacgaaaatgagatttgctgtccattgaaaactatttactgagcaccttctatgtgcctgacctaggactttgtcttgagaaataattctaagagttgatcaatagcagtcttgtaatcccaggttaaattatagcttccacatttactagctggcaaatcttgggtttattatttaacctctctctctgccccctacttatttaatctgcaaaatggagatgatgatattatgttgagaattatgtacataaatttatgcaaagcacttagaatggtacctgacacacataagcactaaatgttagtatagtattttacctagaagtaacataatgaatggttaacagaatgactttaggtgtcagaaagataccattcatctctgtcatttacaagtgatgtgcctttgggcaagttacttgagttctctgaatctcagtttctttatctgtaaaataagaataatattggtaccattttggaggggaattatgaggattaaatgagataaggatggggaggagcttagcatgatgccttgcacattgtagctcctcaatatatataatttgttgttgttgttcccagtggatcactcatctggatcccagataaggcagagcaaggctccacagctccacatcatgggaccaaatagcccagaggataccagttggagtggataggtcatatctgacaagcagatttattttatttggactagtttattaacattgcagtattagcccacacaaaggtttccaacattttgaatgagtttctatcatctaaaaagtataaagtttcattttaaacaattgagatttttcagtttctttagaaaaatgaagattggcaacatcaagctggcattcccatatggccattcctgacttgagtggggaagcagctgctccctttagaagggcataggtcttgaatttactgcacctcctaacatttcctagtgtacccccagccttagtgtcaagtgccagctcccatttaccctcctgaggttttcctctacctctctgctttcatcttttacgctactttgcctctgtaggcatctgagttagcagctgctggtctttactgttgagtggtatcctctgcaaactggtacctctctacagggctgcatgcaaggtagcaacacctttatccacacaacgttaggtcatttgtcagcactgcaagtgcaagtatggaatgaaaaaacagtcaaaactgcaaatgcaagtgtggaatgaaaaaacagtcaaatcacaactaagggctggcctaaccagtaagctgagcacatccttggaggacagcctcttacccagaagttgactgcatgaattcactattcactcaccctgaatcttctccagtttcatttagactgagggtagaggatatgggacaaaggataggggtgctatacaacaatacttcaaaacttggttaatctaaaatatatcatatggaccattagttccttaagatgctgtttcttggggggaagatgtcgaacactgttgggaaatagctcatacactgtccctcatcttggggatttatctgggtaaatattgagttgtcccatcagaaagaagttcacccacagttcatacattaacagatatttactaaggacttacagatatttattaaggttttattaaggacttgccaggcactgttctttttggtgttggagattcagtattgacagtcaatattaaatctgaatattgacagattcagttcagacaatcctgaactcaggtaacttattctagtgtggagtaaagaagacttcactctctttccaaatttatctgactatagaatgctactgaaaaatactgctttatacatagtgcatagccacttgcaaatcctatctcttgagacttttcatgataaaggaatgatggagattttcacttctgtgaatacataagagaatcagaccactccaaaatgttttagagaaacagataatttattttttatttcttgaaaagtcaattaacccaccagagcagccttaatttggaaagaaccacagcctcacctggggactcaggcctggctaagttttctgagaatatcacatgaagggttaacttgacatttacctccaaactggagctgtttttctctgcctctaatatgaccctgttggaaatgtatttgtttttcactatttaatcttctgcatcacccactgttgattagatttaattaatttatgtttctaatgaatttagaaacttgcagtgctatagcaggaaaattttcagacagcatctggccaccaaatggattgattaccttgtctgcaaaagtctttcaaacatctggggcctgattttgtgaaacatccagaggctctttcaaaggtaagaaaacccacacagaagaatcttgaggggagaaagagagaaggtgctagaaataggtaggattctctttgatttgcaaaccaggatcctggcactctcccaacatgaaatcacattttgctgctcgttggcacagtttcaatggcaccaaatagactgatctgaatctattttgttcaacatcattggattccaccaggcccaagccaggctgccgccctgtgcgcttctttggcacttccttctatgtggaagctcccagtgatcattaaggcgaaacatttacagaaaacattcagagagaagcactttgctctcattcactcaacaaacatttatcaggagcccactgtgtgcctggcactgagccacgcatacctcttaagtagctcttgcaacaaccttgcaggataggtaggtactgctctcccattctcatagatgggaccaagtaataagtaaaaataacaataatcattaaggttaacaggaacactactaatatagatgtagagatatgcatacccacacagcaggctctgtgtgaagaactttacatgcattaactcatttaaccctcacaataaaaccataaggtagatgtcattattactacccccattttacagatgaggaaactgagtcactgtaagcttatgttaacccagctagcctttggcagaaccagccttctaacataggcagtctaacttgagagctttttgctataaaccactcaactttactacctccagatactatttactgaagacctgctatatgttaggtactatcttacagcttttacaacattagattttaatgacatttacgccatatgcagtggatgctattattcccagacaagaaaacaaaagcctagaaacattaagtaacttgttgaagtcacaaagagagttagtaagacttaggctatggcttaactcaggtctgcggagctacaaaggccactttctgcttactgagttatctgctgatgaatcagagaaaaaatgagtgttgagaactcaatagctttctcaaagctgccccaggaaacaaactaaaagtcagaaggcatagcctggctgctttgcacagcccagcccagtccagaaaaggggaagctacaaaatatgctacaaagaataagaaaaacagcttcatctaacagaagtaggtgaaatcttattgcctgactggtttttctggctcaaattcagagaaatgactgacaagcaagtgggttgcccacagtataaacaataatgaaaaagcctgcaatgctgaacatctgaaattttttgcaatgttgcacaatcaggttagtgcctaatacatagtataaaacacaattatatacagtaccagtgttgaagaaacccagtttgacatggttcttgtgatagaatataattactaagtctggccatttcttttgattaaaaaacttactttctttgacttctctcttgtctactgccactacctaaacatgaacaggtccttgctcctctttgggcctttgtatgtgcctttctctgcctggaacctggctaatctctattcatcctcgatcctcagattgtcgtctcttcctccaggaagtcttccttgactttcctattctgggttagatgcccattttaagcacaatgtatatttcctcctattatagcatttattacaccgtaaggtaactgtttatttgttggcctcctcattgagagagcatatgttggttaccactatattcccagtgtatgggtatggtacataataagtgtccaataaatatttaattgattggatgaattggagtgaacctcataacatcctctttgttggtctccctgtttgaaacctctcacctccacactttgtgctacatcccgtcagtcattcagctttcctttaaactttcatagtgtcattttaagaaatcacttccctttgaacactcacataaaagtcggaatactgataatctctgggcgagggagaattaagtaagagtgggcaagagaaaatcttacggagtcctaaaactgtcctgtacctttatgtgggtaatggtgacatggttgtatacatgtataaaagtcattaagctgaatacaaaagaataatgctcgttattgtgagtaattaacacctcagaataaacacatgaatcctttgaaagatcacttgtgttgataggataaaatccagacctccttgccccagttttcattgttctttactgattggcccaatggtcgatgtacttgttcaaactcacttttctaaaacacacgccctgatcttctaacaggtcctgaaacccttctcactcattcccatctctgtgcttaaaatcatgttttcttaccctaaatgtttatttctcttcctcccaccttacaaaagctcctccccctcttggagggccaggacaaattcatccatacaaactcaacaaatccacaaatctcattaatcccttttttctctgaacctttgactattttgtctgtttcattcattcgtgccaacatttcctgaggactgtaagttccttgaaggcagggatgttatcttattttcaatttttatatttaggacagtgcctggtacaatggtagattctcaatatatatttgttgtgaatataccaaagtcctacttacatgtccagaccctgggcagctatgagtctatacagagattaaaaaggcaggttgtctatgtcctttagaatgaaaacatagtggtgttaagcccatggacttaggattcccacatgatttcaaatccaggttttgcaactcactggctctgtgatccagtgtattcgatggccatcccaaaaactcagtttcctcagctgtaaaatggggactgtcataggtttttttttttgagggttacatgagaatataaacatttattttattagtgagcttttattgaatttgttgttttgctaaataatacacaattccacccaaataaaagcttatgcccttgatgttataatgcaaagaattcagcatagtgatcgactcacagggaacactgaacacatggtagctattcttatcagagctattataatccaaatatatagttgcagtgagaaaaatctataaattaggaggtaaaaatgtagaaagcaaggagagtggactcgttgtgagatatatacatgtgcacacaaacacagagtgaatctaatctgtaacaaattccttagggaaattccatcacatcccattaacacggtcccaaaggcaggagctgggctgatcttgacatatttaatatctttgaaaaaattctgaaaccataatcatctcaaaatggtatacaaaagcaagtctatctgggagttacatgcaaacacattttaccttagttctagcttacataattctttaatcatcataattcctagtgcttctcttaaaacttttgaccttaagaggatgattgacagttaggaaagggagaacaccgctcaatagggttttgacagttaggaagggagaacactgaggaacaagttctcagtgtgtttttacacactcatttaaaaggcaacagtttaataattctaattcatatatacttctattaatgcgatcaataattcatagaaattcctcagcagcatttttagtgacaacagaaagggtaaaatatttcttctcttccctttgccttcctttcctcacttagtcatgcctggagcctggagagcacacaatttcaagaaaacagtttccatggtgattcttcttttgagtacccgactgtattttgctctttctggagtgaattaatgcttcttattgctttcatgctaaatatattgcagattagatttgatttcctttgcagtgatatagttttattgcgaaaatggaaagtaaaaacacagcatgaagaacctatgtatttctgccactacactgtcagaaggctggaaaaaaaatccgtttcagaaaaaaataaccagccatagggaaatggatgcaggtatctggaagctaggatatgcatgcatgcatctaaatgttggaaagcctgccttagaagataatcttaattcttctataagttgaaggtgttataagttgaccataaaacactgagttacaagacatatcgatttttagtgtactatcctcttctcagcacagaaaatatatatcatatagaacaaagaaatcttcaaacccacaatatggcacttactttatattttattaaggagagctttgtttcctactaaagctaaataactggccttctttcacttgttaaaatagttatgtgaccttcctaagattcccatagcaccctgcatttcctgacatagaatttatcacatgtacttactatccactatgtccatcttcctcactagactctaaaagggcagggcccatgtctgtcctgttcactgttgtaccttgtgcctagcatggcacatgggaagctgaaaattataacaagaaaactatgaaagctaactctgaggcactgaggattttcttgtaaagcatcagtgggctggtgtgctggatagagatggaatctcatgtacattataaatactcaaatcttagcagcagctattggttttgatagtcagtcctacctggagccttgatcattacttgtctttgaggcactaaggagttaaagggaagaatccatcatgccagaggaggaggaacaaaaagcaggcaccatcctctaaagcctccttctccaccactgcatccccacctctcagagcctggagccaagcacttactgggcgtcaaacaagcaggaagaaaactaggattttggccaatttaagccaactagggagtattcagcatctatgccaaactagatatgactgtcctaggtgctgctgaggacaaagagtggaacacaggactttttggctctagcgagtttatagtctcaaagggattcttttgggattgtgcagaaggggagtatggccaagtataaacacacacacataccctgattattaacaatagtgaccatatttattgaacaacccattaggcacacttctaagcaccacatatgcatgaactcacttgatcctcatagcaaatctgtttattcctattattttcatttgacatataaagaaattgagactttgaaaggctaggtaacttgcctaacatcctaaaaccagttagtagtggagctaagattcaaacccacacagtctagtccttgagtcaatatcttaacaacaaaaccattctgaatctcaggctcatgggatctgatctgagaaatctactttacaaaggatttcccacagtctcttttgctgtataaattatccaaagtcgcttatgttcataaatgctcctggggaatcatcaggatgcatagagggccatatacagttctggatttcaagaggaaacccagttctgtggctatgtaaatgttagatttgcatggctttgtaactaggatacacattatggtaagatttctcctggctcaaggaggcgtttccataagaagggacaactggaggattactgaatgctaggtttcatcctatagaagagagacactctagtgttttgacacactctacaaaggggttcttttggaacttcattttctaaactacccttcagggaattcaaaattgctcagctgtatgctgaatttgattccacaaaaaacagtgacaagaacaaggtctcattgtattagctcacagatatttcccttcatttcagagtgtggattcctacagctatgttaaacatttatttaaaaaaaaaaaaggacaggaaggatgtggatgaagtcttaaagggtaggattatgagaggtgttttttttttacttatttaaaaattttatttttaattgatgaataattgtacatatttatggggtacaatgtgatatttcaatatacatttacattgtggatggattaaataaagctaattaacataactatcacctcatatttatcactttttgtggtgagaatattttcaaatctactcttttaagtgaaataataaacattggagacttctagaaggtgggaaggtagaatgggggtgagggatgaactattacctatcaggtagaatgtactctatttagataggtgcagtaacagcccggacttcaccactatgcaatagatccatggaacacaactgcacttgtacccgtaagtcaaaaagaaattttaaaaaaattataaaaaataaacaaaatacccaaaatctattcttttagcaatgttgagatatataatacattattaactataatcaccaagttgtgcagatctctaaaacttcttcttcttgtgtaattgaaatgttatatgctttgaatgacatcttcccatacccaattgctcccccttcccctatctcaacccccaactccgaaaaccagccccgggtaaccaccattttactttatacttctatgagtttgactttttttagattccacatataagtgagatcatgcagtatttgtgtgcttggatggagtttaaaattttacttttgctcttttgagataattctatttctcagttttctgtaataagcatgtataattttaaataccacaaagtaactcactcactttaaaaaacttttagtttctctgaatatgatggctagggaaacacttacttttttttttttttttttttttttcagatgcaatgatttcccagcaaaaggaaagcaaggacagggaatggagagataccaatgtagcaaatgttacctatgagatctcagaatcaggaaggggaaaaatgttttcttctcagtattatccattccactgtgtgactcctataaacagaatatttttaaataagaccttttccccatgtttagtaataagagagattatcacttattaagcagcaaaaacattgaataggtgtgtttattttttctctcagaagagagaatgggctcagagattatgttctgtacatgctcagagtcacagagttaacagatctccgtgggactgctgcactccacatcctgttggttaatactttgctctcctgtcttcgtgtggagcaaaataatcctccaacagttgggaagtgatatggtttggctgtgtccccactgaaatctcaacttgaattgtatgtcctagaattcccatgtgttgtgggagggacccagggggagttaattgaatcacggggactggtctttcccgtgctattctcatgatagtgaataagtctcatgagatctgatgggtttatcaggggtttccacttttgcttcttcgtcattttctcttgccgctaccaagtaagaagtgctttttgcctattgccatgattctgaggcctccccagccatgtggaaccatataagtccaattaaacctctttttatttccagtctcaggtatgtctttatcagcagcatgaaaacagactaatacagcaaattggtaccaggagtggggtgttgctgaagagataccccaaaatgtggaagcaactttggaactgggtaacaggcagagattggaaaagtttgaagggctcagaagaagaaaggaaaatgtgggaaagtttggaacttcctagagacttgttgaatggctgtgtccaaaatgctgatagcgatatggacaataaaatccaagttgaggtggtctcagatggaaatgaggaacttgttgggaactggagcaaaggtgactcttgttatgttttagcaaagagactggtggcattttgcccctgccctagagatttgtgaaactttgaacttgagagagatgatttagggtatctggcagaagaaatttctaagcagcaaagcattcaagaggtgatgtcagtactgttaaaggcatttagttttaaaagggaaacagagcataaaagttcagaaaatttgcagcctgaatatgcaaaaacccattttctggggagaaattcaagctggctgcagtaatttgcataagtagcaggagcctaatgttaatccccaagaccatggggaaaatgtctccaggccatgtgagagaccttcatgacagcccctcccatcacaggcccagaggcccagggggaaaaagtggtttccaggactgggcccaggtcctcatgctatgtgcagtttagggacttggtgccctgtatcccagctgctccagctgtggctgaaaagggccaacatacagcttgggcctgcggtttcagaaggtggaagcctcaagccttggcagcttccatgtggtattgagcctgtgggtgcacagaagtgaagaactgaggtttgggaacctccacctagatttcagaagatgtatggaaacacctggatgcccaggcaaaagtttgctgcaggggcagggccctcatggagaacctctgctagggcagtgtggaagggaaatgtggggttggagcccccacacagagtccctactggggtactgcctagtgaagctgtgaaaagagggccaccatcctctagaccccataatggtagatccactgacagtttgcactatgtgcctggaaaagctgcagacactcaatgccaacccatgaaagcagccaggagggaggctataccctgcaaagccacaggggcagagctgcctaagactcttacatcagtgtgacctggatatgagacctggagtcaaaggagatcattttggagctttaaaatttgactgcctctctggatttcagacacttgcataggctcagtaacccctttgttttggccagtatctcacattttgaatagctggatttatccaatacctgtacccccattgtatctaggaagtaactagcttgcttttgattttaaaggctcataggtagaagggacttaccttgtctcagatgagactttggactgtggacttttgggttaatgctgaaatgagttaagactttgggggactactggggaggcatgattagttttgaaatgtggagacgtgaaatttggaggggccaagggcagaatgatatggtttggctgtgtccccaccaaatctcaacctgaattgtatctcccagaattcccacatgttgtgggagggacccaggcagaggtaattgcatcatgagggccagtctttcccgtgctagtctcataatagtgaataagtctcatgagagctaatgggtttatcaggggttttcacttttgcttcttcctcattttctcttgccgccaccatgtaagaagtgcctttcacctcctgacatgcttctgaggcctccccagacatgtggaactgtaagtccaattaaacctctttttattcctagtcttgggtatgtcttcatcatcagcataaaaatggactaatacagggaaattaaacttatatcattaaaaagagaggtgatcagggaagcctgaattggcatgaggagtctgaccaggaaatgtagccaaaagatattctctgcattccaagaagaaaccgatgaggccttcgaggctcacagtggaaagggttagagaggaagattcagccatgtacgaggtgtgagtttggagagaaaaacacagattagatgtatcttcctgctgaagccatacacaacacaccagctggctccttttccaatccatgctctatcagctaatccaacaatcatattttgttattcttctcataaataaaatgttgtatgtgtgacaaagacatccctgacaggagactgcactccaagtaagttagaatgaatggtgacaaaaatgggatgttttcaggtatacagaataattgccagttactggcacttaaaatggctgcaaaatctgtggtactgctgggtacctgatgtttgctgcagcctcaggactctgatgcctggactttttcagggtcttatagtatccattggctttctgtttatagtgctaatggaaaattaaaattattttgcaagagaccttaactatactgtactatgagtactttatgtggcagagagaaggccaacttgcatttctgtatattcttctcctttccctcttcattttccgtggcttcccgtagagtttaactgactaattaagagcttgggctttgaagtcagatggatctgagggtcaaagcacatttctgccatctattagctgcaaaaccttgggagagtcagtcaccctcattctcaatttccttctctgtaaaacagtgaagaaaatctttccacttttcatgaaggaggtgtgcagatgaaatgacataatgcaaataaaggagctagcacactgcctgacatctgataaatcctcaataagttttaggaaaacaacaatgtaacacaactgacaagaatttggacagagtgggtatgtccattgaactttttttttgtctttcctctatgagaagtttgccatctcatcatggggtcatattaatttctctaactatattgttagctatagcctttctttttgaccccaaagttagagcgtaaatatctcccactaacttgatgattaagataaggtccaggaactttttcccgtttacggtttaaaaacaaccttctgtggagatttttgatggaatgtagggatatttatgactcaggcctcctggaaaagtccttgatgctgactcattcattatcacaagaaaggaggaggcagctgaaatcaccactcatttattctgcttctaacttacggtgaaaggtcaaaggtaagtcactccacatagggctgagtatgagaataagaatttcaataacttcttttgaccacaagagaaaacagcatttctaatgcacatacattgataaaaatttttgcaaggacctctttaatacaagtgctatagcactgataaatgataatatttagtctgaagcctcaggcttccagctaccaatacacagaaactacggtttttccacagagcaagtgaaaaccaatgggaggatggacaaaaatagaaaggaggcatgatttggaatttccacagtgactatggccttgaaatcaggaacaaagggcaatcttgcagaggtataagaggaaatataaaaggttttgtagaacaaacctggaagtgaattccagttgaaaccatgctcatggtaaaacatatttttaccacaaacaataacagcattaatagcactgtcaccatcagactataataggcaacaaatacaacatcaataaaatttattgtatgtaaaaagcttaggaatatgcaaatcaatagaagaggaatactactaagtaacaagtatttgagtactttgtgtcaagtgctcagctacaaactctaaatgattttttcatttactcctcaaatagcactatgagattgactccacctccatatagactgtagctggggcactccaggcttatagatgttatacaacttgttcaagaccacacagttaatgaaggaggctgattctaaagcccatcttctgctattgctgcttcagcaaagttgtgttgaaaacaatgctatctattggccataaattactgatacacactcacggcaaaaattatttttacatatttaacattattcttggctctagatacaggatataggggagaatatgggccgaatttggacttctaggtcaccatgaactctcagcatcacttcctttacaaatgtaaatcagtgggaggtgctgttcccgcaatctggttactcatattcttccctaaatatgcaagtaacccactcagtgcaagttatgtgggaacatgggataaaacttccagtatttccaaagtacagggctgggtggtcaaaaaacagtggcagtatgggactgctaaatgttatttggtgcaatgccaacataaatagttttgcaagatataaaattaattgggggtgaggggcttcttccagtttcaacacagcagataccccaacagaactacccttggcccatattttaaataaatgaataagctctctaattataaatattctaaatgagtaaatagaagactacccattaacatttggctttcagtaagaagtatgtgaactaatacaagtagacttgctaaagcttgagactagagagagaagatgacaggatactgaattcccatattaaagttgttctaagcttgggctagagctttagactaacctccctccaagtctagaattggcaaccagtttgagaaggtcataagtagatctggggcaaggaaaacaaaaccacacacagacacacacacacacaaacacacacacgtcatttatatggtagcataggctataattactatcatgggtgaattcagcttaccaggaccctactcaaggtctttgcaatatatgtgctggaaagtactgattttgtattgaatttgagtcatgacaatagcagcagcagcagtagtagtggtggtggtagtaatagtagacaataataacggcagtagtagcagtggtggtggtagtaatagtagtggtagtaataacagctaacatttattgagcatttccaggaattgttttaagtgctttacatatattacctcatagggttgttgtgaagataaaatgagttaggttttttttttttttttgagacagggttttactctgttgctgaggctggagggcagtggcatgatcacagctcactgcagccttaacttccctggctcaagcagatcctcccaccttcgcctcccaagtagctgggactacagatgcacaccaccatacctggctaatgtttttatttttttgtagagatggggcctccctacattgcccaggctggtcttgaactcccgggctcaagaattcctcctgccttggcctcccaatctgctgggattacaggtatgagcctggccattagccatttttaacagatggagaaactgtgttaaatgccctgtatacaatatctcattcagttctcataactacctatctactttattattcccactttgcaggtgaggaaactgaggcacagactggttacttatggtcctacaactcaataggttcaagaactagaattcacttccaggattgtttgatttcaaagctcatgttctgaactgctacattacagttttggtaccagtattacccctcatcctggccatattccagacaccccaccccctggccatgcttctctctcccactctgtctgtcctcgtgagactgagatgcagcatctttcaaactgagaccctctgctgtcaaattggataaaatcaatgtctacctcaaagtgctggtgtgacaaccaaatcctataacgtatagagaggatttgcctggtaccttccatataaagacctgatgatacttatgttttggaattctattagactggtgcaaaagtaattgcagattttgatggcaaaagctacaattactgttgcaccaacctaaatcatcacttttattacccgcccctttctctgccaatagcatttccttccagggatcagaaggaagctgaggatgaatttctctagaagaagtaagaaggccaagggttaatgtgtaagagatgaactgagctagatgagagggaaaggagaggtggaattgctttgaatttcattgctaggaaccgcgatcttttttattatttgtataaatcacttggctgtgaagacaccacaggccaagcctccgagtgtgccgatgataataaattgggtagcacaataaataacaggtaaaatcaggctgccaaatgaagcaggatttagatcatttaaatcccaggctatgagttgtcaaatccagtttaatactgataagtgtgggataataacttttagcaaacagtcccctcccaccaaaaccccccccacaatccttctactctcttctcccaccccttgcaaacagacagagaaccctgaggggatttgcagaatgaaaaggcatggtatatactgaccagatatgagtccaagttattacataataatcccagagcctcagcttgggctgagagcaaataggaagagctaatagaatgctgcaaggttcgattagctgcaaaggagattctaaatcagagcaggttttatatgattaaattggatgggggaaaaaaagagtctcacactcaggtataatggaaaagtggaaaggataagggaaatataaaaccatggacgttgctggaatggctatggagtggcctgagggtagagtcaacgctgagggacacttgtcaaaacaagagacaacttagccagcagttctcagtagctgtgactgttcttacaagactcacacccacattcagagatatagcagcaggatcctacctgatgacactggaatttcaggaataaagagtcatctattgcttgatttgatgatgataacctatttcattcattcaacaagtatttattgaataccaaatatgtggtgggcattattatttatgattgcataaaatagactgtgatggtgactgatttagtttggctgtgtccccacccaaatctcatcttgaattgtagttcccataatccccacgtgttatgggagggaccaggtggagataattgaatcatgggagcagtttcccccatcctgttcttatgagagtgagttagttctcatgagatctgatggtttcataagcagcttttcccttcactgggcacacattattctccttcctgcctccatgtgaagaaggatgtgtttgcttccccttttgacacgattttaagtttcctgaggcctccccagccatactgaactgtgagtcaattaaacctctttcctttataagttacccattcttgggtatgtctttattagcagcgtgagaacagactaatacagtgacaataactaacaactgagcgttatgccctgccacatattttacatgcatttgctccttcagtcatcacagaaatcttatgatctagttgttattattaccatcattttaaaaatgagtaaactgaggcccggagagataactaacttgctccagatcgtgcaggaagaaatgatgctgacatccaaacctcatatgtctaaagcccatctgctttaacatgcctccaaatgaagaagtgaatcatagcagccatcgtaagtcttgaggacatctctgccatcttcttcccagcccccagcaccaccccctttcctaggtgtgtacatgggtacatcccacaattggtatttgaactaaagtgaatgagaatgttctgactccggtgtaatctgttaattactattaataccaccatgagggcacaaaagcaggattgcagctttgtgttttcatccctgctcagtcattacctagtggtatacatttctggatcacctttggcatctctagttggttctttttagaacctataacatacatttactctctaacccaggactgttcaatagaaataatgtgagccatatataatttttaattttctaatggtaacatttaaaaaataaaaacaggtaaaattaatcatatatagcattttatttaactcaatttattgaaatatccttttaacatgtaatgaatacaaaatattactaagttattttactgtcttattttcatgctaagtcttcaaatcctggtgtgtatttcatacttacagcacatctcaattttgactagccacatttcaagggttcagtagctactggggacttcatactggcagagagctttagctgcactgtgaatgttcattgacttgtcctgattaggacaagtgccttctaggcatataggagctgtgccttctagtagtattttttgggtgtctacttcatgcaaagacctagagtgggcattttgatacatattatgcttcatcttgccagtagctttccaagaaaacatcgttggctccacattacagataaagagcctgaagaaagttactggaagctccaagactgtagagagtatttacttttacctctttaacacttagcacattgccttgcacagagcatgattcaacaaatatctatggaatcaatggaaggttacttgtcaaacctgcagaagagctgggatttgaatcaggtatgcctgattttaaagcttgtactttttgatccattccgcttttttttgccacattagtaatatactaatttgcccctaagtaatatacagtgaagaataaacaatgcttatttagtatataagcctttcatcccagtgaaaaaatttataaatgggaaactccagtcaggtgttatatttatggtgggtgtcacggtcttctttgagtgtatttggtttaacaaatgttgttggaggccaggtgtggtggctcacacctgtagtcccagctacttgggatgctgaggtgggaggatcacttgagcccaggaggtggacattgcagtgagctgagatcacgccactgcactccagcctgggtgacagagtgagaccctgtctcaaaaaacaaaacaaaacaaaaaaaacgttgttagaaacctactcagacctggggactatgttcgaccttgaaggtacaaagaccatcaacacatgattgtcactctcagtgtggtttggaagatatgccatagagtgtttagtacagttaggtgatataaaaaatcttagcttcgggctgggcgcggtggctcacaactgtaatcccagcactttgggaggctgaggcgggcggatcacgaggtcaggagatcgagaccatcgtggctaacacagtgaaaccccgtctctactaaatatacaaaaaattagccgggcgtgatggcgggtgcctgtagtcccagctactcgggaggctgaggcaggagaacggcatgaacttgggaggcggagcttgcagtgagccgagatcatgccactgcactccagcctgggcgacaaagtgagactcagtctcaaaaaaaaaaaaaaaaaaaaaatcttagcttcacagaaaaactagttggaagtgactttaaacgtcatcttattttattcataatttggtactaaattacatactagcaagatttcacctggggaactcttgtattcccaacagtaggttcttgaaaggagggagaaatacatctttactccccaaagtattttgcacagtgttaagcaaatgacggttgaacaactcctagttaactgccctcagctctctgtctccttctgtgtgtaccaaggaaccaagagtcagattcctcatgggcagagagcaccttggtcagatgtcgttaaagttctaattatagaccatacttctcagggaggatataggtagagttctttattctagcttatactagagaacaataaaactaattatactgagggttttttaatcagattaattcataaattaattcaaatatttattaactattagtcattagttggtgtgactagaactgtgaatatgatagtccctgccattgaggatattactgtctggtgagggacacagactaatgaagacacatacattgtaatataatgcaataggaattaagataaggataacatctaagaagtgcacctattttttttttaagagacaggatctcactgtgttgcccaggctggagtgtagtggtgtgatcacggctcacagcagccttgacctcctgagctcaagtgatcccccatcccccgaacctcttgagtagctaggactacaggtatacaccactgcacccaaatagtttttatttatgtaaagacagggtctcaactatgttgcccaagctggtctggaacactggggttcaaacaatcctcttgccttggcctcccaaagtgctgggattacaagtgtgagccactgtacttgggaagaagtgcatctaaatggaatttagagaaattaggggaagcatcgtggagaaagcattccaaacccagtgttaaaagacaaatgagagtcagcctggccaaagggcaaaggatggggaggaaagaatgccaggggtgggggacaactcatatgaagactcatagaacatggtacatttggggaccaacagagatttcaatgagacggaagcatggagtgccagggctgggcaaaggaaggacacatgttcagaatatattagagaagtaaacttgaggttcatgaggaaggtctttgtgcatgataggaagaggatgcatcaaagattttaaggaaagaagctacgattataatttaagcacattttactctagccctgctgtgtttcatgtacttctcacattccatgatcactatttatccatctgcttccatttctatcctgagatccttaaaacaagggctcctatgtttctctttgtatcaccagtaccccaatgcagtgtctgctacatacttgatgcttaatacttattttaatgaataatgtctgtgggaatcctttgtagatttgagggaactcagtctgctgaggacatactaccagggagtatccttaacctagattccttggacctcttgaaaatacttggaaaaatgtgggtgcgaatatgtgcattggttttaggagtgagatattatcattttcatcagattctcaaaggaacctaagacctcacaatgattgcaaagcacaataaatggggatccttgggaaatgtagtttgggagccctctctagctagaaaagacttctcagaggtgaaatgctaaatggtggttctcaccaaaggtagaaaaatgaataggtgaaatgttgatgtgacctaactttttccaagtgaaagaggtgtacaagtgataaaagagaacagctctgtggtgacaagataatgtttgcaagaaaagagaaaagaatcttggagatgatgggcaatttcccttatgtctcctaagttactaagagcacctgatagttaacccagtctttaaagaagagtgctccaggtagaggtgtaaataaggagctttgaaaccaccatgggaagaggctgttgtaaatgaagggctcttggagtcagagaactcaaagaaaaagttgttacctctggaagaaaaaggtcttatggaagctacctccctctttcttttccacaaatttggatctgccaaattaatattttaaaatgagatcacacacacacacacacacacacacacacacacacacacacacacacacagataaaagttcttgatggatgccattaaaatatatagggtaattccatctcagtgctgaaaacctgatgatttttactcacactgtctgattattttttcacaatgagcatattttttcacagatgaacatgaaaaaaaattccattttgaaaaaatgatggtaggataataatgcaaaaattagtgttctaaaagaaagaagatcataggagggcagagtgctgctcaaagtgtgtctcataggccatgaagctcacaatcaccaaaggaacacattaaaaatgcagattccatcccagctactcaggagactgaggcaggagaatcacttgaacccgggaggcggaggtggcagtgagctgagatcgtgccaccgcactctagccaagcgacagagcaagactccgtctcaaaaaaaaaaaaaaatgcagatttttgggtcccaccccagttctactgaatcagattctttaggaatggggatctaggcatccgcaatttgaaaaattccccaggtaattcctatgcttatcacagagattttgaaaaaacctagttgataaggatggagcacatgcagtaaggaaggttcttgtctagcaggcaacccccctttctccatgtacatatgtgccttggacactaagagagtacaggacagagatgagcttaatacagtgtcttaacctaatgaaactgatttttttcaccttctaaaacattttcttatacattaaaaatgtacttataatctgaagttggacatgttggtgtcaggggaaggtataaattatgaactgacagtgctgcatattcataaaaatcccgcctttctaggagtggagggtgaaacactcccggtgtccttgtagatggcatgcttcttggacacctaaggatttttctactctctcacccctctacagggcaaatgggaatccatagctaggggtataatacgaagggcgaccgcctctcgggacgtggggacagaactcagagctccgagaatcatgccatctcaagaaggactgcgtcaccacctgtcaggtttgtgagagctgccactcctgcctgtgctgggaggccagattctgatactgacagtacacaattttaggccacataacttttaatgtagtctatcatgtcatatttgatacatccttgaatgtcatcctaaattatttttgaagcagagtacagtaaaaatattctggttcaacaagtctgttttgacagatcgatattagcctagtatccaaatataaacaggtgaactgaatgctgtttctatgcctttaggtaagaaattatatttgtgtttgtgtaggaagactcgtctgggtcttgggattttcttaatcgagcccattagactatcttcttgtaattatctcaggggccaatctgtctgtgtaatgggctctggaggaatcaaaccttcacgttcttacaaaggaaaatgttatgtatgtgtcagaaaaaaatgttttgaagaattactggctaaccatctcaacagccgccggggggaactttgctgtgatactgcaggaaattgttggatttgagactatattgctccaaagggtatttctttttttgtgggctttttaataaatctaaaatgcgcatgaagcctctgatgcaggggactccacaccaactgcctccttactgtatgaaaggataccaaaatcttaccgttggagagactgccaacactctggatggctagggtttaactaatgactagctatgctgcttcactgaattgggctggccagttgttctggatccttttacctgaaacattaatgtctgaatatggtggctatgtccaacagttcattattacttgaagatattcacactatgcattgatattctgatttcttcacctccctacttttttctgtttttgcgaatttttaattctctgcagggtagagaatagatttatagtataaaggaaactatgaaaagctaagaaataatgaagatataataataaatgataataattattatgggttgaattgtgccctcccaaaatttatatgaagttttaacccccaatatctcggaatgtgactttatttggaaataagagtcattgcagaagtagttgcgatgaggtcattagggtgggtcctaattcaatatgactagtgtccttataaaaaggggaaactgaaacacagagatgggtatgcacacagggagaatagcacatgaaggcgatgaaggcgaaggcagagatggggtgatgcatctgcaagccaaggactgccaaaaattgcctaaagaccacaggaggctaggagaggggcctggaactgtttctctgtcatagccttagaaggaagtaactttgccaacaccttgatcttggacttttagcctccagaactgtgagacagtacagttctgttatttacaccacccactttgtggtactttgctatggcagccctagcaaactaatatagtaatacacaaaccaggtcctatggtaagcactttgcttatatcattttactctcttaacaacagccttttggtctgaagattgtcataaacgattgatgggtggaatggctgggtgggtggaggaagaattctttttcttcccttttcaccattcaaataggatttttcaacatatgctggactgaaaggacttgggcagtgatgctggatttatatattcccttcatgtgtgacttcaccagaaatttataaaactatcatgcgaggctaaaggaaggcatcatattcagcactcccttcacttgtggtacataaaagatattctttacaaaagaaggaaaaggtgaggtggctgctactcacctaatgagaaggaattgggattaaatttagcttagtgactctgatggcaatttttacttctggactaaatgttatgaccttctccatccccacgtctaatccagttcaaattccttgagcactaaggctctatatgctttaattttattattattatttccctttcagattcagtttaaaacttatttcatttcccttcctgtcaagtttattttccccaagcttcctttggaataggccctttgcagtataagaaagaaaacaggcactaaactctaaaggagaaactgttacaccaagtcgtaagctaaaatgtgcctcaaatatggccacaaaattattgagcaaatattgctgccaatcaatctgcctccatagtgggtggtttacagccagggttaccaagattaaaactaggaccaatgatgtgcaaaagtgggcccaactgaccttattgattatttcccactgagagagaatcacaggttagcaggcagaaatcaattcaactgcattaagttaagccaagtgtagatttattcataccatgcctggaaattataaagtggcaaaaaatatttaactatacgtagtatacatactaacttacaaatatatctttaaagtacatagatgcttgctccttcctccttttcataatatttaaaaatctgaaataaaatatagaacataaggctgttcctgcatttcctcccacaccatcccctgcccccacccttttaaataaaagaggttatttgtgaatgctcttaacatggctacttcagccacaccccagatttcaggatggagtggcagagcagatacagatatgtctccgcagccaaagaagcaatgaaagctatttgctcttgaggaaatcatcatttttggctttttagatgaaaggaacttggcccttaggcttcagtgcaccatggggaacacagaattcattctctttcctcctccagtgacaacacacaggctgggactgaagagagctttcagaatgaacaatgggtggaaaacactgcccttccagcagtgagaaatgtgaaattccactcctaccctcacatgtgtcaccagggaaccatcctgtgtgctccatcagcactgggatatgagccaggcaatcatttgtactcagggactcagccttaacctaaaaaatcatcagaagagcctaagaagggttcctcctcattcctcatatctgagaaacaaagaacaacacattttactgcaagaaattgtttgtggatcttattgagaatagcttagagcttgcttttcctttaagcaggctatctacttcttattctgcctagccagctaagatatttatctcctactttcatggtcattcacagccacccagaactttcaaatgcattgctcagggcctctgggggtggcctgtaaaccaacaaaaatacttttatcaaacacaccatagagatcaggcagttaagagaccaagagtcaaatttatattcagtttagaatataaattgtccattcccagttcaatgggaaaatagataattgaccaaaaccctttagttgctcaaagctgggcactgtggcaatagaagaaacctgtgtctttgcagctcagtgtcagttgtcttgactcattttcccccaactctaaaacgtgcagagaaagacagagagagagagagagagagagagagagagagagagagagagagagaaagagactataagcatggaatgatgtgaagaacactgggtcagccagtgggcctgagttcttaccctagttctaccacttggtaaccctgtgcccttgaacaagctctcaactctaaaatgtggcaggatttcaatcaatattccaagattttgagatttttggccataaaaatgggatctaaagaagatctgatttgcagggttgttatggaagatctagaaagaaaataaatatatcagcattttgtcagctgttaagtgaaagacgaatgttagttattgtcatagggataagagaaaaatctttaagaacttactatgagcagcctggcacaattattagagtcctctagattggtaagtcactgaatctctttgaacttcagtttccccacataaactgcttgccttctggcatgaagagaaaatgaggtaaagaaagtatgctttaaaatgataaattgtcggccaggtgtggtggtggctcacgcctgtaatctcagcactttgggaggccaaggtgggtggatcacaaggtcaggagatcaagagcagcctggacaacatggtgaaatcccatttctactaaaaatacaaaaatcagccaggcatggtggtgcatgcctatagtcccagctacttgggaggctgaggcaggagaattgcttgaacccaggaggcggaggctgcagtgagccaagattgtgccactgcactccagcctgggcgacagagagagacttggtctcaaagaaaaaaaaaaaaagataaattgtcctagaaatgcaagcaattgttatctagagaactcattttgacttttggcattatgatgcacacacagttagttcttggctcaatgacagactttaattggcttggctatgaaaaccttatagcgctattatgtgctacacctgtgatggccatgcagcgtgttaatcaagacaattaggctggggacccagagaacggctttccaccactgtgcataatcctcctcactttgaaagggaaattaactgctgctttatggtctctcatattatctcactttcttggagagagatcccaatcagatccaccttgactaaacaacacctatcactggcgcatgggatgacacaacatctgtattaactttgactttgaaacagcttttggactgggagtttaaaaaaaaaaagtcatatgtagcaatcattagacaaagcagccactgggtgacagccagaatcagaggccagaaagttgatctctttcaagtgacatattccagaggagaaaggaacaggaggatgagcagatcaatttagctctcaaagtatttattctctagcctgcaaaaggagaacagggcttccaggacgactctgtctgctcctcaatttctcactacaattataaaatcttttggaattttcttccttgcgctacccctgctatccccatttcttctaagaagcatgagaagtatattttgttgtttggatttctttcactcttgggcaaagctgcttgaactgataattagtgattttaaaaagcagcacatctaaatggtggctattcattaatcataacattctgagtttacatgcatttatcttattaaatgctgtgagataaaagtgctgtagggatatttaaactcccattatgcagataccaaaactgaggctcaggaaggccaacctaacaagttcatatggcgagtccgaattttcattcgggtctcttggctccaaggcttttctataacatcgtgctgcatatcatctgtggaggaagcattattcaagggctaaggactaggctcaatttatttctgtggctccagtacctacaacagtgcttgtcaccttctaggtgcttaatgtggaattaaattttaagaggagcttcccaaattgcttaatatctttagaataccaggaaaaaaaaggtccagtaccccattcctaatcatcctctgctatcgctgagtcagaaaaaatggctcttgtctcccaatggtaggcagtttagctgtgagaccatcctggggacatgggtgtagatagaagcagatggatcatgacaactggaaagatcccagtagagcagctttgggccttagtctactttgctttgctctggaagaggccaaaatgaactgttcaacctataattcccaatttatgcaccaaagcactccagggcatcatggcatactcacagggatgctgcaggatattttaaattttgagtgaacaatagtgatattaaacctctgtcagataatgtgagaatgaatagcatgagggaacttaccacttcaacattagtacatagtatattccccttaattacaaagtatttttgcaaagctggagttttggtagttaatataattaaaaacaagcactgcatcaaaatcaatgtggagcagataatgaaggtgacagtattcaatctgattccaaggtttgggaagtggtacagactattagggacacataattccattgtaagcaattgtagttaagaatgaaataaaattatttcttcaatttatgttactatgtttcaaacagttactacattgttagtgcaaacacacttattaagtagtttgaacctaactacttagtaaacagaacagttgtgaatttttttttggcccaagaacagcatgaaaaaaattaggacgatacgaagggtgatatgaactgaggtacttggggaacctctgttctacacaaagcatggtttaacccgagatgttccagggctgaacctgcctctggattctctatgtggtacagtgacagccacaaaagcagctcccatctactgagctcttggccaaacataggcaagctcttaagcattgtaactgcatgacctcatttaatctccagagcactgtgagcatgggtcttttatgatccccatttaaccgatgagtaacctgaggccccaagaggctgcccatggtcatttagctagtaagtggcgtagcaggaatttaaacccatggctggttgatttccaaagcttgtacttttttttttagaaaaattaagcttttaattttgagattcacatgcaattgtaagaaataatagagagttactatggaacattcacccagttccccccatcacaatggtaacattttgcaaaactataggactatatcacagccaggatctgacattgatacagtggagatacagacaatttccatcactataaaaatctctcctgttgccctttcatagccacaccagtttccctccagtccccatcctttccttatcccctggcaaccattaatctgttctccatttctacaacattcttgaaatgatgaaatcataaaaatggagaacagattagtggtcacctggggttaagaagaggtacatccagtagtacataagcttttggaattggcttttttttccctcaatattttctggagatgcattcagattgttgattgtatcaatagctcattcctttttaattgctgaatagtattccatggtatggacgtaccacagtttgatgtgctgttcacacatctaagaacatctgggttgtttccagttttttggtaattatgaataatgctgctataaacattgtgtacaggtttgtatataggtttttgtgtgcacatacattttttttatttttcaaagacaaatacccagaggtgcaattcttgggtcatatggtattatagtttcatgtttaggtttttaagaaattgccaagttgttttccagaattttttccctagaatattcagaaggtacattttacattcctatcaaaaatatatgaatgatggactttctctgcattccagcacttgtattgctaccatttcattttagccactgtgatagatatgtatctcattgtgctttaatttgcatttccttaatggctgatagtgttaaacatcatttgctgtgcttattggtcatctgtctatcgtctttggtgaaatatctcaggtcttttgcccattttctaattgcatttttttaatgctgttttgagagttctttatatattttggtaactagtctttgtccgacatgtggttttcaaatattttcttccggcctgtagtttgtcatttaatcctctaaacagaatctttggctgagcaaatgttttaattgtgatgaggttcaatttatggacagtgcatttagcataagaactctttgcctagcctagatcacagtgcatgtagcataagaactctttgcttagcctagatcacagtgcatgtagcataagaactctttgcttagccttgatcacagtgcatatagcataagaactctttgcttagcctagatcctgaagatttcctttttttcttttcttttcttttttttttttttttttttcgagatggagtctcagtctgtcgcccaggctggagtgcagtggcttactgcaagctccgcctcccaggttcacgccattgtcctgcctcagcctcccgagtagctgggactacaggcgcctgccaccatgcccggctaattttttgtatttttagtagagacggggtttcaccgtgttagccaggatggtctcgatctcctgacctcgtgatctgcctgccttggcctcccaaagtgttgggattacaggcgtgagccactgcgcctggccaatttccttttttttctaagaattttatagcttcacattttatatctaagtctgtgatccattttgagttcattaagattaggttgagattaattttgtgcctatgggagttcaattgcaccagtgccatttattgaaaggctgtctttcctccgttgaattgcttttgcaattttgtaaaaaacaaacaaacaaactgagttgaacatatttgtgtgggtttgtttttggattctttattctgttcattgatctatgcctctatctgtctgttaatgttacacagtctttcatactatagccatataataaatcttaaaatcaaggagactgattcttcccagtttattattcttttaaaaatgatttttagctattttggttcctttggttttccatatacattttagaataatcagatctgtatttataaaaatcttggtgggattttgatagcaatcacattaaacctatatatcaatttgggaagaattaacatctttgcctcgttgggtagacaagtcctatgcctttataaacacttttttattttaggacgaactagggtaacaaattcagttgctcaaaagaggccgcatgtatcaggtttaagaacatgcaggcttcttgtgatagtagattggatacagaatatttctgtactgtaagaaaacaataactcaatcagatgttaaatgaccaggaacacttgagctcagcattagaaacataataaggaatggtggggattgtggcttgctggaggaaagccatgtcccctatgaatggagcagttgctacccaagtcttctcatggttaagaacatgggcacagcattgctatggcttatatattttcaacataagccagaaatctattttttaaaaaacctaaaatgttggcacctactttgaattaacataaaataaaacagttcaaatacacacgttggtacgctggatccagcagcctctctgtggtctcagaattagagacaacaaagaaggtccccaccctcagggaacatacactccagctggagcagcagagagacaccacaaagcagcactgttctgctctcaacagtaggagctgaagagcatgcagggggatcctgaactctgccctgggaggtcagggatggctccccaaagaagtggatttacacagcaactccaaggagagacatttggaaccaagctgtaagcacattaggaaagagtaagggatactttccagagaatccaaatcgtggcatgaggtactcttgagaaggttaattcagttgatgattcaacatgtgctatttaatccattgcctccagagcaaacattgataggattaaataacagtgcagagctctacttccgggcatcacagaacatagcggggaagaggtcatagagttcagtgtttctccaagtgttatgtcacctgttgggaattgcaaagctaaagctttccagaggtgaacagttttctgatgctcttggaagaaaatcagagccccttctaattactcacaaggacctatgtggtctggcccctgcctgcctctttagcctcctcttctctccttattcctgtcttctttctgtctttgcagcatatcatgactcaaggcctttgcattttgtcattctttcatttattcttctgtttattcaagaactgttgattgaatagaaataaatattctaggtattgggaatacaacagtgaacaaagtcaactcagttcttaccctcatggagtttacattctaatggaggaggaagacacacatagataatatcctgccttgtgtgatgagttctatgaagaaatattaaacagagttaagtcatagggaataatggtgattgcccccagagggtgggggcaggtcttctggtgaacatatgagaagaacttgaatgaagtgatggagcacaacacaaaagcacatgggcttttccagaaagagaaaactacaagtgcaaagagcctgacgcaggagcacatttggcctatttgtgggtagcaagaaggggagtgtgctagggcagaagagtggcaggaaatgggggtagggaggaggccagatcatgtgaaactgcaggccttggttagcactgtggcttttaccctcagtgtaaggaggagccacagagacatgatttgacttacagagaacagatggtggatagaaatctgttacaagtttattagaaaagtccaagtgagagatggtggcagcttggactagtgtggtagcagtgagggtggggagaggctgatcagcttgagacgctgtcaaggtagagatactgtagggttgccttgcacttgccttggagtatgagaggaaggagtcaaggatgactccaggggttttgttctgagtgatacatttattgagatgaaaaaaagcagtgcctgtaacatcacaatgttggctccttatcatgattcaggtctccatcgaatgtcttctctttggagacatcttccctgaccacccctcatcctatcagtgctgctcattttatttctcagaacttaacacatatctgaaattatcttattcattttatttgactcatttatcatccggattccccactgaaatgcaagacctaagagaataagtgccatgtctgcttagtttattgcaatatctttagtacctaattcagtgcctggatcttgaaataagatcagtaaaagtttgctgaatgaggtttgcaatgtgtgagataagttaagtccccaggtttttggggtgtgtgtgtgtagttcttttcagagcaatcagttaatggattaaatagtattgattatctgtggcaggcactgtgccaggctctgggaaaacaaaaatgagcagaaaaaaagcattgcctgcagcctcatggagcttccagcagcctggcagagccatagtaaataatctcaccaacagactttcactgtgctaaaaactctgaaggaaagacacatggaggtatgaaagtgtattatctggggatctgatcacttcggggaacacaggtgaaacttctctgagctgagatccacaggagaagccactgtgggcctcagggatctctgagaagcatagatgctgtggctatgacttcaaatttttcatggagcttcttgtggaaagaaacacattttggcaaaagcagaactagtacaaccttctcaagcactggggcttagctgggttcagaacctggataagatgagcagctgctccatgacagaactagggttttgtatttatcatgacacatgtgggtaaaaagggaatgctacctacttaacagggctgctatgagaaggaaaagttattgtccatgaaatgcttagcacagtgtctggtacacaagaagtgcaaaatacttggtaataattatcatcagacttcaaatttgtgagggtataatgtgaatactctcccacacacagagaatagacagtatagaaccttacacagagcaggacctcaataagtttgtattgaataaataagtgctggttgccttggtgacacaccattttgaatctgaccaaacattttcaccaaagatggacacagtaaataagtagaaatgaactaggccagttccttttgtcagctgtctcaggactggtagctgacattaattattgatattacagggagggagattcttgccagccaaggacacttggcagcttgaatgtaaggaattcggtctgatgctcggttttaaactaaagataagtgagaagtgggaggacccagaggattcgatgattttatgcatcaataatacttgccataggaaggctcagccagagtccgggaatagctgctactgaaatggcattttccttttcattgaaatccacatgcttgatttgtgcatgtgacttctcagctgctaccataatagaggaagtggttttgaattaacactaatcaacctgaatctccaggggcaacttgtacctgaaaacctccaagtcctttgtaaacagcagttaagcttccctgtctcctgagggatgagcttctggatttttgcttaaatcaagcagaattgtaggaaagaggttgcaattatgagcaaagtgggtgtcagacaggataatttctcatcataaatccaggcttgaaaagggccaaaaataatctgaaagtccccaagatattttgcccaccaaagttctgccacaagcccccgccacgtgtcagatgaaggatgattggaaattacaacagccgttctggagggcaatttagccataactgttataataagcagacccttcaactcagcaattctgcatcaatgcatttttactagagaaatcctggcacatgtgctgaggagtaagcaagtacccccattgctgtgtcatctgcagaagtgaaagtctgggagcgatctcgaggtgtactcatcaggaggagaatgattaaataggtagtggaatagcatgcagcaactaaagagaatgaagttgacccccatgtattgtcatggaaaactaagattgttaagcgaaaaaagcaaatttgcagaagcatatgtgcactatgccatatgtagtggttttaaaatacatacagaagttcttcgatactctttcccttatgagatgcagcttaattcgcctccacttgagtttgggccagacttagtaattcatttctagtggacagaatatggcataaatgacaaggtgccacttccaagactaggtaataaaaaggtattgtggcttccttcttgatctctctctttcattcttttactctcccatcactcactctagaggatgccaactactgtgttttaaggacactccaggaaccctgtggagaagcccatgtggcagcctcctgtcaatagccagtgatggacagaagactccaggcaacagctgtgttggtgagccatgatggaagcacttcctccagtcccagtcaagcttccaaatgactgtagtcctggcttagaccctgactacaacttcaggagagatcatgaactagaaccccccagagcttagtgcccttggattgctcactctcagaaagtgtgagagatagtaaatatttgttatttcaagtcactgttcatggcagcaattgacaacaatacaccgtttatataaacataaatttttaaataacttaacaatacacacatggagacaaatgtttagagaaaggtttggcaggagatgtgccatagtgatgaaggggttacctctgagaagtggagaggagagggatggagggtggggataagattagcttcacctgttgtgtctctatttttgttatacatgcattcatacatgcattactgacataattttagaaagcactaaaagggaagaaatacaatgtaaaattctactactttggaatttcatggcaagtcagataaagctgaggtttacctttgatcaccttcaagtaaaagggttgcttagcaaactcatttaataataaacaaggttatcagcggagctctccaacctacttaagaaagccaactcctgtcagttactcttaaaaatcaccttagcataagtcatatataataaatgatcatttttactcatgtttcttatctattattaaagcaggtcaaagagacctttctttggacaacaccaattggcaatatttgtattcccaaagagcatccaaattattttgaaaatgacaaagataagctctactgaaaaagccaagttatatattaatgcactgtggtttcatcaaatggtttaaaatcaaagaggttttgttgtcaggtaaggttatggaaaaggtattttaaaagtaaactttgtattggatttcttttaggcttgtgctaatttgtttttcaacttcgagcctgggggtctgcatcatttaatagcagttccaaggcaaggaccctgatcctcgtctgtggctagactggctgcaggcaccaaagcttatgcattttcagtggaattgggtccagagcttagctgcaaaatgccttctgggtgactgaccagaaattcaatcacagcacattcatttcaaaaatccctttcatgtatcatttaaaagcagcctgcatacttacatttgcatatctctgaccctggattttggaaatgcaggagaagaatggattgctgtttaattttcaggatgatgggaaggaacaaaccagaggcatttccttctcttgactactgagtagatttagtacttctgaaagattctgaatcagtagttttgtaacataagccgctgttccatagagcttgggaataagaataactaacatttatagggcattttataccctacaaagtgggttaccattcattgcctcatttaatgggcagaggggctcttaattatcctttctgatgaggggacaatgattctttcaatcccagcatctgcagagattactctggttttcctttcatatggacacactaaagaaataatgatactgcatgctagcttcctcagcctgggaaagaatacactacggcagatgtgaggtttcttcattttccccatgctgcagtgtgtattccaagtttctttcgattaactgaaaagtatatgtgaatcttttctgcaggaagacaggaaagttaaaaggtagcctctgggatgcctgggtttgaatcctagctctgtcattttctggctgcaaagtcttaagcaaattatttttctgttagatatttaaaaccctttaacttatcagttttcttatctgaaaaatggggctgataataatagtaccagcatcacatggtttccatgagaattaaatgagtgaattcatgtcgtgtacttaaaagaatgcctgatgcatagtcaacattcagtgactgttgtttgtatgtgcagtgagctgcattttaggctggatgggtaacaaggcacatccaccattcattcaattactgcacagctctctgccaggcaggctgaagctccaaggatatgtcaaatgtggttcctctccttgcaacacttacattctggtggaggaggcagacaaattaagattaaggagggtagacaatggagagtggagctagagaatgaagctctgagtgagagtggggttttcttgtttttaggatgtgaaaggccagcctttcaaaacacatggggaagaacagtcctggtggagggaagatcaggagtgagggcttgaaggaggagagagcatggcaagtgtgaggaactgacaggcaatggaattgggggctgagtggagagggagggaggtaggcaggttgcccaggccatggtggaatgtgacagttttgtgctgtgtacaaagggaagccacagaaggtttagaagtagagcgggaacatggttttatataaatttatgacatttagtgaaaactttatataatggtatcacatataaatatctattgcatacacatatttaaagatagtactggctgccatgtagggtgaggattgtggaacggagggaccacagtaggaacacaaaaatagaagaaagagacacataccagcagagaactacaactgctttggagtttaaaggaaaatgggtggaaggcgagagatggaagccccatttgaggtgactttgaagaggacattgttttggacatgcaggggtgtctggaaaacatagatggcctcactagttgctatgtgtcttgcacagaggacataggggtcttccctggagtgtcccaaatttaatatatggatctctgaaatctgtacaaacatgcgatatgggggaaggaaagaatacaagaatattgcttgtatcccaaatcacactggtacttagactatcctgtggaaccaaactgcaagaaagttccagaaataaccagtgacttgatctgcatccaagtggaaccctttgccctgacatcaccttggcttttgaaggccaagaaaacctacagggtttaaacttccattttccacaaagctttgaggccaagcggaactcttccatgcaccttgaaggcttggtcgcctgaaatgaagctgagtagacataaggagatgtccaaaggaaaacaaccaaggaaggacatgaaacctctcagctactcagacctgtccagatatggagcttggcattgtgatgctattcctcagttgattttgctcacattatggttctgtttatgtgatattctttgtgacaggccaccccttcctctcaacattaacatcagtgatgtctgctttctctggagttactcatacaagcattctccttggcttagagatttacaaatgatagataaccaaaatttcaatgattgccccaaaggctcaatctgtagcagcaaaagcaacaggtgaactagcaccagaggagctaggtttcagtctcagctctaccatgaaacagctttgtgatctggggcaagaaccctcattctttgaatttctctttcctcttggctaaaagttaccaacattacctcaaaggcttgttatgaggattcattatgacatctgtccaagtattttattaaattaataaaatacaaatacggcactatcatgatgaaataacagcaaatgtttacatgacatttaaaaatatttaaatattttcacgagctatatttcattagccaattcactaatgaatgagttccccattaagttggctccatgagacgccacaaactttgtctgatttttccccatcctgaatccttagcatctaaagaagtaccagtacctagtaggagcttaatacctacgggtcaaatgaaagaaaggaagaatgaacagaaaccactctggggaatggaaggacactggtttgcagaagacagagaatatcttctgtaggtcataggaataatcctgagcaacagaaaaatttagttatcctacaaactaaaatttcacagctacatttatgatagcacaggccctaatcctgtctctacagacccctaggtttttttacttccaatccctgccctctcttacatggaattttttttttcccaaatggaattaaaacctaatactttcctaatgcagtctttcagttctcttcttaagccatctgctcttttatctacaaaaacttacttattttatttgaaaacttttaattagatgcttccaggcagtggctgagttaagtttagaagcttcaagcttgtctcatactcagcagctgcagtaaggaaataaggcttatgatttaaattcattattatctccatgttgatgtcatttttctcccttgctattgcattgttccaggaagttacataaggcttaagaaccaccagactaataatattgcttcttagaaatgacctttcagggaattttccttatgtgatcagatgctggtaaagctatgataataagtaatatacttcccctctacctcaccttttatctgaagattactgaaagctttgcaaacattaattaagccaacctcataacactcagggaaaaaggaattatccatcgcagaaaactaaaactgagtttaaaggcacattactgacatgtttagagtcagccaatcagcaacagaattctgattgttctgtccccaccttcacccccacctcccctgtgggcttaagaaactcttacttatcctccaagactctgctcaggcatcacctctagaaagctctccttgcctccaccttccaagttgaattaggtgcatcccttcctgttgcactctcaacatcctctgcaggtatcttcatctatacacaccctattcttcataataacatatattaatgaagtgtccatatgggtgggtctgactggcaaatccatttcttccctttttttttttttcatttgtgacggagggtataagaacaggaagtgctggtatcataattattttgaatctatattaatttatataaaagagcaaaacatttgtcaactccagtgctttagttgttgttagtagttattgtgatgtcttacagttatatgatgtgccaatagtgtattacaatatcatatttgtgccttcccatcctatgacacaactctgaagacagtgagagcatctgataatcttaaataacttttgggtaacaagaaaggtgtgtttgtttagaagctaaatctgcttcctatattatgtaaaaattaaatgataattgcatacaaagcatttagcacagcatgtaacacacagtaaacacgaataaattcagctgttgtgtaataacatcaataattactatttattgagtgcatattatgtgttaggaactatgccaagtgctttatatgtaccctcttaatattcctggcaaccctataaggtattgctttaatctctattttgcagatgaaggaactgaagtatatggaatttttataattttcactgcatagctagtaagtagaaaattaagcttgtctgcctccagagttcagcaaactatactgcctctatttaagcaaacaagcagcatttattaagtgtctttgtggccaccatgtgctattatgggatgaaatgaactctctgctctccagcaactcatactcttgctggaaaagacaggcaagatacccaagtggaagatgtgaggtgataagactgtatgtgatgaattatcaaactaaacaatttaaagcaaatatgctctagatttaaaggaggaagagactgaggagctgcaagtcagaagagacctcagaagttaaggtgcacctggaattattagtatggtctgcatgctctgctgtgattttgtgggtgagggatgcattggaaatacctggctgaggggaggggtgctttttcaaacttcactctcacccacccttgactcgcatagttgaaaaattgctgttgaagtttaccaggggtattgaagaaaatatttgagggttgtcccatcaaaaagtgggcaaaggatatgaacagacagttctcaaagaagacatttatgcagccaaaaaacacatgaaaaaatgctcatcatcactggccatcagagaaatgcaaatcaaaaccacaatgagataccatctcacaccagttagaatagcgatcattaaaaagtcaggaaacaacaggtgctggagaggttgtggagaaataggaacacttttgcactgttggtgggactgtaaactaggtcaaccattgtggaagtcagtgtggcgattcctcagggatctagaactagaaataccatttgacccagccatcccattactggatatatacccaaaggattataaatcatgctgctataaagacacatgcacatgtatgtttattgcggcactgctcacaacagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcacaaggacaaaaatccaaacaccacaagttttcactcataggtgggaattgaacaatgagaacacatggacacaggaaggggaacatcacacactggggactgttgtggggtgtgggaagtggggggtgcagcacaccaacatggcacatgtatacatatgtaacaaacctgcacgttgtgcacatgtaccctaaaacttaaagtatagtaataataaaatttaaaaaaaaaaaagaaaatatttgagggttgtaactgtctggattttgtagtcagattgcctgagctgaaattttggccatgtctcatttcttttttaacctcagttttctgatcaataagatggaaaataataattacagtatgaggagatgtttgtaaaacacctagcatggtgcctggtgtgtaacatgtttaatgtgtgataatttagtaatgtttccctggcttgatgagggataaaaaaagatgggactcactaatctaggatgtttgtcagatagcaaaccgcattgagctctctgcagagtgtatgtgggaatgatggcagagaagggctgtaggaggagctgacaagcactacatttccaatctgtcttgggacctaaaccttccagcctgaagacatcttagcatcttagcctgacagtatttcttaaacagctctgactccaaatggccactcaaacataatggaatgatatgatttcatacaacatgctcttgggactggtagaattcctttaatggacaaaatgttaaagaaaaaagttactgatattggctaaaacaaaagaacagtttactgcagaatatagaataatctttcatagattttaggaagcaacaataagcagttatgaacaacgtggactcaatgggaagactacacttgaattcactcacttcagcattctctgaaggcatcagtttccccatctattaaatggagaagaaaatagtaccgaaagctgcacagaaggcagttatgaggattaaatgagatagtgaatataaaacacataacacagttccaggcatacagtcagcactcagttctgttcactactctttctattcaaggtgctgtgctaagattttgggtaatagagatgaaaaatatctaagcattctcacaacagtttttagtagttatttcttacatatctacatactctttgggaacagatttctggtctaatccattctattcatctccatatatccagagtcaggcacagaacttgaagtacagtctgtgcttaacagttgtgacttgaataaataaatagggatgcacggcacccaaccatcatgcttaagaaactcataggaatgaagacaggcacctagacaagtaattataatgcagtgtaattgttgtggtcaagaggctgtggattcatagaaggcctgggcgactagcatcattgtcctggaagcaaaccagaccaagtccaggtctgccctgcttcaggctggtaggtaataaggaacatgtgtggaatatcaccaacatctgactacggtcactttgagttctctagttgagcctctgtcatttggctaatgtgccccgcacatcagtggagtgacctgtgacccgcctggctccaagagcagctctgtgagcctgttttgctagatttctgcctggagcacttggccataacaaagtggagaggagagaaatcaataacaacctgaactgaacgcacagttaaaacatcagccttcaactctggaatcacacccttgtcactggcatccaaagtgcttttgctccacgacctgctcagggtctagtaagcaaacatgaaggaggaaatggaaatagctccagggcacagacagggaaatgtgctatttgataaacgggaacccaccaagggacagcttcctagcgtataggatagaaataacgcagctggttcaaatgctggttgaggatcttccggtatgtttctcaacctctctgagcctctggtttcttgtttggaaaggatgatgatgatgataatcttacccaagagtggtatgactcttttggcaattcagtaagcattaatgcatgtgacatacccaacacacgaactgactcttggctggtgctcaataaatggtagcttattacaactgcttttctgctgctcataaggaggtaagcaagaccaaatgcagtgaaaataatttattagccacagaaataaaagctacagcaatttaggtttcccacagttctgttaaaagaatgcttaccaagcacctgtcatgtgccacctgctatgttaaggactgggacccaaaaatgagttaagacaaggacccttctttccaaaggtcttgctctgtctctcaggctggaatgcactggtgctatcatggctcactgcaactttgactttatggactcaagtgatcctactgtctcagcctcccaagtaggtgggactacaggcatgtgctaccatgcctggctaatttttatattttattttttgtagaggggggtctcactatattgcacaggctagtcttgaacttctgccctcaaactatcttcttgccttggcctcccaaagtgctgggattacaggtgtgagccactgatcctggcaacaattttaatataattattaaaaggaatttcacagaaaagagaaacgtacaggtggcagaacacacagagaggggcaaccagctcaacacagagaagatggaagctggtttgagtctgaaggacttcatggagccagccccatgacggaaagtggaaggggcactccagctgtgggctgtagggacctgagtctggaggggggtgggcaggcaccagatgacaaaagccttgtgggcccacttttgaaggaatttaccctgagaagccaggagccactgaagatttttaagtaggaacagatttacatttggatatatcactttggctttagggtggaatgaaagttattatttcgcaggagtatttagggcgctatttcttcattcctttccaactcaagcaaatacacaagtctattgcctcttctggatggctcaagtcagtaattatacaaccaaacataacttttggacccagaatcattcccctaatggataaaatgttttaagcaggcatctctcagctctcatgctccatttccccagagtccttatcccttgatcacatacttgtctacttctgctgcacctgcaagagtgagttcattactctccattatacatctccattcagtcataggcaacctcagtgggaatgtcacaggtcccaggccttttggtggctgctacagttaagataatttaagtccttctaatctcaagaggtgatcttgctagccaagagatgtctctttatggaacatctctatcccgagagagagagagagagagagagagagatacacgcacacacacacgcacacgcacacgtactctgccccatctaaaccatcctagtggatcttcctagttattgccaaaatattaagctacttgaatcatatgtcattgcagtacaattaagaatttaattatcctcaggtataaaaagagttaataaggccaataattaaactcttggtagaaaacacatagaggtttcagaagaataagtagattttgttaaaagtgtgtcatacatactattttatgacaaatgtatcttcttttttaagttccaaatcagtgaagatttcttatatgctatagaaaatgtgatatcaaattttaaaaggttgcttggaaacacagatgtaaataataactatatttcacattcatacattataagatgtagttttcatatgatatctgaatgctttcacatcccttagctagactgagcacaggaaatccacgtctaggcagtgtgtgttttcacaccttgtactagggtaattttcagagtcattaccattctggtaagaaagtttcataagggctttaacaacatatgagaaataaggaaaatctatctctttttccttattcctctgagcctcaaagttaagcctgcatttgaagaacagtgcccagaacatggaaggagcaacataaaccacatattatgagaagtggccaaaaccctttgtgttagcatctgacttattattggtaacatctaaattgccactctaaattataaatagttaaactgtgcgcaatgtgaaataatcaagaccatgctttgtttcttaacatctactacactggctcaaatacttttatccagattcttccaacatgacacacattacatttagaacttggttttctcatcagatttgtagagaagatagttaatgcatatttcacaccacaggaagtgattggggtaaacttaatatcataggagcttttggatttagacaaagaaacccattagttttctcaaacagccatcagagagactttaattaagtcaccctgacacacgtatgccttcactggatcacgatttctcatgctggtaactttcaagcccggaaaatagtcactttgggaaagtgtttagactggttgttttggacagaactttttagactctccatttattatcatctggtgattaaagaattaagatggtgatacctaaacatgttcttttaaaggaaaataagtatcattaaatcattaataattatttgaggaaaaaggagccaatggcatctcttgaaaagccctcattatactttctgtaatgtgctcctagcttaaatgcagaaagatgtctttgctaactttaacagctcatgaaaagttactgtaccacatacttagtagtctttgatgtattttgctgatgataaagaatcaaattccattcttcccacaaaaatttattccagtatttttaggtttaaaaaagatgtctgggaaaaaaaagagaaaatgtctctaaattagcatttgagatgaattaccattttccagagatatcactccctacaatattccaccccaaataaaccggaggaagaactgtggctaaatgcctaagccaggagtgagtggggagtgggaaaaggctccaggcaggtgaaaagaaccaagttaaagtctgaccaagactgaggtaaaaaacacataattccttctgataacacagcagccattattatagctagtgttgtgctcagtactttccctgagtaatttcactaatccttgtaagtacttcatgaggtgatttctattatttatactttcaaatgagaaaacaggctcagagaggttaagttctcaaagtctcacagacagcaagttcttgtcttagcttctggaacagtgaatgctaccacaacaccgtgggccctacggcaccataaaaaagcttggcagaaggtggggcacggtggctcatgtctgtaatcctagcactttgggaggccaaggcgggagaatcacttgaggtcaggagttcaagaccagcctggccaatatggtgaaaccccgtctctactaaaaatacaaaaattggccaggtgaggtggcgcatgcctgttgtcccagctacttgggaggctgaggcaggagaatcacttgaacctgggaggcagaggttgcagtgagccgagaccacaccattgcactccagcctgggcatagaagtgtctcaaaaaaaaaaaaaaaaaaaaaaaaaaaggctcagcagagacagtaacagcacagaatatcttaggtagcattagtttctccttgcatatatccagacttcactaaatgtttaggccaagaagaaaatcacaaaacaggaatacttgagaatatataaaagtggctcatatccttcaaaatttgaaccccgaggcccaccccttgtctcctgtttggggagtccaaagaattcacagacacatcagtcatttagtctgtaagcaaatttcatttaattcatactttgcctggggttagcagtccatggtcagaaatgctcctggtaccatattcctaagactgtcactgactctgcagctggttcttccgtggtatagagtgaatctttcagtaggaagtgtttctaacaagttcccatgctgctgaagccaacacaaggcaagaagctttgaaatggctgatgtttaaattatgactccaatacacacatacatacacacacacacacacacctatatatatatatttagtagacttttttagagcagttttaagttcacagaaaaattgagtacaagctatagagatttcccatacactccctgcttccacacatgcacagcctccccattatcaacaacctccaccacagtggttcatttgttgcaatcgatgaacctctgttgacacatcattatcacccaaagtccatagtttacattagggttcactcttcgcattgcacattccagggtttggacaaatgtagcatgacacgtatctaccactatagaatcatatacagtagttccaccaccctaaaaatgatctgtgcctaacctattcactcctccctctccccaaaccctggcaactgctgatcttttgactgtctctatagctttttccagagccatatattttttaaaacaattacctgaggtcctctggggaaaaatatcttattagagattcacaataagcattgtcatttgaaaggatctgaaaactctagcagttaacaattggttttcttttttttttttgaaacagggtcttactccgtcacccaggttggagtgcagtggcacactcacagctcactacagtctccacctcccaggctcaagcaatcctcccaccccagcctcccgagtagctgggactacaggtgcatgccaccatacccagctaatttttttattttttgtagagacagtgtttcgctatgttgcccaggctggtcttgaactcctgaactcaaacaatccatctgccctggactcccaaagtcccaaagagccaccatgcaagtcctaagaactggttgtaattttgttgtagccaatgcttcccaagaaattcctgggggtgaaatggttaacagttttattccctcctcttctcactatctccactgtcactccccagctcagaccaacctcatctctcactgtccactgtcatggcctccaaatctggtctctccattcacctcctgcttattttgcatcctttttcctcttaacacagagtgatctctttagaatataaactggctttccactgcattaaggtaaaatccaaacttcttcccatgatctataaggtcccataccatctgacgctgggcccacaccatctgacattgggcccacatctccaactttgactattattttcttcctcattaactgcaagtctcactggcctcctcccagctctttcctgttcctggagatttgctgtcgcatctgcctagtgtttctgagactttttacagctcttaatccttcaggtgtcagcttaactatcttatcgtcaggcaaagatttgttgttacttttttttttttttgagacagtctctcactctgcctctcactgaggctgaggctgaattgctcactttaacctctgcttctcaggttcaagtgattctcctgcctcagcctcccaagtaggtgggaaagcaggtatgtgccaccatgcctggctaatttttgtatttttagtagaggcagggttttgccatgttggccaggctggtcttgaactcctggcctcaagcaatctgcctgccacagcctcccaaagtgctgggattacaggccaggcaaagcttttgtaaccacctaaagcacagccttctcccttgcccttctcgatgttactccctatcacagtagttttcaaaatgtggtcctgaaaccaacagcatcaggaacatctgggaacttgttaggaatgcaagttctcaggccccaccctagacctgctgaatcagaaactctggggtgtggcaaatccatgtgtattagcgagcccttcaggtgattctgatacaggctaaagtttgcgcagttctatggcagtatcctgtttatttcctacatgtttatcgtaaactataatcgtttcttcttattatttaatgcatttagcttttctcactagatttgcaagcactgtaaggatcagcaatcattgttgaggtacaagacaatatctgaggctgattaatatttgctgaatgaatgaatgacacggaacatatcttggaaaatactgctttacataggatctatattagcttatggctaaacttcaattgccgtgaaccaccttaccaatatttctttccattcatttattcaacatttattgacatttgtaatatgctaggcactatcccaaatgctataaatacaaacacgagcaagtccttgttctgaaagaacttatagacaagtgagataaaaacaggtaaatacacaattattttattctgataagtgttattataaggcctagaaaaacctaccaaaagcattaaaaatacacatgtacttgtctttgacctagttattctagttctaaaaattaattctaaaaaaaacccagggatgcatacacagatttatcaaaacgatgtttgtcagcattatttatactagcaaaaaaaatcagaaataacctaaatgtaaaagaatggagaatttggctgggtgtagtggctcatgcctgtaatcctagcattttgggaggccgaggcaggcagatcacttgaggtcagcagttcgagaccagcctggccaacactgtgaaaccccgtctctactaaaaatacaaaaattagccagacttggtagtgcacacctgtaatcctagatactcgggagaggctgaggcaggagaatcatttgaaccaggcaggcggaggttgcagtaagccaagatcacaccactgcactccagagtgggtgacagagtgagattccgtctcaaaaaaaaaaaaaaaaaaaaaaaaagaatgaagaattcaaaaattatcctagacataggccagaacactaaaaaattattgcaattaaaaagaatccttaatgatgtgaaattgttcacaatatactactaagtaagaaactatataatatagtttttaattctatataaaaataaatgtattgggaaaatgtattaaaaatgttaacagaaattactaggtgttatgataacaggtaatttaacgtttctacttttatgcttctctttatttccaaatgttttgcaatgcactatgatactaagagaaaaatgttaagggcaacaagtcagagttgagggagcaagtaaatctgctatgtgggttgggaggtatcatcacacaggaggtgtcgtctgagttgggacttgagaatgcatgggagctgttatcaggaagagttgtcagtaaagcaggattcagggaagtgctgagtgcctttgggggccaagaaatagctcaatgaggctcaagcagttgcagaggggatttgcagctctccaccaaatttagtttacagagaacaacctatttactttctcaaaagaaaacaaagtttcatatggacagtgacattcttttttaataaaaatcagaatttacctatgcatgatgggccatccatgctctaccaggcgcattttgaaaagccacagacagctttcctgctgcataaagaataatacaaataaatagaaattataacgtttcactttggctgattatgagataacatcagatgggagaaggaggaggatatatctttatatcttagacccaaagctcccagtgccagaattctagaagcaggcctaatcccatggtctggctctcatcagtggccaagaagactgaatgagcagtgaaatacctctttgatgcttgttcatcactcagcaccagcacagaaatttcaaaggccatgttaagtgacttgacaatctggagacagatgataaagtctcagcttctgatcactaaacacaataaatcccttgcgaacaggtgctactaattttttttaaaaagatccatcttgtgctgtcagtcattttcagatcaactacaagtgagcctgttgacctgaggtatactcagattgggctaaaattcagtaaaatatgagttttgagaagggtacatgtgatttaaatagatgggattgccccagagatgccttccataagagttacaaactcaagtgtcaatagagcagtggcagatgatgagctgtctaccaatatcagtcctgcccttcttgaacaataagaaagttttagctgggcacatgattaggtagaacatttgctagcttctcttgctatgacagacatgtgagaaactctccaaacaatttttctatttttcttcggtatatagctaatctgtgtttcccaatcccctactgcagttaaaagagggcatgtgactaatttctagccaatgcaatgtgggtggggatgagatacccaatatcctggcccataaaaagtattccatgctcttttcacttgcaggagaagagaaaggaatccacaaacctagaggagatcagaatgtgtgtaccttcagagatacaaattctatttcaaaaaagccaccttactgaaacacttgcacatgtacacagagaatcattttcatgggtgttcgttgcagcattgcttatactagcagaaaattggaaacaacctgaattacatctacaggaaaatggtaaagcaaattctggaatatccatactaaaaaacataatgcaacctttaaaaaggttctatatgggctatcatggaaagatctccaagacctattgctgatcataaaagcaagctgcaggataatttatcccctaaaacagcaaacatttatagatgatttatatgtcaggtactgtttagggagtggggataaagtagtgaaccacagacaaaaatccttgcctatataaaacttatgagcacgtagaatgtatattttaacatcctaaaattatatattagttaataacttgtgcatatatatatatatatatatatatatatatatatatatatatatatatacttatttctaaatacagagagaagatccagaatgagacccaccaaattgttcatggtggtaatctctagagaggggagtggggtcaaagaggggataacaacttctttgtctatattcttctgtgtttccatgtttataggaatgcatttgtgaatttgaattctttttagtggaatgcattccactaatgcaaccaaaaaaactgctcttcaggggcctagccatggaactcctcaagggccaccaccatagaaggatgaacaatgtgtccattttcctcaactggtgtcttcatctgctttatttatttatgcccataagtgaggtttcttttgatcaaaggtttctgtggccacaaacgtttaagaacagccaacattgctcataatcagaaaattaaaatacacaaaggaatatggatagaaatctcacttgggcataacactagactaatcccatatcatttaagggttttgattgtctagctcttttgttactaaggctcctctgcctgtaaaggacaagacttaagcttttcagatgtcaaatagcactcaataaacatcacaaatgagttctgatgtggaaaatgcattctcaaatagaagagtttttgttttattttaaaattgtgttagcacctaaaagacccctgtaatagtgaagataaagttaatccagtaatgcatttaccatagtaaacctccagaacagaaacacattacttccctctgatggaattttaaatcagcgtaagggattaaacagtattatccagctgatggagagcaacttggaaattatgggaaatggccatactgcacagccgtttgcattccaggaattccgtttggaccttccatgattaatatgtctgatataattctggggagctggtgtcttttctcctttgactttttcatttcatcttttcaaaaggcttgcacaaagcagagccaggcttcatgctcttctttcagactgtggtttattatgatctagatttgaattaaagcagtggaaatggcctcacaattctacaactccacttttagtatttggttgaaacagaatgcattctccattgtattagcacatgcacaaaataatgaattatggcctatctacaaaaataaacattgtctgacagattatagggtgagtggattggatgatacagagcctgaaggtaatcaaagttcattccttcttttgccaccttccctttcagcttgctttcctgagcagcagggtttgagaattctctttttttctgcatgtttaaattaaggcacaactcaacagctatttcagataaaatagtctcccaatttatccatcttttcctgaaatatttttaccgtagaggccaattttaattgccatgagttttttgtttaatgtgaattatttatataattaatctgtttttcttagcacttattgacagcctaccttcacagaccatctcttctcccaaatacctcatccttgtttctcctatctgtaaacattcccactgcaacccgtcgtaataggtaatgtcagccacagaaggaaataaaatatcttagtatccataagcaaaacaagagagaaaactgtatattttgtaggcttggtgaattctgtggacttataagccttggactaatcctaatcaaaattaaatctttctttgattttcctggatactctaacttgatgaatgacttaactgctttgtgttttagttttctgaaaattgataggataagatgataatacctaactcatggggttaagagttgagtgagatgatataggaagctatttcacatataatgcctggcatgtggaaagcatttagtaaatgggagctgttattgctgtcattattatcatcactatcagcaatgtgtttttgtcttaaactgaccaaaaaataataaagtctgagaaccaggaccaaatgtcagaaaggttcttggatccagattttagtaaaaatcaaggaaaacctctctaatgatgagagagacaaaaataaagtggggggttgtatactaacattattactgagtttacagaaaaaaaaaatggatgtaagagaatattataaggctgggtgtggtgactcatgcctataatcccagcactttgggaggccaaggtgggcggatcacctgaggtctggagttcgagaccagcctggccaacacggcaaaaccccgtctctactaaaagtacaaaaattagctgggcgtggtggtgcatgccagtagccccagctacttgggaggctgaggcaggataatcgcttgagcctgggagatagaggctgcagtgagctgagatcatgccactgcactccagcctgggagatagagcaagactctgtctcaaaaaaaaaaaaaaaagaaaagagagagaatattatgaataactgtatgccaacaaattgggtaacctagattaactggacaaattcctagaaacacagacattaccaaaactgacttaaggagaaatagaaaatccaagtagacctgtatcaagcaaggaaatgaaatcagtaattagaaatcttccagagaaaagcccaagactagatgtcttcacaggtgaattctaaacatttaaagaagaattaacaccaatccttctcaaactctttcaaaaaaacgaaaacaaaaacacagaaacaaaaacactttcttaattactttatgagaccagcattactttgatactaaagtcagacagacaacacaagcaaagaaaactataaactaacacattttatgaataccgatgtaaaaattctcaacaaaatactaggaaaccaagctcaacagcatattgaaaggattatacaccctgagcaagtgaaatttatcccaggattgcaaaagtggtaaaatgtatgaaaatcaatgagtgtaatataccacattaatagaataaaggaaaaaactatgtgattgtctcaattgacaaagaaaaagcatttgacaaaatctaacaaatatcctttcatgataaaaccctcaatacattagaaatagaagggaacatcctcaatttgataaaagccatgtagcccctaagattaggaacaagacaaagatgtctgcttttatcacttatattcaacaaagatgcctgcttttatcacttatattcaacataatactgaaagacctagccagagcaattaggcaggaaaaataaataaaaggcacctaaattagaaaggaagaagtaaaactatcttcgcctgcagatgatatgatcttacatttaaaaaccttaagaacacaaacacacacacgcaaatctgtcatagctaataaaatgaattcagcaaagttgcagaatacaaatcaacaacaaaagaagttgtatttttatgaactggcaatgaacactctgagaaggaagtttataaaaacgctgtttacaatagcataaaaaataataaaatgcttaggaataaatttaactaaggaggtacaagacttgtacactgaaaactacaaaacattgcttaaagaaatgcaagacaaaaataaatggaaacacattcagtgttcatggatgggaagacttaatactgttaagatgataatgctgccccaatgtggtatatctgttcaaagtgacacacagattcaatgcgatccctatcaaaatcctaatggtgtttcttgaagaaatgtgaaaactgattctaaaattcatatggaatttcagaggaccaagaatacaagaatagtcaattcatcttgaaaaagaataaagttggagaactcacatttcctaatttcaaaacttacttactgcaaagctatattaatcaaaatgatgtggtacagggataacaacggttttatataacaatatagaattgagagcccagaaataaaccatcatctctatggtcaaatgattttctacaagggtgtcaagaccattcattgaggaaagaatactctcctcaacaaatggtgctaggaaaaaaccagacatccacattcaaaagaatgaagttgggccctacccaaatatgaacaagaaattaactcaaaataaactacaaacttcaatttaagagctgaaactataaaactgttgcaagaaaatataatggcaaatgtgtattatgtcagacttggcaatagttttaatatgacaccaaaagcacaggtaacaataacaaaaatatataaaattggacttcaccgaaataaaaatttctgtatatcaaaagacactatcaagagagtgaaaatacaacccacagaataggaaaaaaatttgcaaatcatacatttggtaaggttttaatatccagagtaaaaaaataactcttataactcagcaacaaaaagacaaacaacccaaataaaaaatgggcaaaggaattgaatacatgttttcttataaaagatatacaaatggccaatatgtacatgaaaagatgctcaacattattaattattaggaaaatgcaaaaaataccacactaagatactacttcacatctactaagatggctataatttttaaaaaggaaaataagtattgtcaaggatgtggaaaaattggaatccccacacattgctggaggaatgtaaaataatgcagcttccatcctcaaaaagttatacacagagttaggatatggcccagcaattccactcctaggcatgcaccccaaataattgaaaacagtgactcaaatagatacttatataccaatgttcatgcagcattattcacaataaccaaaaggtagaaacacctaagtgctcatcaacagaagaacgaataaataaaatgtggcgcatatgtaaatgaaatattatccagccataaaaaggaatgaagttctaatacatggtaaacatggatgaacctcaaaaacattctaagtgaatgaagttacacacaaaaagacaattattgtatgattctacttgaatgaaatatctagaataggcaaactcatagagatagaatatatagtagaggttaccagagactacggaaagggagaaatgagaagttatcacttaatgggtgcagtttctgtttggggtaatgagtatttttggaaataatagtgataattgcacaacactgtgaatgtaattaacgccactaaatatgcacttaaaagtggttaaaatggtaaattttatgttatatatattttaccacagtaaaaaggtaaattaagaagtctattataaacatcattgttggtatttgtaatggcaccatactatgacatatacaaaaccattcagtttttctatgcacaattgagaaaaggaaaagtggcccttataaactggaacttaaacatatttttggccagatagctggaacaggcaaaatgtaattggttaaattgtttgtatcagttctacctaaacatattaatccatgtctataaatgtttaaaaagatgaatgcactgttacgagggagtaaaattcccagcactgaagatactaataaaaaattgtatggtagcccagcagggaaattgtagaaggaatttatacacatggcaggatgttagacaagatgagggtctcaaaggccttccactttttaagagtttaaagttctatgagaattgtgtacaactagaaactttcccaaggttaaataattttcctttttccagaggcaatggaaaatggcaatttgggttccggcattcctgataaaaatttactgtttttgtctggtgatgtctctactgaaaatattctttgctataaatctcttgcctgaaatttccatagagcttatcaggtttcataaagcagatcaccttaaaatggcttttaaaaattcagagtggaacagattcctctatgaaattgtaatatggaaaataaagttctcctaaccctaattgtcttcacaaaagtgtttccaaggagaacacccagggatatgacataagtagcaaggccataataaagatgtgagtgtaatttccacacatgctgtcaacctcaaatatgcagcctactcagaggcaatttgggtaaaaattgtcatagctattgccagtgttgtcacttcttgattttttcatcctagggactgtgtcttattcattcttggtctcactgatggtgccacagtaccatctttcaggcattcagtcaaagtctcctgagttgaattttcactcttcctagatttcctttgttatcatgagtttttgataacaaaggggattgtgaagagaggagatgggtcagtgactcaaatttataaagcaggggtaaatgacacagtcatcagaatacataactgggccacagaaggcacatttaagtaacaatttggaaaactcagaatctaatcaacacatctgtgctttatattctctacctgctgtcttgcctaaaatgaagatgcttaaatccccattagtggggcagggctgcccatctatggaaaaacagagccggactccaatctgctttgtgtgtcttcagaacagctgccagctgatcagaaaacatttaatgtgggggatccagtgtggggcaggacgaacacagctggttgacacagcaagcagttagaaacaacaacaacaaaaatgccatttgattcgtgggctgagccaatccatctgggaaatctctcaaagaaagtagctggaaatgacatttcagctctgattttcctagtcaagtctgcaccttaagccaaagactcaaaaatagcactccatctagatggtgtaaatacagtgacacttgagtctcttcactttggtcttttaagagtgattttaactctttcagagataacatgggagactgaaggggctggatgctggaaacgagactgtccacatcttgtttccagaaaacggattactctgctggcggttgattcttggatttcctatcataagatctgaaccctgggcctgatgtacagtgaggcgtgcgattggcatttgcagaagccttgacatcccacactgcagttcatgattggtgtcagacaaagaagcatattaaatgactgccggcccggtgataaggccggttattaccgaggtgtagtttccccaggtctaaagactcatagtggtaccactgaagcatgctggggagaagataaaatttaattaataatttccttagaggccaacagtctattacaactatgttccttgctgttctctgcaatgaccttatagctcataaacattatagatgcatgcttggtcatagtctcatccccgggtttaatttatggctcaggttgcactgtataattagctagtctgaaatgaaggttttcagatgctgaaaacatttaaaatagactctgcataaggtagggtgtgcctccctcccttctgttcagtttaatgcctgtaatacatagtataatttcctggattaataatacacatatgatgaagctggggatgaaggtgaagtctgcttttgagttacatataggggacgaattttggtttatgttagatttggagattctggacactaaattaggtagctttttctgtattccatagagtagctcaaactaagtgtttttagaaacacaaaattgcaaaacaatgatgtaacgtggggttaaatttttctccactacagtaaaacacttgtctctttgtatgtgactacaatttattttggacctattatgtggccaacactttgtagagctgtggtagaaacaaacaaacaaaaagcctcaattatctctgggattagtgcctcaaaatcagagaagtagtacatgtttaataaatatctgttgactgcatgagtcaatgaattgattgtgggatattttatacattaaattattttttaaaatgggcaatgtttatatggtcagaaaagtaataataaagtagattaaaaatgatagttgctatcttcctaaaattgagaaccaatgtttgctgaatgcctccatccaggccctgcggtacgaggaatacagagaatacagcagtgaatactgattcagactttaaaggctgactgtccgatagcaaaaatgactccctcaacttgccagagtcaagcccaaactctaagtattacattttctacaattatctttggcatattcccctttccagcctatgctatatccaaattagatggcctttgttctagtgcctggctagaatagagtctgaaatacctgttgaatatataacataaaaagaaaactaatcactaggaatccctgtgctgtttgctgttggtgacccctctagttagatattcttcctcagttgctagtccatgagtccatgacaattctctctgcctgttcttcaagatctacttcaaacaccatctagaatatagaagtgcattgttggtatttgtgtcatttgatcactcagtcactcatttgtatatatctcacacctctttctaaaatggctaaggcatcacatgatagaactgcatagaagtagaagaatatctatgctttgtaaagatacagttttcagtgccaaagcaagccactttattccaattctcatccacatttcagatgatgatgatgatattagttaatacagttaacactattgacagagcatttattatttgctctggactatgttaacttcttcctatataattatttcacttacatacataatgccaccatgatatatatatatatatatatatatatatatatatatatatatataaaattattctcatgatataagtgaagaaactaaaacagacacactaagtaaacctgccccaaatcacatcataacagtagtgtgagtatatcaacccaggtctaagtctaaatctttgctcttagccactacattatcctgcctctctcataattctcagctaatgacaaacagatgtgaaagtgtgtatattgaactgtatccttgaagaaggcaacttgaatattccatttgcctgtctgatgccaactacccaaatttgtgtagtcactcgaccacctggatatttagtttacgttaacacaaaaatctggatatttgaaaaactgtggtgctcaagcaagcatttcaaatctcatctaaattcctagcttcatataatactcaggcaaggcatttttcatgaaaacagaacataagagatctgagccaagaaaaaaaaaaaagagacaaaattttagacaaaaagtatgtattgcttaatcaataccagttaaaaaaatgaattttcctgtagcccaccaccacatttcacagaatcatagttgtcccaatgtgatactttatgaaaacagtatatttcaggatattacaaccagactaaatccaactgaaagtcaaataaaggaagaaagacgctaggaatgaaataaattttggatcaatccagattcatcaccaactgatatgattgggatctgtgtcaccaccaaatctcatgttgaattgcaatccgtaaagttggaggtggggcctggtgagaggtgataggatcatgggggcagtttctgttgaatggtttaacaccatttcccttggtactgttgtcacgataataagctcttttgagatctggttgtttgaaagtgtgtagcacctcccccacccatgctccagcgatttgaatactggctccccctttgccctccaccatgactgcaagtttcctgaggcctccccaggagctgaggagatgctagcatcacgcttcctgtacaggctgcagaactgtgagccagttaaacctcatttgtttataaattacccagtctcaggtatttatttatagcaatgcaggaacgatctattacattatccattgtcataattgaaccagaactctcctatagctattgaggatcttaacatgttgtttcaaataaaaataaagacaccattctgaaccaactttacatttagaatatgccagtttctatattaatccaggaaactcagcatctaagtttcccctaaagcatctgttcctggggtgtacccacaaatttataaagttataaagcccaaagagatggcccacatgaattcacttcagcctgagtgatgactacctgattcctccagttattagcaaatttttctgtttgctctctcttgatttttaattcttgcacaagtcacatcatacattgcaaaagatataatattcttcaaacctaatacctcagtactcaatagttgtttttttccttgcccatttttttttaaagagttgatccatagtttttcaagctatgcttcatgtatggtgaccaccttggtttctgtacttttcttggttatttcaatatgtaaaatgcttgaacttaattgaagggtgagagagagaagggagaggaaacagaagaaagaaggaaaaagaaagaagagaggagagacagagagaaacagagggggaaggaagggaggcagaaaaggagagagagaaagaaaggggaatgtggctagaaatgtggatacaaaagtgtcatagaatcgatatggaaaaaaaatcctttaacctgctatcacatatactggctcaaattctgcttttagtgaatttcccccaaatatgaaaaagtaagtaggtataggaagagtttttaagaatattgaaaaactaaaaaccataaaatgtctgagaataaaggataggttaaacaaattaagattaatgtcatgggctttataaactactgaaaatcacatgatataagagtatttgatgacatatttgtgatctattcctaatacagaagcatgcatggtcatagtctcatccccaggtttaatttatggcccaggttacactgcataatcagctggactaaaatgaagattttcagatgctgtgaacattacaaattctgcataagttacagtgtggtatagcataagccctgatttcatttaaaagatatatgcattgaataaagagataataatttccacaaaaatgctcataaaacctacctttgggtgctttaagcatctgtctggacccgtcattttctctttagttgattaaatagcataagcaatttaaaatttttctacttatgctttttccattttccaaagtccatacaacttttataatcagttaaacatcatgctattttaaaaaataattaatgtcagaggctgtaaatttttttaagacactcctctaacacaaagcacccaaaaggaacttcttggaggtggatgcttgtctttgcaatggtcaacagatacaagattgcagacaacgcatttgtaagtctctggcagatgttatgagaatttcccatgaaccagaaatgaagcctctgaggaacaaggacctgaatcactaaatatcaattccatcccagagcactgcagaaattttgctactgtctgatcgggggataggaagagcaagaaggctgtgcttctgcctcggagaatgatgttattaacttatcacattagaatatcaaggaagatcagagtatgtatatatctttgtgtgtgtacctgtctatatgagcttagcacgtaattcccagacctacaaaacttggcacacaaaggaagcagaagcaccgaaatagtgaaggattgactggagtaccccaaaatcttatgcaataaaaagaacctcagctggttaacattttaccctttctctctttaattgtgaataataacattgaatgtttcagcctatttttccccaaaatggtctccaacttctagttttttctgtaaatagcatgcatgatatgcagaagttttctcaataaacagctatagaaacaaaacaaaacaaaaatttagtcacaactaaaagtgtgagaagaggacagcctcagtcctctaaatgactggattggattcttacatatttaaaaaataaatgtagccattattttaaagtcaaggatgtttccatattacctacaaaatagatgtgatgaagaaatatattggcacttataacactgatgggaaaattgattcaacacaacattccttgggattattagatatttttaccccactacaatcttatttatcctattcacaccttcagtaaatatcataccttctcgtaatagtaaatcagaatgaatatcaattagaactggaattctaaatatatacaatctgtaatgtatataatatatacagtctgtaggttgctcttaaatatactattaaaagtgctagttcaagttggtaaacatatcaatacaatttctttttgtgtggctctcagctcttcagaaggatgactgccgtgttgattttaaaacattgtccatttttctagttaaataaatatttccacatcagaaaagaaggttctattatgttaactttacagaatatcagtttcctggtgagttcagaatcagacatacttgacttgtcagaatcatgaaattgtaggattagacatacgtaagttagataccaatttacaaaggaataaaatagatggagtatcaacttttggaatatatgattgcgaagaaaaaagcaaacagaaaataagagtcacccaagagtgcatcacacccatggagaataaagtacaatcgtagcactccattttacttagcaataaataaaaagtaaattgtttaaatattatttattgcttttcaactttatgagataactcattgaataaaccctcaaccttaatagtggttacaaaagagaatataaacacaatcaaccctgatgatataaaaggagaagagtatagaaaaggaggaaggaagtgggagctaactttctcatctgacacagtgggaagtcaagataaaatagctggccaggcaccgtgtctcatgcctgtaacccaagcactctaggaggccgaggcaggcagattgcttgagcccaggagctcaagaccagcttgggcaacatagtgaaacgctgtctctacaaaaaaatacaaaaattagctgggcatggtagtgcacacctgtaatccctggtacttgggaggctgaggtaggaggatcacttgagaccaggaggtggaggctacagtgagctttgattgtaccactgcactccagcctgggcaacagagtgagaccctgtctcaaaaacaaacaaacaaaaaacaaaaacaacttaatagcttaagttggtgaaacaagaaatagaagtttcatggtgacatttaaacttacaaaggcaagcaacggaactaaaataataactagcaaaaatcagaatggagtaatttttaaaaagtcagataagttttggaagtaaatccttatttttcacagttgaggagttaatagaaatatattaaatgtatatatcaagaaatagtgatatatgcatgttctcactgatacatgggagctaaaaaagttgatctcatggaggtagatagtagagtggcagttgccagtggttgggaagggcataggggaggggagaataaagagaagtagattaatgagtacaaaaatatagtcagatagaagaaataagttctagtgttcgatagcacagtagggtgactacagttatcaataatttgttatatatttaaaaatagctaagagagaagatttggtatcttctcaacatgaaggaataataaaatctttgaggtgatggatatcccaagttaccctgatatgacgattacacattgtatgcatgtatcaaaatatcacatgtaccccataaatatgaacaattactatatatcaataaaactataataaatggaaggaaaaaaagaatcactcaagatatgtagaatactattgagaaggactcatttcaaaggtcatttctgagctttaggataactctagacactgtcccccaccccacttttctgtgatacacacatcaggaaacactactttaaatgcattatcatggttcacccaggttgccaagtgaagcgctcctggagacagtcagccaggtgccaattatgaagttggcaccttcctgattatcccacatcctgataaggaagacagatgctgccacttcctgaaacccctggctgtacccacctgggcctcctgacaaccaccaactatcactgaagtgctgttcatgggggccaggttacttccagacaatttaagatatttacattgccctctgctttctccgagctcttaatttataactcctttctgtttgtgtataaacccttttagtcctttgcccatattaatccttcttggtatcatttggaaagagatgatattggtttgattctctctggctctccccacctcccaaactggtagggaaaaaaatgaagacacatttgggtatgatgtaatctagcaagttcctttttattacagatcaatctttagagaaagatgaagttgcctgaaagcaataaaaaggtgaggcctgtaaaattttctttaattcaatcatctcaggaagcttttctttataacgaagctaacaacaactcttgttatctatgcttataataattccagtcaaatgcataaggctttagggtttatcttgttcatttttcataataaatccctattttacagataaaaaactgaagcatagagaggttaaggattttcctatggccatgtggatctttagtagcagatgtgggattttaactttagatttgtcaaaaatcaaacacacacacaaaaatagtgcttacaactgccctattattttccttgccatggcctttgttgagggttgcaaactcagatgccaggcagataatctccatgaggggagcaggctggaagggaaatatggcaacctggaatactcctacatgatctacagggtgatcactattggccaactccagctaactgtggtcatgaaggttgtatgtacacactgtggccacaggatcagatttgtcaagggaagatagacgcatagatttttttaacatttaaaaattgtatgtttttcaaatgttggcagctcatttaaaatattttaactggctgaacaaaagccttctgtagggagagttcagatcttgggccaccagagctcttccttcctttcctctcttttctcttctctcctctcctctcttttctcctcccctctcgcctctcccctctcccttctctcttgtcttctctttcttcttgagatggagtctcactgtgtcacccaggctggagtgcaatggggtgatctcagctcactgcaaccttcacctcccagattgaagtgattatcttgcctcagcctcctgagtacctgggactacaggcgcacaccactatgcctggctaagttttgtatttttagtaaagatggggtttcaccatgttggtcaggctagtctcgaactcctgacctcaggtgatccacccacctcggactcccaaagtgctgggattacaggcgtgagccaccatgtccagcctattctttctttctttaggctcaaatcttaacaggtgtgataataacatgctgcttcaatgaaacactgcatctttggcttttaaatttctctgtctctctactatagttaaggagttgagtgacaaactgtctttctcatgtctgctttcggaggcaaagtcaaaactgagcaggcttggtggaagcctgattttccagctggaaatgagaatccctccctctgcctcctccatgccgttgtgtgagcatttgcgcaagttgcctccagttttctcatgtggttcggatatatagtgtcttctactgagtctagctatattttgtcttggaggaggaagaaaaataaatccatattagactccaaaaaatatagcttggcttcaatctcctctgcccaaattttggggataatggtaaattccacactcaccagccacattttttttttctttagcacaccctggtttaaagaaaaaaaaaaagggaacagtaacctccaaagtagggaggtttaggttggacagagcaacctacaatcttaacattaagtaatttggaaaattactttaaaaatctacggtggggctgggcacagtggctcacgcctcccagcacgtttgggaggccgaggtgggcagaccacctgaggccaggagttcaagaccagcccagccaacaagacgaaaccccgtcgctactgaaaatacaaatattagccaggcgtggtggcacatgcctgtaatcccagctacttgggaggctgaggcaagagaatcccttgaacccaggaggcagatgttgcagtggtccgagatcgtgcatcattgcatttcagcctgggtgacagagaaaggctctatctcaacaacacaacaacaaaaattatggtgaagggtactctttaaatataatcctttgggttacacttaaacactctgcaacaacagaaacaaaactctctgccttggggttttgactcacacagacctctaaattcattcatccctctcagtttcttccagagaccttagcatcagcaaatcaatcttgctcactgttgtaccccagcacctggcacaaacattggtaaatatttgttgaataaatgaataaaatgaaaaaagggctcagatcagttgggaccaagataacatctatgcagtgatttattcattcaaatatgttggaatgaactcaggtccctaaggagcgtgctccaggaacaaaaggtggccactgttgagatcactgtgaggcttttgttttgctctgtagggtggaatccgagggcaacagctgattgtgtcttgacaaaagagtaggaaggaggatttctgagtgaatatgtgggtggaaaggcaagagaaaatagccaaaaacttggggggcaaatgggtaagacttggaaaagaaaaaagatgttgggtatgtgacataaccctttcagtctctccataaaactttcagtaacatgttcactatcatcaatgattttagaatcgagtaacatggtcagtattaataatatagctatcacacatgcttaacatagagaagcaaatataaatacaaaaatacaacaaaatctctggagcagtctcaggtgaaacagccaaagaaataaaaccttatacttcaacatgaaaatcactcaaaggtacttggaaaacactgttgatttacgcaaagacatttactgagcatttactatgggcctggtgatgttatggcaaacgagacagtcacgggcatggtccctgccctcaaggagagagaggcaatacatctaagaaataggactgtatcagtgatgggggctctgaagggaataaagaggaggtggtataagataatgataatggattggatttaatattaaataggtggtcagggctgacctctctgaggagtgacaactgagcctaaatgtgaaggataaaaagaggccagacataagaatgtctgtggataaacctttccaagaagaaaaaagagagatgtgcaaatggccggatgtagcagatggtcaggcaggcaggggccagatcagggagacagagaacataactaggtctgcaaggataatgggtagaggggcaaagtctcagggaagttgactgaaatgcagaggtaaaatgtaatcacaacacaagggccttgacatgccccatctctgggggaaatgttctcaaacactagccctccagggggcaggaaataatgtagtctagttaattgcccttcgggactgctctgtgtatgaatgtaaaactagggattatccagccccagatgcaaatgaaaagggcacagtgggtcactggttttcctgaagactcttctcacttgagatagaagtgaaaatgccaattaccctcatttctgtggaagggaactgggagaggagaaacaccagagaattgtgcttccgattggcttgaaaatcataacaaccaccccaaaattaagagaacaggaaaaaagccctttgctcttgggaccttaagtgattagaaagagttgttatttggctgattttcacacttcattagcatatgcatgatttaatgagggaacatgctggggggttggcacgggtgagggcagctctttctacccacagactagaaactggggcagtagcattgggagcgcttaattacgccagcaaggcaacagagatcagtgcacaaagggggatgagcatatgatggggacttggaacaagtacagaaagataccccaatgtctgtcttcacctctgagcacacctgcactgagccataaggcagcattgcctaatatccctcccaaggataaatccacctgtgataaacctcacactctccttctcttgcctcagacacctagattttcttctctgaaaatcctacaatggcaggaagagtgaagcattatattatgattgtccacattccatttagcattgaagagaggaggaagaaagtgggacagtgttttggggacagaataaaatgaactcttgaggaacagtcagaccttcacattttgattctgaactatactagagtagatacacaagtggagcagaaaggacaaaagtcacaacgaatgctgcaaatcggtcaatgtttaggctttctttttctccattcaaaacaccccaaaggaagatgaaaaagaagaaaaggcaaagagagactacctgcaaaggaaggactcaactatgcccagtcacctatcttttaggacctgtttctcttcttgtgtcctttggaaggacatatatataacacaaaaagtaaggagtagaatggtgcgggtctttttgaaaagtggcagggaattttacaactgtcacaccatatcttacattagcaccacgttcaatgtcatgtaactatcatactgctatatcttagtccattggtctattctgagatattttgccaatctttttctgcttcttataactcttcagtgtcgatcccccctttttctattaagaaaatattatttttcatttttcagcccaatctgctgtgtgtatgtgtgtgtggtgtgtgcacgtgtgcgtgtgcgtctgtacagcttacaggtctgagctaatcggcatattccctgcccctggcaacagtgattggttcaggcattaaaaaaaaatccaacttggaccaatgagagttaggtccagattttcactgctacattgagaagattccaacatattacttttactctcttcacactcactcctcaaagctctccaaacatgtcaaacattttcatacctctgtgcttttgcagatgctattccacttcttgaatgaatgaagaaatccatcagttcttccatatgttattttggcttgaatccccaaaccttatgctaccatatttaatttaataagcacacactcactactatttattataccagaccactggctgtctcccagcaacccattcttttcttcttctgccaataatcccctgactttcccttttcttatcctcaagtaaaatttgagaggtgctgattcctcccgccacatgagagtgaggccctaattggcctaattcatcaggtattccatcttactgaatatagggaatagatttagggataagcacagaatccaaacagagctaatgagatgttaggagatgtttcctaaggatttaaggagatgtggaaccctgcactatggcagacaattttctaccacaaagaggctggaacagctgctgggtctacatagaaagcagaggacagagactattgaacccgggtaacatagctaggctctagatcaagccttactcaaaactagtgttctttagatcttttaaggtgtgtgtgcctaatttttgattaagcaaacttttagtaggattttttagcctgtttaaccaaaaaattactggccaatacagtgacaaaatgttaaatagttcaagagcccagccaaaaacctgtgggaaattataaactatcttctgagtcaatgccacattgttcatgcattcatccattcaacatgtagttgaccaccacttactatatgccaagtactgtcctaggatgttgggggtataacaatgaacaaaacaaacaagtgtccttttggaacacagattctggtggagggagatatgtaacaaacaataaataagtaaggtatgtagtatgttagaaggtgactatgggaaagcagaataggttaatgcagatcagaaagactaaaggtgcaaggggacttcaatttcaaataggtactcaagaaaggcttcattgaaaaggcaacacttaaagccttgaagaagtaaggaaattggctatgcagatgtctggaagaagagcagcccaggtagaagaaactgccaatgttaaggccttccagactggggagttcaagcagcagcaagaaggctacgggacaggcagaaagcagtaggaagtgaggttagagaataaaccgaaggacagatgatgtagggtcttgcaggccatcataagggcccttttttacactgggtgaggtggggagtcattgaaagattttgaacagaagagtgacatgatctgacctaattttttataggaatcaatatggctactgtgtggagaagagatttgggggtcagtggtaaaagtggaagcagggaactgctacaacaaagtatgttagatacttgcttgcatcagcacggtagcagtggaagtgatgaaaaaagattagattctgggtagattttaaaaatagagccaatatgattttctgatgcattgcatgtggagtgtgaataaagaatgactgcaaggtttttggcctgaagaactagaaggatgaagttgttatcaactgaggaagggacagttgtaggtgaaaaaggtttgttcaggagatgatcagaagttcagtcggaaatattaagtctgcgatattttattagacatccaaatagaaattttgaagcagcagttgcataagaaaatatggaattcaggactggactaaaaacatgaatttgggagttgctgacatatagatactatttcaagtcacaagagtagatgaaataataaagggagaattgtacataacagtggatccaagtactaattcatttaagtcacttatttaatccctataaccttgttaagtcagttatttttatcctaattttataattaaggaaatcgaggctcatggatattaagatcacacaacagcttggccaagagcatatatgctcacctgtgtataaagacataaatagctgagctgggactgaaacccaggcagtctgactctagagtctgtgttcctgtcacccaatattgctgcctattcccaagtggaatttttaaatcagctgatacatgtttagggttagaaataacgagaatataaaggacctaagtgtgggcaacagagccaaaagaattcagttccctgtctctagggttatactgagctgcaactacaatgctgagacaaaggtaagggctgaggtatctaaacacagggagaccagtttgctcagtggtccccacacttagtcaaattcactagatgcagctttctaggtgaccatgcctagacattgattcagtagatattgagtagagctcagaaatttcattttgacacatatctcaggaaattctgaacactttttgagaaatgctattatagaaaatagacttagtttgactctgtccaataactctccattcccaaagaccaataaaactggcctttatcttaacttcacaagtaggattgtgactgaagaaagatatctgtacatggctaatgactacagcttagcttgaaaaaatagtttgatactctttatgaaggtcttcagtcttcttttgtcaatcataatcaatttcctacttgaactgaaattgatcttttatttagtcatgttagtaaataaaataaccttgaactttgcagagcaaatggtaggtttgcactaattactcattaaaagtgtgtgagaaatttacatctttcatttgtcagtggagacccaagcttattcagataactttacctaatgatagttgcaatcaaagtgtaatagcttttaacttatgctaacaagtgactgtacttacaataaactgccacagcagagctataaataaaatgggttgctatgaatgcccacttcctttttagttctgactaaatagacaagtacagagcttctcagaaatgcgcatataactccaataattctacagttgagtaagcccagaaaaacatggaaaaaagagctgatatttgcttgaatcaaaggtaactgcacaaatgatttccttcaataccaaatgccattaccaactgtttgcacatcctattgctttatgtttttacttagggttttgaaaacagcccttatgaattgtctctattttagtgatatgactaatcatattaatatggtgcagttttattttaagaatttttccagaaccactgactcatccaatttattggttccactgggaggcaatcaaatgggactggactaatttctaaaacaggaaaatcaagacaatgaatagtggtgtcttcctcctgccccctattttttttgtgcaaaatgaaaatatgggggcaaaggagaaataatttcttaatcacattatattaaatacttacatagtaatttagtgtagtgattaagaaaatgggttcttagttgcaatggtcataagcaggttatcagtttctttatctataaaatggggctggtgaaagtacccacctcataaggactgttaaggagattagataggctcccacttctgactatatatccaaaggaaataaaatcactatcttgaagagacatgtaaacttccatattaattgcagcattattcacaatagataagatatagaaacaacttaagtgtctatcaacagattaattaataaagaaaatgtggtatacatgcaaaacaaatattattcagccttaaaaaaggaaaccctcccatttgtgaccacatggaagaacctaatacattacgccaaatgaaatgaaccacacacagaaagacaatactgcatgatctcacttatatgggaaatctaaaaaagttgaactcatagaaacagagtagaagggtgattaccaggggttgaggagtgaggtattggggagctgttggcctaataaattccagagacctaatatacaacatggtgactacagttagtaatgtgttatatacttgaaatttgctaagagtagatgttattctcatcacatatgcataaaacaaaacagaaaaaaccacaaaacataagcatgtgaggtgatagataattagcttgattgtggactcatttcactaggtatagtatatcaaaacgtcaggttgtgcaacttaaatacaaactgttttgtcaattacatctcaaagctgaaaaagtcaatttgcatgactaaaaaacagaagattcgatggaataacgcacataaaatgaccagcgtagtatctggcacatgataaaaattctttgtcatcattagtgactatcatttttatctatgcacatttttatctatgctcaactgggtataaacatgcctgcatatagactatccctacgttttgtcactattgaactcagctgcctagttactgcctaataagcatctctgtttcacctcttccactgtaggcattcagtgtgttttgctgctgactcaaacaatggtacaccaacagaaaacacccatataaaaatgtcattgcaatgatatgacatctgaggaggattttaaaatgcagaagcatcttgttcttatccaattgggcaatgaaaaaaaccaatgagaatcttcatgataggtccacgtatgctcccatacgtccaagtgtatacatatctgttcctcgagtcatcacaaacagaagtcatcacaaaggacagagtgagcagaacttaaaaccacccacctggcctatgtgcaatgcactttttaccaagtgataagtttaagttattatgagatagaacaccacttccgtggcatctgactgctctagtagctacaaatggcaaacattcttcttcttttaatttacactcagagtgcccacaatgtgccatatactgtgccaagggccctggggaaaggtaaggcaaataaggcaaaatctctgagctaaagataagccacagaatatactatttctccaacaaatacctagcagaggacctggctcataattgatgattaataaggatttgctgaatgaacaaatgtacaatttgggaagtcctatttacaaacctagggtagaaaaggaaactaatcaagccaaatttaggaagtctctgttcccagttaccactgccaaaaaccattatttgttttgtagcttctaagtctggccaggaagcacatgttttttcttagttaggccattgattcttagtgagtaccatcaccttgtgattattgctactaattaaggtccactctgaacttttatagtagtgagagtgacttaatataccaccattggcaatgagaagaatcagcttgatttcaccagcctgtaactccatcccataagttctccaccttttaaggtggaagtagtaaatcagctaaactcttccaaaagttttgggagttgaccctttgttagctctcaacgttcccactgtgttctcacagcatgaaagtgctccaccatgatccatacaataacaggcactgttccactgaaatcaacagaataaagggctcttacataccccttttcagctattatttgtagtgtgactacaatcatgctttagctttcaagacactcaagaacttaaggatgcaccatctgtggattcttgtcatcacataaagcaaataattgctttttaaaaaatccatgccactattgctaattttttcatttccacaagctaccctgctaaacaacctctgggtatttacatagcatatttgattatgcagtggttttgtgtgtactgaacattatacagtgagtccatgtatcctgaactcaccatctggatttttcaaaccaacttgcctgctttcttttatttttagcaggaggatgataacacccatctttctggcctctggagggattaatactcacaaaagctgtaaagctgaaagactctgcatctgtgctgaatatgatataacaaggtatatttgtaacctcgtgcttaaagagacctatctactgggcatctccgactaccagcagctaagcacattattgtcatcaaatggtatttattgaacatgcagtaactgtctggtgagctccaaattaatgggggactcctgagaacctaattttaaaacattatctccctctttgttatctgtatttgtttgtttcagagcctgacatgttaattggggctcaggactccaacgcacaactgcaattttccttttgaaagcaagaaagcggctgcctaaagacagctggcttagctcctggagttcagaggttggcagggagctgtgcagccacaagtgccagtaagtgccatgaatacggcagaaaactggagcttgtctcaggtacaggctgagaaatagacaaacaaaccgtcaatctcctttcagagtctcccttcccataactactccatccgagacaggcatttgtcttatttttagtctcctcctcaggagctttccatttttatccctagtatctttggggacttggtgagtctggttttgagcctctaattggcttttaccctctaattctttttcattcacccagaaggcaaattggccctttccttgtctactttatcccaatttctttcactcggttgcctcattttgtttttcatcttccaaggagacttaccctcttctctcctctcacgtatcactggagatctgtcaagcctgccttaaccctgacttccttaaccttcccctgatgaaggcttccccagctggtaatttatttctctaatccacagcttccacagtacttggtttggattttctctgtaatacattctaagatgatttatacccattgataggcatatgcagaagataaatcttcacacaccatacagcactcaccagcatactgagcctagagcaggagcttaaattattcttagacaaatgaatgctatcatttaaatattataagtactttacaaaaagaatgttttaccaatgataaaatcaacacctaacataatctaacagtgcattaacactgagaacaaacaaaattatcaacagtagcaactaatattgactcagcacttaagaatgctctaggcacatagcgagatgctttgcttggattatctctttgaatcctatcaataacttgatgaggtaggcactaatattatagaagggaattgtagcttcaggaattaactttctccagggtatacagctaacaaatagtagatctgggaatcaggtccatgtctgtctgacctcagaatttgctatcttagccacttcacttctgtcttctttttccttgtgagcctgtttaaagggatctagtcaggctcaaccagagtgactttgagaatttataaaaccatatatataaaaataggtgacagatacactgaatactccgaggtgactttttaatttctgtagaaaatatcctctgattcccattccggggcagccagaacaaagcaatggccaaagaaagtttacttactccccagttcttagatggagttatgatttcttcactaaacaatgaggaggccaacctaggttcttagagcaaatcttgttttctagcgatgaacatatttctccttgtctttgacttagatgttatttgcactagcctaatttaaattgttaacacagtacaaattttaacagaaagacagaaagagaatgaatatgaaagatttgggctgctgctggtgatagtggggagctctatttacttttggttaaatgccagtgctgtaagagtccaaggtcagtaaaagaggtgtgaaaccaattagggtttctcagcttctggctgctggaagatatgcatattgcacacccaaaatatacagttttgtaaggaggtatcgacaggctacagtcactctgccatgctgcacaatggcatggtgccaatctagcctgagacaacacatgtccactcatgagttttgggttaaaagtgctgcaacccaaaagaacagaggtgaacaaaagagattcagcaagactgggaatgaagcatgaatcacagatagaggagatcaccatcaaaagcttaggaaaaaatctgccaaagctatatagctctctgctaatgactatgattgtaatttctgcatattttaacagatgttctgtttataaaactgcaaacgaatttaggggttatgagtaaagccaggaggccctggagatgtttctttgtatgattaactgaccacaggccatttgttttacaacaaagatgcacaatgatccatagtccatgatttataccagcccatgtatactaacggctgatgtctccatggtacttctcattagcatcagaagagggattgcagggaaacagattatgggaattgctctcccattgctcaacacgatagttcattagtgggtgtggaatcgatctgaaaaaaaacctaagacgataatcataagctgaaatttgaattattataacaattaaggaagtcaattcaatcatgaaagaaataatatggatttttatagctctaggtccatgcatcttgataattggaaatgagaggattttctgtaatttccaaataaaagataaatataaataaaagataataataataaacataatattactgacttgtactgattacctatctatggatcaagcattctggtgggtaatttatataaattatctcacttcatcctcacaactgtgtattgtaaggatccccgggtactggtaccagaatggcatcaaggttaggggcatcccaggctgctggctatttcttttcctcctcaagacccttcttcttggagggcactctctaatgctgtctctaccaaattaattttctctgcttcctcatagccactgctgcctcattacttcacagctcagacttgctctcatagtctcatttcaccttaagttctcagagctaaataccctgatggtatttttttctggtctcaactcccaagagaagaaatctgatagactcagctaattttttttggggggtgggggggtggactaggtcacataaaaagtcataagcccatctatcgattggttacctttctgtactcctgcccttcggtctaatcagctgtgcttggatggggtaggaatgactaggggttcaaaataggggggctctccaaggaagtgaaatcaggatctccaagagagatccacattctcatgctcattgcaacaccattcccaatagccagatatggaagcaacctaaatgtctgtcaacagatgaatggatgaagaaaatgtggggtatgtgtacatacacacacacacacacacacacacacacatatacacacatgtatatatatgtgtgtatacactgggatatcattcagcctttaaaaggaaggaaatcctggcatttacaacaacatggatgaacctggaggacattatgcaaagtgaaataagtcagatgcagaatgacaaatattgcatgatctcacttatatgtggaatctaaaatagctaaacataaaaacagagtaggatagcagttaccagggcctgagggggtggggaaggagaacatgttggttaaggggtacaaagcttcagttatacaaaatgaataatttctgaagatctgatgtacagcaatgtgactatagttaacattattgtattgtagacttgaaatttgctaaaagggcagatattaagtgttcttgccatatatacacagaaaaagaggcaactatgtgaggtgatatatatgttaatttgactgtggctaatattttatgacacatacatcaaatcaagttgtataccttaaatatacacaattttaactgtcaaatatacaataaaactagaaaaagaatagggcccctttataaccttttaagtggagactggagcacagaagatgcccttggatggggaaatcaccatcagtaaatacagttcatgctgagggtgatgggaagatacaggctgtggggtcaggccgcctgcctctgcctcttattggctgtaggaccttaggcacttatgttaaaagactgagctttattcactcacccataaaatggaaatattacaattacctacttaataagggtgctatgagagtgaaagggatgtacaaatgcttagcacagtgcctggtgcagaatccccacttaataaatgctggctattatcataatcccgttaatacattttattaataacaaattataattgcaataacaacttctccagagctaagcccaaattcgaagatgagttagtgctccaagtggccccacttaaccatgctggaatgaaagggaggagcagctgcatgtgtctgtcattcaaatcaatggggtaattctgtttttattgtgaacagacaaaagctgtgtcctcggctgggtccaaatgatgagattctttatgactaactgaggcagaggtgatattctcagaccttcctgaatgacccacacaaacacccaatggttcttggagcttaaggagtaacaatctgactgaggaagtcaccacaaatttcatgctctagtcccagtttcacgcccccttttctcgcatccagagtcttatttcccaaatttgctttccctgctctctctagaatgcattggatacttccattggaaatgtctaggtcagtacctaacatctggcatagctatctccaaatttgttggataattaaattctacccaagaactcaacaggggggtggcaaatgaatacctgagggcactgcctggctttggaaatttgagtgcatattatcactatttgtgtgtatttgtgagcacaaaagaattagtaagtgctcctgaagcatcatctcattccatctgttgtcaaagttcacattaagcaccaaatccaagggagcataatgagttatgtgaaaatgaacttgtgcttggaatttcagtatccccaggtgatgcaaataggcacatttcagcttgttctgaagaatcccaggctctgggacctgaacatatggtctaagttatttagccagataagacatgggatttcctacaagtagggttttgtcagcaggttggtaaacagtttttcctcagcttggacactccatatcatggtggggatgggataagtatatagtgaggtctttccataaaggacatgtttacaaaaaaggagatcaagcctttaacttgtgccccaaggctcagaagccagcactagttagttatgcaagtattttgaacccacaggacttctggggaattggaaggagtccaacctggctattagaactaagcttcggataaattttactcctgtcctcactatcaacattaataaaatgttcaaggagctggaaccagagccataaagaatgttcatgtcagagaaagcaggatacacagggacaagaggagtgaaattcagcttatgaattgttcccttcatatgctccaaatgctacttctctctccaaaacatgtttattccatagagcgcatgcctaatgccatccacacctaaatgctttacagctactattatttagctgaaattagaacactttttaagtattaggagatcaaatccccaggcaatttgtaatgcaaaatttccccacattttgtatttctcagtgctgcctgaaacccgacattagaactatgtaagccccagcaaatgcctcatgtcagggaatgttctaagagagtgctggggattatcagccacatttgttaactttagtacaatttagacacttttaaagataaaggtcattaatattttaacataacattaagtttaaattcagaactgagaactgttatgagaatctaaccagttttaattcggcatttaataaaatttatttatgttaaaagaaatactgggtatcaggagaaaaaaacacaatagaatgaatatttgaaaatattatattctagctaagtcatgcagctttatttaagtcatcattagcaggcctagcaagttaaatttttcaaagccctatgacatgtgcagctcctaaaaatataaggaaagcttagcccagtcaccctggggtaatggtaaggaatacaagaccaagttaggcatccctgggttaaagcctgccatttataaactatgtggtttttggcaaattattttgcatctctagaccttggtttttctatctgcaaagtagggagaaataacagtgcttgcttcatgtagttgttgtgaggaaatcaggtaataattatatagttaagctggttgggcacggtggctcatgcctgtaatcccagcactttgggaggccgaggcaggcagatcacaaggtcaggagataaagaccatcctggctaatacggtgaaaccccgtctctactagaaataaaaaaaattagacgggcgtggtggccagtgcctgtagtcccagctacttgggaggctgagggagaagaatcgcttgaacccgggaggtggaggttgcagcgagcagagatcatgccactgcactccagcctgggtgacagagggagactctgtctcaaaaaaaaaaaattatattatataattataattattgctaacatttattgagcactacttcctatgcactaggcattgttataggcattttaagatacattatttaatcctcacaataacccaatgaagtaggtactttcatctctgtttttaaagatgagaggaatccgatgcttagagaagaccagtgacttgctccaggtgtcactactagcatctggcagacccgggactggaacccaaggccatctgtgtacaaagtttgtagttctgttgcctgccctctcccctccatcccctctaaccctgctctgatccattgccttttaaattgactatattttcaataacaacataaacaccttgagagccagggttgtgacttgtcactcaataaatattcgccggatggattactgactcttctgatgttgtttagaaagacaaaatcagaatctgtttagaagcaatgaggagtcccttagaaagcttaaactgaagtgaggatggagactgtggattttctgatattattatatattagacatgaatctcttcaaactggaacaaaaactggtaaacagaataattgcaaaatatgtgccaatggccttgaaatcaaagaggagcaggtcgcctgaggagaagcatatgtttaatgcttcacactccatgatgagtcctggagaagaaatgaggctgggcagaaacaaggcagcctatgtggggttcacatccagaaatgaagaaaagcattctaataatttaatttgaggggaatataatttctcaaactccaagagttgcttcagccttcagaaaaaagctgttgggtcccaagatggcaccataaacaacggcaattctcctcctcaagctgtgaggtcagattttatgtgctgggaagagattaactttattgcaaggagaaggatttaattgcagagagtgattagccaaatgcttagatcaatagaatgcaggtcaaactgtgctcagaaatatccatggctcttattacatagaaagttgaggacacagaaaccatttggggaccctgagccatttgtgcatgaagtcatctgcaaacctttccctagaccgcagaagcatccttctctttacccagcaatgatggcatgctgactcaaggaacattcacccctccccccaactcttggcattagagaaagtcaataaaacagctgggatccttgaatgctgttttcaaaagtagagaaaggatcctgcctggtctagctctttgttgtctaattgcaacaaaaatcaatggttttgaaaatggaaagcagatagatcattcctcatttatccaagatatttgagcagaagatggagtgacattgtctaacatgctttaatttttgctctcaccaaagccctctttattcaatgagtctgtgtttgcactgttcttatgaagaaattcattgatagcaatggaatatggtaaagcagatgagcctgtagtacaaattgcaccctaggaaaaaaatggagtggtttaaaagtggtattttacgtaaatgataccttactggctaaccaggcatcccaacaagttgagactatgcagaggggatgtggcttaaggggaaggctgtgtttgccaactgggagctctaaatatgttgcttcacctgtgatctacacctgacaagcagaggccccaaattcccttaattatcggcagctcgatgagtctgacttcctagttcttatttatttcctagaatccaaatcacatgatggaaaagacctagaaaagtgtcaaatccctaccttggcgaataaagccaataaagaagtaacatcaagaaaaaggccaactctttcagaattttctgggaggcttgcagataacattttactcatcctgaaaatacatttgtgaatttggtggatgacaaaatgaactgagtgtgccactgaacatatgaagaagctagggagacagtgtgtgtgatgcgcacatacacacatgtgcacaagcagaaacacgcctttatgcaaggtcacctagagtcagtgatagggctatgaattgtgctaagtttcaatctctcccaccaagttgttttaagaaactgtgcatctcaggcctaccaaggaaatgtattcttctccctgatagtttgatgcttcatttccacctttcctaataagagctgtcattaattttaggttgcctaggactaaaacatacctccaggaaatagcttgtgtataacctttaaggtattgctcagcttgtaaaatgcctctagaatcttgcttgtaatataaaaaaaagaaaaaaaagaggtacctgactctttccattccttcatgcttttgctgcatggtctgctatgcagactgaccccaaagtccttataaagtcttatgttgttggccatcatcatatccagcctggagctttcccaacattaaaaatgaagcaacagaggtgctgtgatataatggaaggtactctgggagaagagtcagcatactggaatttttgctgcagcttaactagcagtcaccaaccaggatagtatgaatgagtggagtaatctctgcccttttttatccttggctgacaaatggaaaaaggacatgacagaatgtcgttttgcaaactgctgagtgtcatgtaatgcaagacactgccgccacctgaggaagtataaaagtgcccccgacaggggagcaggcaataggggaccttagttttagccttggctctacttctcattgtcccatgaccttaggtctacccctgtgggtctccatttccctatctgaaaaagagggtattggtcttatgacctaggtgctctgaaaccttgttaccctaagtatggatcctagactaggagcctttgggagacctgggggcctggcagaaatgcagaatcttggcctccacccagaccaactgaatctgaacttgcattttaacaagctcctcagatgatttgtttgtacatgaaagcttaagaatcactggtcttcaagatctcttccagatttttcattctataattatactataagtggtccagtgtagtgcactgtcacagaacatctatttcatgagacagtggcataacttgctattcatggctaaggaggcatggcagtatgtttttgcttataggtgtacttcagcacagtcacatgagaccagtcagttctggcagaggaaaagtttgtcttggttcttccctatctttttctctctgatcacaaagctcaccaacactgctatccagttgtgggtttagatatacaagatgatcatatttcatattaaaagataatgtcaaagttgctaagataataacttatgccaggcacagtattaagtactttcatatagacctcatttcatacttaaaacagccctgggagtaggttctattgttatgttcatttcacagatgagaaatgtggatcttggagatgtaacttgcccaaattccaagccagaacgtgacagagctgggatttgaatacagatctgactcacaccagagtatgtgcttaaccaccagggatatgccctctccaactccttggttaaacctcctggggtgccttctttttttttttttttttttttttttttttttttttttttgagaagacagttttgctcttgttgcccaggctggagtgcaatggcacgatctcagctcactgcaacctccgcctggtgggttcaagcaattctcctgcctcagcctcccaagtaggtgagattacatgtgcctaccaccacgcccagctaattttttgtatttttagtagagacagggtttcaccatgttggccaggctgttcttgaactcctgatctcaggtgatctgcctgcctcagcctcccaaagtgctaggattacagacgtgagccaccgcacccagctatcttctcttaaatattctcactccacctttgtgtcctcacatcattcttgctatttcaaacccagtcatacaatattttaggtttgtgccgtccaatgggttaatcagtagccacatacagtgattcaaatttaaattaaaaactcagtttcttatttgcactagatgacatttcaagggctcaacagtcacatgtgcctagcggctaccatgttgaatagcacagatatagaatatttccatcgtcagagcaagttctattgcatagtgttgttttagagaatccaattgctgaaaatcatcactctatcactggccttgttctgtgtttcactgcttctcagtattgaaagctctactgttaaatgcacacatttagaaaagatacctcagagccccattcactaagaggtaagaggctgtctggaaaggaagaactgaccaatcctgaatagccaacaaactgggagtcctaaaacttgaccctgacttcaagttcaaagacagcatcctagaagccggggctctggcgtgtgttgccagccttgccagccttggctctcatggttcactgtgacaactcctcatttctatcaggggaaagaaagtccaatcaggcaagttttatttcctctctgaaataaaacagaattgacttgccaaggtatctgcagggacatcaactgttgggccttaaattacctggtaactcttctagtcaattctactttcatgttggagtttgcaatcaacatttatctctataggacagaccgtctgcaggtttctaataccatttttattattaccttgtaaatgtaaaatcctcgaggcagaaatgccagctgctaacactggtgtgtgtgtgtgtgtgtgtgtgtgtgtgtgtgtgtgcgcgcgcacccacttctccagtgatgaatgtccttgggtcctggagtttccaacagcaacaaaaagacataccaaggacttgcctagaaattatgtattgtatggatccaatgtcaggggctttgggggcagctttctctagtagacctgctgagacagaatgaccttccctttctccgccagggtaaagccttctatgtggccgtcaggctttctgctttggaaattaaggcaaataatggagacagaaattcttggcaaatgctcacaagcagacacttcacaactgtctctctgacaggtattaataaataatagttatcatttattgaagcccaactttaatttctctgctaatttagaaattcatcaagtctctactagaatagttctgggtctcaaagagcagccaacccaatgaggaaggtaggtatttaatctagtaagcacccaaataaatgtatattgactaattataataatggctgggaatgaaaaaaataaggcactatggtagcaatgaagaaaggaggccttatttagagggagtggtcagagaagaccctctctgaggaaatgacgtatcagctaaaactggaaggacgaagcagctagcctgcagccagagcttagtaagcaaggagtgggccacgaggctgtgggcacacagagaccagatcttgcgaggtgagtcttggtaaggcgtttgctactaagaacaacgggaaatgattggagggtttgaggcagcaggctgacaagtgcttcatgtttttagaagatcactctagctaaagtgtgaagaatggattggaggttacatggagcagagagtggaagcagggagacccggtaggggctctgtctgtagtgcaggtgggaaatggcagtggcttagactcacatggtagtactggggatagagataagtgaagaaatctgtgagatatcttgggggagtacaaaaaaggacttgctagccaatctgttgtgtgggggtagagtaaggaaaatcagaaatcaaagatgactctcaagtttcaggcttgagaagctggtgggtagtggtgctgtgtgccagaactggttttgcattcataatttgcaagcctgacaattagccttgtgaaagtcaggtattgttactaacatctccctttacagattgtgtattagttcgttttcacactgctgataaagatatacctgagactgggcaatttacaaaacaaagaggcttaatggactcacagttccatgtggctggggaggcctcacaatcatggtggaaggtgaaagtcacgtctcatatggtggcgggcaagagaagacaatgagagccgagtgaaaggagtttcccgttataaaaccatcagattgcgtgagacttactcactaccatgaaaacagtatggagaaaaccacccccatgattcagttatattccgctgggtccatctcacaacaggaggcaattatgggagctacaattcaagatgagatttgggtagggacacagccaaaccataccagatgcggaaactcagatagagcaagtaatttgcccaaagtcacacagctggtgaatcgtccagccaggatttgaacgcttgtctatgagcaaagttcatgtatgctctttccttcaccttcactgcctcatgactgtgttttctcattcactgacttccagtctctatggctcctgtctttttttttctttttaatatatatattttttattatactttaagttctagggtacatgtgcacaatgtgtgggtttgttacatatgtatacatgtgccatgttggtgtgctgcacccattaactagtcatttacattaggtatatctcctaatgctatccgtcccccctccccccaccccacaacaggccccagtgtgtgatgttccccttcctgtgtccaagtgttctcattgttcaattcccacctatgagtgagaacatgcggtgtttggttttttgtccttgtgatagtttgccgagaatgatggtttttagatggagtcttgccctgtcgccacccaggctggagtgcaatggtgcgatctcagctcactgcaacctccgcctcccgggttcaagtaattctcctgcctcagcctcccgagtagctgggattacaggcatgtgccaccatgcctaatttttgcatttttagcagagacagggtttcaccatgttggccaggattgtcttgatctcttgaccttgtgatctgtccacctcggcctctgaaagtgctgggattacaggcgtgagccacggcgtccagccatatggctcctatctctattagtctatagtaagtgttttccttggctcatcactccgctgaaagtgtttcttttttggaaaaccttgtcccacatctccatctggctactccttcttgttccttagaatcttagatttggtttctattctcctgccatttgctatcctaatgcacattaaactttatagcaatttctttattaatcatttgatttttcccaatagactgtaagctctgtgaacataggatcaactatgtatttttttttttttttttttttgagaaggaatctcactctgttgcccaggctggagtgcagtggcgcgatctcggctcactgcaacctccacctcccgggttcaagcagttctcctgcctcagcctctcaagtagctgtgactacaggcgcccaccaccacgcccggctaattttttttttttttttttttcagtagagacggggtttcaccttgttagccaggatggtctcgatctcctgacctcgtgatctgcccgcctcggccacccaaagtgctgggattacaggtgtgagccaccgtgcccagccagaatcaactatgtattatctgtcactatcacactaaagcctggcactatgcctgacacactgttcattcatcacatctcgatgcatatttgctaaatgaactcctactcactggggaagttgagatacagacttgcccagtttaatctaagagatcaggagcctggattagtggtcttattggcatgctacagggaactgggcccaagagctctgagttaactttggacttttgtcactaactagttctgtgacgtgtggaagtttccattacctctctgaaccttagtttccctcttagctcaaaacagaggaaagtgaaacctggcactctgacctcatggggtgagaataaaatccaaatatatgtgaaacagcttgcaaaggtataagaactatacacatggatggtatctcatttgcctcaaaataacaaagtttctcttcagcatgaagattctggagcctagtagatctaaggaggcttcgttgtagtacttatctgtttgtttatgtttgggcaagttgtcttctctgaactgaactaatgaggataatagcactactactttcccaggcctcttctgaggactaagtaactctagtgatagcagtatatatatatatactgtatatatatacagtatatatatatatactgctatcactagagttacttagtcctcagaagagtatatatatatatatatatatatatatatatacactgctatcactagagttactttatatatatatatatatactgctatcactagagttacttagtcctcagaagagtatatatatatatatatatatatatatatatatacactgctatcactagagttactttatatatatatatatatatatactgctatcactagagttacttaatgtgtgtgtgtgtgtatatgtgtgtatatatatatatatatatatatatatatatatatacacacacatttccattataaaaccatcagattgtgtgagacttactcactaccatgagaacagtatggggaaaaccacccccatgattcagttatatcccgctgggtccctctcacaacaggagggaattatgggagctacaattcaagatgagatttgggtggggacacagccaaaccataccagatggggaaactcagatagagcaagtaatttgcccaaagtcacacatctggtgaatcatccagccaggacatatatatatctacatatacatatactatgaatgaagctatatatatagtgtgtgtgtgtatatatatgtatatatgctatatgtagagtatgaagcagtgcctagtgcataggaagcacctaataaatcttagccttttaataatcattaaaaaaaacccctctctttacacacaaacacacatacctcacataccaattcaacttctacaccaacaattttggagttacattatttggatgcatatttttgaaaatgtcactaagaataaatattacctcatgcccaacctcaggagcagcttcttcaagcacagttacctataaactttgtaccaaatagtatgcccctccaaaaccaacagacccttctttgtagaagtcaagtggaagcaacgcttagaggtatgaatcagtgtgtcgctcggttccatggagacaaatccaagtaggcactggcagctgtccgggtcctcagtgagctgaagcaggccacatggcaagataatttttaaagtttcttagcatcaataaaacacctcctttttaagagctccatctcttaattcaaagtcgaaaccttctattttccactgctctgctccgctgctatttcagttattagaacacctgctgtctgaacgagtttgcctcccaaatagccgaataatcaaaagatgaggagacttgcttaagcagcaggaaggaaaactggtgaaagaaagaaagggttgacaggcagcaagaggaggagaatccaggaataaatgggacagaaacggagagagcaagcaggaggagtcctggcaagatggcaacagtttagaccaggacaggaagtggcaagaacagagaagagacaacaccacactcaggagaaggcaggagaaaagggaagtaaaattgctaaaccctctcacttgaagaatatcagtaaggcagtggattgtggcagttaaagccatgacttcggacacatagaacagggactgaaaactgtgcatacaaagtatgcactcagtaaatgctttataatagattatgagcatcagaatgggggtaaaacactccctccccaaataaatactgaaggtagagaaaacagctaaaaaaaaaaaaaaaccctccatatcctatggtctttttttttctcttttttggggagacaatgttagttttctaatttgccatcttcttcaaacgctgctttcttcccttgtagctcttctacatgaaatccaaagatgacaggtccttatgttacagtaggtagctattcagaaatgagcagagtaggagaggcctcccctgcaacacacaccaggaatgtcaggagaccatcaggtgatggtcaggcagtgttaactgtctctctaaaataataattggtcatggccagtgccagggaaaggcacccaatagatgggaaagtctcccaacagacagaaacatctgaaactggtgatcagcagcttcctgataagatctcaggagttgggtgaatgggctcaagcatgcgcactaaggcaaaatggcagattacctccctctggaacactggattggtaaggggaaaagcacctcaagtgagcatgtatacaactttagtaaacacattgcacatgtggtcccccccaagtgctggcaggccactgctcatgcagacagcccaccccaagggaagaatcaggaaagaacataagaccccagaggtatgacaacatggaaaaaccccaagtcaaaagtcaaactgcgcacttgatctctcaagttgtctgcttggccctcttccaagtgcactttccttcctttcacccctgccttggtctctccttctgtcttatgcccctcagttgaattctttcttctgaggaggcaagaattgaggttgctgtagacctgtacagatttgcctctggtaacatactttggtgccacgtgactcagatacgttccgctgctaacacttacagtagaaggagacatggaagccatctatcctacttctgcagagctggaatctccttcatatcatccctgaaggatgtgcatgctggcactgcctacactagtctgctgggggaaatccaatgcttccagcaaggtccattctcttccttgtgaactggattatgaaagttcctcctcttaacaagccaaagcactctctgctgttaacatcatcactggtcttaagaccttctggagttaattacaaaacccggatttcctcttccaatgtatattcattcaacactcctgcacacactttcattgtatgcttattgagagcagagaggccatctgtcaggttaatttttatcttagcaggttgcacaatacttgacacacagtaggtgctcactaagcatctgaatgaataaatgatattcacagaatcaaaggatttagagtacctactaggggtggtaaactaaatgccttcaggagtgcacgcaagtgaaatacttaagaggaagggcgtggcttgtggctaattgaggagtgaatgttctgcctaaaggcatttgaattcaaattgtttagaagggttgattagctggacagacccttttactgttgggttgcagcctgcgggctcctggtttgtgactccattttaacctatccccacttttccacacacacacactttaggaatctgaatagtctcaattatattctttacaaatgctaactcatgctcagaacatccctaaggatagggaaagcaagatcatcaaaactgttcattatttaaaaatctattactttgagctgaaagctgctttgttgaaatttttcccaattgctcctagtcgtgccctttgagggtggcaaaacaaattgacttcttttctgtttgatttccctgcaaatatttgaagatattcaccactcctccaacctaagtctgctccagattaaagttctttcagccgttcctaatatcaagattatgaaacctccactatcttgaccactccactatatcaatattcccctccaaagtgtagtggcacacacttacagtattattaataatagtgggctcatgcctgtaatcctagcacttttggatgctgaggcaggaggctcgcttgagcccaggagtttgagaccagcctgggcaacaaagcgagactccatctctacaaaaaaattaaaaaattggctgggcatggcagcacaagcctgtaattttagctactagggaggctaggaggatgacttgagcccaggaggctgaggcggcagtgagccatgattgcactactgcactccactctgaacaacagagtgagactatctccaaaaacaacaatactgaaacattttggaaaagatccaaatatatgacaatagaaatttagtaaattttggtcatcttctataatagagtttatgcgcctattaaacattatgctaaagagcatagaaaaatatccatatcagaatattaaatgaaatcacattacaaaatgatgcattcaacatgatttcaattttatttaaaactgatttgagtaagtagaaaacttagcatgaagactgcattgtccaaaaattacttcaataatcaaataaaaacacaggttttttattaaacatgatttcagaaattaaaaatttaagattgtagctcctttaacattgaagagtcttttgtcagtttttaaagtcagagacccatatggaggagctgattccaaaatccatgttctaattccttatcccttctccccaagatttgaatacagtcagtttgggtggggcctgagcatatttttaaaaagactgtcaggtgattttgatgaataccagtggttaagaattaaactagacagatttctatcaatgctgtcaaacaacatataccttttcttggcagctgcatgactttttgacttcctcttggagttaaccaagaccctggaggcttgttgtgatgagcgttgctcttgagggctactcccctccctgtatgcaggcaggtggctttgtaaaacctcaggaaagatactggcattgatccccacacaattcatgttgctacatttggcccatcatctagagtgtcaagatctttcttttctgcctcctccttccagctgtgactcatcctaaaactcaatcagaatgacatttaaggtacttatgcaaatctcctctttcccaaggtaaacattcccaatgtcatcaaccagaaagcctaagacatttttctcttccccactgacttggacacctggcctagatgctcaccacttaggacagagatgctacctccatcccaccaccaccatttttaaaactttgatgataaatgtatttatatgcaaataaatttgcatatatttatagtgtacagtgtgatcttttaatatatgtgtgcattgtgaaatggtaaatcaggcaaattgatatttccgtcatctcacacaatttttttttattgtgagccttttcccttttaatgtagatcctggaacaggatttgaaaaggctccaatttgttgcataaaagtctctaactagggtttttaatgactaaagtaacataggcttgttgtaaaatatttttcaaaaatttatggaaactcgtaaaataaaagtctcccccatttccaagctcattttcccaaggcaatcactattcacaacttagtggtatgcgccactttacatctctcatctaggctcagtttcatttctttgaccaacggtcaaatatttctgccacccatttcataacaatttattctgatgccaatttaaaattatcaaatcagttcatgactctggctcccataaaacaccatcctcccatttgctcacactgctctgcaccaattccttttctccaaagtcatggatccctttccacctcatggccttgcctatgctgttttgtctgcctggcagggctgccctatgcccaaaccttaactttaagatcacttcttcagggcagccttccctgatcttgtaagactgggtcaggttatctcagcacagcctatgatgactccattacagaggagccatcctgctaggagtttatatactccttttgtgactatttgatcaaagtacgtctttcccgccaaattttaaactctacgagggcatggaaagctgtcttgatagctgctgtggccatagcacttagtactgtgtctggcacataagacagccaaacgatatttgttgaataattaatgaaataaattgcaaagacattcatctatgctaaaaaaaattcactgcaaaaaaaaaaaaatcacgaggatttttataatcccttcaacacaatctctgctccctctaacttggtggttgatgggcattttctcctcactcttattccatatgataagatgtccccatccctgccccaagatttataagccactgagctcttcttgaaaacatattgaagaaacatcaccaacattcaccccattgttccgagggaactcacatattttgagcaccttaccatgtgcgggttctatccccttgcatcttaagttatgtaattttctcagtgacccatgatatagtttcattttttctactttacagatgagaaatctgagacccagagagactaagtagcttggctaagatgatagaggaagtaatggtagggatttgacattaacaggttaatagaaaggatgctggcctggacatgaggagatgtgagttttagtctatcttcttccatgaattccttgggtaaccttgagccattactttaacctccaagttttgactccccgatgtaaagatagtgtctgaagaattggcacaaggcctgcaaaagtttctgaccaaggataaagtacagcatgctgtaaagatgatcattatgcctctttcccctaccctcaagaaccaacagatggccttctctgcatttgaaaatcaaacattcctaccaaggtcagttatgcctacaaatcagtgcaggctttcttctcgggcacaaaatctccagctgaaaatcagctctaattctttctcttgctcaggccttgctctgaataatatattttgaaaatgaactattttggggccaagaatctgtaaatctgagctgattcatcactttcaccaccaggctgctgctctcctgcatcttctgtgttgtgagataaagatgttttttcttcactaacagtttctcagtgggctacatggagagttctccttttgtcatgaaaagattctctgcaaaatactacaaaacctaaggatgagcacattctcaagaaatcatctggagtaaatagaacactggggtgggatgggagtatgcagagagagacacaaccacagaacagaagagctgaaatggaatacaacatggcacctctctttgaatgtggagatggcaaagtgtcaactcctgaccttcctaacaaaagaataaggaagtgaaaaaggtaattccagaaaatgtactatttaaaaactagctccatctagctttggaatagttatcgtttcctccataagatttagctttctatgtttttttgtatgaatgtatattaaaatgaatttgctttttttaaagaaattacagagatacccttaaaaacatgctaggcagatttgtcaaaaattaaaaatagaactaccacatggtccagcaatcccactacttggtatatatcccaaggaaaagaaatcagtatgtcaaagagatatctgcactcccatgtttactgcaactccattcacaatagccaagataagaattgaatgtataatacaatggagtactattcagccataaaaaatgaaattgtgtcatttgcagcaacatggatgagcccagaaaacattatgataagtcaaagccaggtacagaaagacaaataggcacacaatctcactcatatgtggaatctaaaaatgttgatctcagagaagtagagagtagaattgtggttaccagaaataggggattgggagaggttggtcaatgggtacaaagccagttagatgggaggaataagttctggtgttctgttgcacagaagggtgactatagttaacaataagatattgtaatttcaaaacatctagaagcaggaattttgagtgttctcaccacaaagaaatgatacatgtctgaggtgatatgttaattaccctcatttgattattatacattgtatacatgtatcaaaacatcacattgtacccatataggtacaataattttgtgtcaattaaacattaaaaaattttaaacacacaaaacaaaacaaaaaccatgctaggtaaaatggagcagccagttaaagaataaaagcaattggcatggattctcatttgtggataattgagaattggccaatagtttcccaggggcagaaaacactccttcagaaaacctcctgtgttcagtggaattttaaaatgcaatataaaagagcaatgtgatcacaaaagcacactactgcaatattatatataaaaaacgccatgctgtttggggatattttcttcccattactattcctctaggctatacctctactgagctctagaccatatttccaaatccacttgcaacactgatatctccatgtggaacgtcaggctgctcaaactcactgagtcctaaattgacctccgtctcctcccctctccaaatcttcctctgctgctactttcttcatttaagttcctaggactccatccgtcaaattgccaacctagagacacaggattcattctgagcacttctcagctgcaccattgacctagatagaagccctactaattctatctcaaaatatccctctcataaatctccttttccacgccatgccctctgcactgcgctagtcctgggccataccatctctcaccaagattagtgcatcgccttctaataggcctccctccttccatcattccgcctccttgacagtggtacattcagccacaccctggcttctcaccaggtcactcaccacacatcacacacaacacaaccttctcacatactaaaaaatatccacagagaaacacacacaatacacaatctccaacacctatatatatatccacagacaacacgtgcacatgcatgtgcttacacacatgtacaattgcacaaatcctcaaatacatcaacccacctgccatcccttaataccatactcttctctcccatttctagatgtctcttaaggctatttttatcttctgagacctcctttcttcactgtcataccacccattaatgcccccttgaagctctgatttatccttgtagatcaagctcaaagcatgagcccaccctcccatgaaacagctaagcatggctctcccttctctggttgtcacagcactttgtggatgtatatcacaatgtactaaggtttgctagccctgcctctaggcttagccctggagtcctaaaaagcagcagaacttaacagcacaggctttgggggcaaacagagttggggtgaaacctcagtcatctcttactagcttgggaaagtaaattccctaagcccccttttttctcacttcaaaaaaagataatagagttgaaattagaaataagtgaaaaaattctaactaacactcagttaagactcaataaaatggcaactattattaaaactatttagacctcatgtgcctagtactctgccaaaaaaaaaaaagcttaattacatgaatggatttaactttcagctggttcagtgtcataaaaagcatattcaagtatgatgccacattgtaaattcccatttatgcaaagtaagcaaaggaactactaatattcatattcacattttaccaatggcaaaatacacactgacaacgtaagtaactgtgttcagaacacacagtgaatccgtggcccaagtaagactagaactcagcctttgagtgttatttccgtgtaaaacattgtctcacatttcaaaaatgagtccatctaaaaatgatatagctgtccaatcctttgtactatgctgtgtagttttcctaaatatgcttattttacaagaaaagaaagttcgtaaaataacaaattggtaagatgccagaagaaggactggctcctcaatttagagcagagccttgcaaatgaggatgaacatttgaaagagcgatcttctggaaagcataactcagattacatcattttcttgcttctaagccctccagtgacttctccttgctctccaaataaaatcacccatcttttcatggcctccaagcctccatatggtctggatcctgcctaactctcataccactgttgtctgtttcagtcatcatactcaggttgcactggtcttctgtttctcatactctccacattcattactgctccagggcctttgcatttactattttctctccaggaagtcctcattccctaaattttcttcatttttggttttttttttttttttgctttttaggttgtcctgtcaagaatacttctccatctaatatatttgtttaccacccactctctatatccttaacttgtcctaatctctccataccatttatcaacatataaaattctcatttgctttgtgggttcttcctcccacagattattattagaaaagagagaaatcttgatcttgctcacttctttatgaccaacacatgaaacagtgattgatacatagtagatattcagtaaacatttgctaaatgaagaaataagcttcttttatcaccactaaagcaccaagataagtctttccgtgcctttgtcatctagatttatataacctccttaaaactaaaagcaatgcagtccccaaatttagaacttgtaggaagaagtgagcaaattgcaaacatcattcttacatccttgagaaaaaaagacttttgtttttctttatatttaaggaaagctgagtcttttggcaaaagggactgtttggagacactccctccatgtgaaccaaaaggttacacatgcttcttctccagtttggagctcagccccctgttctggtttcaatctggagatttcatctgacagcctgcatatcactacctatggtggacttgctctgtggccagagtttacttcttcttcttcttcttttttttgagatggagtcttgctctgtcgcccaggctggagtgcagtggcatgatctcgactcactgcaacctccacctcccaggttcactccattctcctgcctcagcctcctgagtagctgggactacaggcgcccaccacaaggcccgcctaattttttttatttttgatagagacggggtttcaccatgttagccaggatggtcttgatctcctgacctcgtgatctgccctcctcggcctctcaaattgctgggattacaggcgtgagccactgcacctggcccagagtttacttagacggcacaccacataacgagcagaacgtgcactgagatgggaagaacagattttccaagtagtttaatttcgagaattaacttaaaaattatctggtaacctcattcctaatgtcatagtgccacgtccactttaaagtttaaaatcttggaaatggattcaatcatccatgacaaacatatgttgttcttctcaagcagaagtataaaataattcttctccctaactttctgaattttccttttaataacttgaaaaaataacagcccttagtagcccacctgtgtgttaacagtgatttttgcaaaacatagccaaacagaagtccctgtttgcctcatttcaagttaatttgaaaaagaaaagttggctcaaccaaacttatgctgtaatggtccttgcttacaagtcagcaagtaccatctgaaagcttaggggtagcactccatttccctcctggatccctggtagtagatgtgcatgcaaagtgaatgcaggtacaaacaccaagtgctctcccaacaggtttccactgtcatcttcttcacttataagcagctaagccacaaattcccctctatcagatgtcacaggaagctacacaaagtaggatttgaaatgtatatatgtaattatgtcaaatctgatggcaacataatttactgaagagcagaaagcttattgaacatgaggctatttctattccaaaagcctagaacatagagtcagtctcatcctcccaacccagccttaaaaatcagatggagattcatgacatggaaagaatcacagggaagatgttcacattggtagtgagtttgcctcaatttgtgttcctcatgaccatctctagttttcaggccaataagggcagatactgctggtagagcagccatgttatatgatttccaatttgtgagttagctctttggctccctagggtaccttcaatagctatagaattagcatctattgcttttcatttggttcttatcatcacagaagagggttggccatacatagaatagttgagttttgggggaaagcattgggtaagaggaagggagtatgcactagaaaaagtagactcatgacacacactgtggtagagtggtaatttttgaaacgggctttaacagagatagaaagaaaactgtatgaaaactcttcataataattaattaagcctctcttagtcctaaattgagaaaaatgcaagaatcaatacttttttttttttttttgagatggggctgaagtgcagtggtgcaatctcggctcactgtaacctctgcctcctgggttcaaatgattcttccacctcagcctcctgagtagctgggattacaggtgcccaccaccacacctggctaattttttgtgtgtgtttttagtagagacagggcttcaccatgttggccaggcttgtcttgaactcctggcctcaagtgatccacccgccttagcctccccaaagttctgggattacaggcgtgagccaccgcacccagccaaaaatcaataattttaaatgtttcatacttattgacattaatgaaacctcctgaaaaagcatttaatgcaactccgctgatattttaaatttacgttcctcacattacaaggtcaggtcagttcccctgggtttcacagagccgacgttatcacatagacacgactttgttcatgctgtgtatggaacaacccttcagagggttgctgagctgtccatggtgctgggaaagcagctgtttctcctctttggttcagcaggagacacacattcagaaatgatgtgttatctcacagtgcagtggcccacacttccatgtttatttggaaaaagaaaacacatagtatctcctagtattctgctttcctaacaagctttgatttgtttaggctacctcaataaagtatctctttttactcttttacccttcagatattaacaaccacattgaggtacatgaatttgcacttgcttgcatttctatcattgcacttgcttgcatttctatttgtatcataagtgttttttctttccaaacagactataagtgtaagggttaaagaaatacttatggatggattgaaataactgaattcaaatttaggctcctccacctattagctgataacctggttgagtcaagttactttttctgcctcagtttctttaactgtaaaaagaggtgattgaaagccactaactttttggaagtgctgtagtttaaagtatgcagtgctatattttaaagtattttgcaaactgtgacatgctatgacagtgtgctatgacatgctatgaaagcaagcatttatcatgccactttttttgttgttggtatcacatgtagtaagatattcttgacagagcattaatagcattaataattgaagtttttgttgtctcctccaattcagaacaggcctatgggaatgaaggatccatctcatgccaggggaatcttatgagttatagatataagaagaatttcacttgaaagaaagtagagaagtgtagaagctgtaaaatttatatccggtaaataattcaaagattaatacccaaagtctcagtcatctctaggctcatcatcattgccacttcctcggtacttggcatttcttttttaaaaatgccccagtcatgatttaatctgaacacattctctttaaatgatctaggaataattaaatatcctgcccaacataataaagggtggcagagacaaaacttgacatcggattattctgaattcaaattctcaaccatcatgcctacagccttctaaatctaaatgagtcttctaggtataggttaaattaggagctggccaaaacttcttggatcccttattctgaagtagaaccttagagagcctaagtctagcattttagagaccaccctgaaaataagcttttttaggaggagggggataagggaaaatttgctttgtgaatctaacccaagataatcttcagtttccatgatgtaacaaaccagaggttgcacaagctgctggaatcacaagaacactaacttaccacctaccaatttaccaagtcagtatccatgaaccaactagaacttactttttgtgcagcataaagaaattcaattaaaatgcattctggtggcgttttcaaaactcagcaactttaataattacaccatttaaaaattgcatttagtgccattacttctcatccatttaaatcctccccattcttaaagatccagttgatattcccctccctccaagaacattcacagatggctccaacttacagtaatttaatctttctctgcatacatatcacttctgcctacaccatacatctgtcaacaaatcatctattgccctggaatatctgttttttaccttgctatctaacttatattaattggcttttcgaatctataccttatgttttcaaccttactggaacactagctcatcacaggtgctcaataaatatttgaactaaagttagcacttacattttattgaaactgcttaagtttctgcttcttccccattcttttcccccattttaagtccacaaaggtatggctactttttctgtcataatcaataccgtatccttgggaccaaggatatcataggggcttatgtgcatgcttggaataactacagtaataaaaatatgacctagctgaattgccagggaattaggagaaattttcaaatctctagttcaaggagataagctatgctcctaagtgaatttattttatttcagatgagaatcactttcaaagtaccattgggagatttgtgtttgtaaattctgttctcagctacaacaaaaaatgtagcacagaccatagatcaaggcatagagtaaggtaaaatacaatacgaataaaagggaaagagcacccagaacacatcggttattttcaaaatgtcttatgtaaagactgaggcattatgcttcagcacagagctgagaagaaatttgcatgaaccctttcaagagcttgcaagctgccttaactccatttatttatgtatttttcaggaatgtttattgtggtagatgttagggatagagaagtgaacaaaaccaatatagtcttgccctcatagaatccacattctaacaaaatgagaaaataaaggaaatttctcccattcatttatataataagtattgataaagtatcgactccatgcacagcattgggtttcactttcctggctttgctgctctgatattactgagggtagaagagatgacacaagcagttaatctgatttaataaatcctttaattctgtcggtaaatactgggaaggaaaggggatcatggagaaagagggcccagaaatagacattaagccctttttctgtcgtcttcctacactttagtaatattaagacagttccttgagaaagagagcaatctctgccttgctcaggggaaaaagaattgggagtctccatggcctagttgaagagagagagagagagagagagagacagagacagagacagagacagacaatcatgtacgctttctttcatggtggcgtcctggctgctgcaatagttgcaactcaaggaggttaggagcagccccctcctgcatgatcatgcattatcccatgaattctaccatccataatgcacattctctagttgaaggttttattttcccttttctttgttgtaatggaattttctattataccctaaaatattacttttactttttttaaaaaaaaaaaagacattctcttgctgtttcacatatagttcttagattaatactcagatccatttaacatcataaaagagaaacttctgtatcaatgaccaaatcagtgggtgagatctacaaactagaatcagggctggtgcattgctttcagaatgttccttatttatagacagcttaattgcattaagtgccaaagaatgtactgctttctttgtaatgagtttttatggtcttagtgttcagaagctcagattccatctgtgacagcagaatgttgtagaattcagctattaatagctgctggtacacacttactcagagctaagaggcccaaggctgtagagacagccagatggagataataccagagagtgactgtatggacaaaaaggatgatctttttccccccaacacaaaacagacaacactaaaaacatgacaatcctgttttattgcaagccaaactctctgaagaatttttttccccctctttggaattcttaggtctggttctaaatcacatttgatttatcactgtttctgatgttcaaataactccttacacaggttataaaaccaaaaacatccagatgagttaacaaccattatttagtaaaatgataccaagtaaccacacagaaaatcaggaataatacaatttggctattattcaaggaaaaataaactttgatacaggacagccttccgaatcaggaatattttccttaacatagagaagaacgggtaagtgagctgaataatacagacctttttatggaaagaaaaaattttttaaaaaaacctgcttaatgtgatttagagtgattatggctttagttcatctttattctaataagagtaagaaaattatactgcaagacaagggtgacatgaccaccatatttaatgtcattacattaatgaatgattcttatgggccaaagaacaccaactcttgttttttaaaaaattataatatcctgctaagtaaataagaaaaaaacctattttttaatctgtgactcattggtaaattgaatggctaaattatattttggtgggagtacaattgtaggttgccaaagaaatgtgggttatatgcttaagcatagaaatattaatgggcatgcttgtgtgcaatgaaaaatgatattaaaaaatgggtaagtgttcagcatattttgtttcatttgcaacatgagtaaaatcacattgttcttctgaagccaagcacagctaaaggcaagaggcacagataaggtggggctgtgatggggagcactctgctgtcatgctttaaggaagtttctggcaaacagagaatgtatgttaagtacctgcagtggcctatttcatagagacaccatataaagagtcctgcaaagcaaaactgacttatgtaaaagaggcgcaggttaaggtttcatacaggtgggtaagaaaaccaggatgtctcaaactatccaaagaatctaaagtctatccctacagacctccattttttcacgtaactacccctactttgtaggaaggacttttttttaagtaaaaaacaggcctaaaattttgataatctattttcattgcaggcaaattggctagtagtttaggttctagagtcacactcattgtgtttcatgtttgcctcttactagttgtgtaaacctgggcaagcttttgaagttggtaagcctgtattttctcagaggtaaaatagatattgtgagaatacctacatcataggattgtgaggattatgtaagatattctatgcaaaacatatagtacaatggctagtatacagtcaatgctcaatagatgtttcttttttattcttatttttgttatttatttacattttacttcattactgctatatgtaaagtgcttctaatattagagacatctgggtttgacttctggctgagaaaccatgatgaatcttcttcagtttactcatctgtcaaataaggctaatcatagatatgccataggaatgtgataagtaaactaaataatttaagccacacgtttaacacagtatctgacacaagctaatgcctataaaaaactagctgttaggatttcaatcgtagtcatatccactcaataaggttaatgtgacacttaaatgtgataatgtatataaagcccaaccaacagtacccgaaccttaaatgttacctcactcttcctgcatcttggttagccacctgcatgtatcacatagtatttttaaccaatagtatcttctgtatattggctttttttttttttgagatggagtctcactctgtcgcccaggctggagtatagtggcatgatcttggctcactgcaatccccgactcccgggttcaaacattcttggctaatttttgtatttttagtacagatgggattcaccatgttggctaggctggtcttgagctcctgacctcaagtgatccacccaccttggcctcccaaagtgctaggattgcaggtgtgagccattgcatccaacctctatatcagctttaatatttaccagtctccaagttcattaggtgacttgctaccatactatcatttcacaaagcgattgtggtacaattatgtactgcataacaatgtttcagtttatgatgaaccaatgtgtgatggtggtcccatgagattttaacagggctaaaaatattcctattgcctagtgatgttgcagccatcataatgccagagtgcaatgcattactcaggtgtttgtggtgatggtggtataaacaaacctactctgctgtcagttgtataaaagtagagcacataccgttatgtacagtatgtgatactcaatcatgataataaatgactatgttactcgttatgtatactatactttttatcattatttcagagtgtactccttctgcttataaaaaaaaagttaacctttattaaaaagtctctgggttgctgagcacagtggctcatgcctgtaatctcagcactttgggaggctgagacaggtggattacctaaggtaagaagtttgagaccagcctgggcaacatggcgaaaccccatctctactaaaaatacaaaaattagccgagtgtggtggcaggtgcctgtaagcccagctactcgggaggctgaggcaggagaatcacttgaacccggaagactgaggttgcagtgagccgagattgcggcactgcactccagcctgggggatagaatgagactccatctctcaaaaaaaaaaaaaaaaaaaaaaaaagcctctgggttgataggtacagcaaaccactatggcacacatttacctatgtaacaaacctgcacatcctgcacatgtacctcggaacttaaaataaaaaatttaaaaaagcatcaggttagccaggcgtggtggcacatgcctgtaatcccagctactcaggaggctgaggcaggagaatccttgaacctgggaggcggaggctgcagtgagccgagattgtgccagcttgggtgacactccagcttgggtgacagagtgagacttcgtctttgacaaaagaataagcctcaggcaagtccttcaggaggtattccagaggaaggcattgttattttaggtgatgacagctccatgcatcttattgcctttgaaggccttccagtgggacaacatgtggaggtggaagacagtgacattgataatcctgaccctgtgtaggcctaaggtaacatgtgttcttttgtttcttaaggtttaacaaacaagtttaaaaagtaaaacattaatgggaaagagcttatagaacaaggatatacagaaagataaaaattttgcatagttgtgtgtttgtgttttaagctaaatgttattacaaaacagtcaaaaagttaaaaaaattaaaaagtttataaagtaaaagttatagtcagctaagcttaacttattattgaagaaagacttttaaaaaataaatttagcatagcctaggtttacagtgtttatagcagtgtacaataatgtccttggccttcacattcactcactagtcagtgactcacccagaacaactttcagtcctgaaagctccattcatggtaagtgccctacacaagtaagtgtgccatttttaatctttttttttttttttttttttttttttttgagacagagtttcactcttattgcctgggctggagtgcagtgaagcgatgttggctcaccgcaacctccgcctcctgggttcaagtgattctcctgcctcagcctcccaagtagctgagattacaggtgcctgccaccacacccagctagtttttttgtatttttagtagagacagagtttcatattggccaggctggtcttgaactcctgaccttaggagatccacctgcctcggcctcccaaaatgctgggattacaggcatgagccactgtgcccggccatttttaatcatttatatcatatttttactatgctttttctatgttgagatacacaaatgcttaccattgtgttatgattgcctacactattcagaagagtaacatgctgtacaggtttatagtccaggagcaatagcctataccatatagcctaggtgtgcagtaggctataccaccccaggtttgtgtaagtacactctggtgttcacacaaggatgaaattgcctaatggcacacttctcagaacatatccctatcattaactgacgcatgactgtgtgtatattaatatcacaagccctttgcaaactagatagggaaggtatttcattctcattttcatgctttagttaatatcagagagccaccaacttaaaatatttccacatacttccagctgaaacttcacaggctgctttcattttttacttagtttctaacattatgatttctgaaatttccacattagctcatcacttcaaaatgcctttaatgccaatatatcaagcccatcatcaaacagatcatcttacatatttgtgcagtgtgtgaggctctaagtgaacactttctacaaagggaatttttatctacatccccaagtagaagagagattgtgctgtgctcctttccttctcatggaaggtttactaataatttcattgtcatctttaagcctttcactagtcacagcaagagtacatgcaaggatctaagcaaacaaagctcttaggctgccttgaaacaaaacctgtctgtaccatcatactaaattcccccagcctatttcaacactggcaatgaaaacatggcatttttcaccttgactttactttcaatgtgacaaggcagtgtctaacttcagggcattccgtggttatgaaatcttgacacctcacctactgtgggaatgacatgttgaaacagtttctccattctctgaggcattttcatattaagctctggtgaatgggtattaatgagatggtcattggagtgtcaggcgggccgtgtctcttctttttctgtctctctccccctgcccttccccatcccatcctcctcccccacccccagctgcacagctgacaacttcaaacatttaattactgatcccctcatcccctaacaatcaatagttggcatcccccaaaatcaaataatattcaatgtgcagagctgtatttgttttcacataacactgcagggaaattaaagataactcatcatgtgaatcaggttctctctttatgattaagaagtgactgccacttccatgcacatcctaggggttacctaacgtggctctaaaatgtccttggcaaatgttcttactgcttctccaattacattaaactatggattgtctaatgattctttggaaaaatatacttttatgataccttgaatgctaaaaaggattcttgttatttatgataaattacttatcttttaacaatagaaatagtaacatgtattgagggcatacaccatactagacaaggtcctaggtgctttatatacataatccatttcattctcatagtaagtccatggaggtaagtaccattattatttctcatgttttatgtagaggagaacaatgacattctgatagaatgggtgacttgactaaagttacaactagttagtggcagaactggaatttagaattgttctgtctgaaccaagaatcaaaagtcttaaacactcctttacactgcctttcttggcaagttgaattatatcaaatgacttttgttttggtttagctataaatatttcacttgtctcaactcatctagcacctttgtcattcaggttcagttatcaaggatcacaactctgattggtgctctgagtgataatgactacatttcccatatgaaaagtcatacatctttattatttttatgaaagttcagagtccttggattgtgttttgttgtttttttctttaagtttaggttctgggagtacacatgcaggtttgttacatgagtaaattgtgtgtgttgagacttgtcacccaagtagtgaggatagtacccactatgtagccttccaatccatgccctctttccatccttccccttcaagcagtcctcagtgtctatttttcccctcttttgtttccatgagtattcaatgtttagctccacttataagtaagaacatgcagtatttggttttctgttcctgcattagttggcttaggataatggcctctagctgcatccacattgccacaaaggacatgatttcattctttttttatggctgtattatattccagagtataaatgtaccacattttgttagtccagtccaccactgatgggcacctagattgattctgggtctttgctattatgaatagtcctgtgatgaacaaacaggtgcatggattgtgtgttaaaggtggatttcagaaatcataatgaaaaataatctcgaagatttatgaggatctattttttcacttgtagttatactgtagcagaaaaattttgatgacttaataataattcaatttaataataaacaatgtattatattgttttttcacttatattttgagggaaaatattaaaatatttcctcaaaaatacatcaagaaacatactgaaattatgaaatatggccaagttaaatcagaaatttcagggagtgttttgatttcccaatccaccactttatgaggaagcatagagcccacttcagcaggtcagttgacctgggccccaccctcatgaagcatgttgagttctagcaaacatgtacatctttggtttgtcacctgtccatactgaacttggggcggaaagatcactgcttcacacccctccttttcctcaggtttgccagtctcagagaattagaacactgcataaaaccttagaactcagtgtattccagctctcacagtctactgatgaagaaactgaagccaagaaaggtagccacagtgcctgggccagacagacccaggttccagagccagcccaaccatctcccactatcccacgcttcctctccagcttacactgtactgtacagatatcggtaaaggagtcatcatttgtaaataaggctggcaatgttccctcctcctaatgttgttaaccagaaactactttattgtaaagaaaacagatgctactaattctgcatcaaagacatcttggacattatgctaattagagcctaatgaagtgggttggcatcccagttccaccgatttaagctatgggaccaattatgaaactttccaaagcctgagttccattatttgtaagaaggtgatgataacaccaccaaccgcattgggttgttggtgatatatatatgtaataattcatatatctgacacataataaatattcaataaatattactttatcttatcattttgctaaattgtaacagaaaattccctataaggtcttcagagtaattctgcctactatgccctccccatgcagctgccaacaaatttattatagttggtatgtcactggttacgttttccaatgtttgaaaaaaattctacctcactccccatccttaccacacatatatcccccacctacttggagtataaactcctgggaaaccacttacaatgtacagtttggctgtggctcaccacactcttctcaaggctcttcagtattgggatggatggcaagaattgcatttattttctcacttcttttgtttaaggtgctgagtcagattaagagatggcactgtcccaaattgcaacgaactggactccacttgtattttgtaaagttgagctgacccggctcagctcctaaaagagtgctgtttgcctgcttttccgggatgaatactttagcaactgctgctctctgtgtctggactcacctttcagagagacagagactttgaggttctgtggctttgcctaatgaataacctggtctctgtcattttcaaaatgcaaacatttgtgggactctgagaactgttctttgtagaaacaagtcattgccaaagttcagagagatagctacagacacagatgtagtcttaggacatattgattagctttctggctagatcttttttaatgtaatgggcatactatcttggtgaaagaagttgactttttgacaatttgcagccatggaacttgccttctgcatcaaaatcattggaagattatgttcctctgaagttcctaatacctcagaaaacagctcctgtccatccattcatttcttcattcaacaaatatgtattgaacacttggttttaggtgctacgccaacaactagcagcaccaataatagtgataaatagtatcctggaagagtttaaaatttagaaggaaaaataatccacaagtacagacagttatgacttagggtgatttgatttaggatttttcaactttacgatgatgcaaaagtgatacacattcagtagaaaatgtacttcgagtatccacacgatcattgttttttcactttcagtacagtattcaataagttacatgagctattcgaactttaaaaataggctttgcatgagatgattttgtagtagatgagttgtagtttaatgtaagttgttctgagcccatttaaagtaagctaggcttagttatgattttcagaagattacgtgtattaaatgcattttttgacttaagatattttcaacttaatgatgggtttatcaggatacaaacctgtggtaagttgaagagcatctgtatagtatgttagttgtatgggggtgggagaagaaagtgatgtggctataaggtggcacagtgaagtgctgggacagcactgttcaatagaaataaaatgtgagacacatatgtggtttaaaattttctagcagccacattaaaaagtaaaaaaaggtaaaattaattttaataatacattttctcaaactcaagatatcgaaaataccatttccacatgtaatcaatatcaaaacattattgttgagatattttatatatttttttgtactaagtcttctaaatctggtgtgtattttacactttcagcatatctcaaatgaaatagcaacatttcacatgcacaagactcacatatcttctgatggctatcttgtcgaatagcacaattctaggaagttcaaaagggggaacaattgcttctcaaattgatgaaggtagagaagaatggtatcagagaaactgattaagcagggacctgggaatctgagttgagttccggggcatgtttgttccctagcaccatgacctacatggcagtgtctcttctcatactattttaagagtccctggtaagtaggttctgtgttcatattcctaacagtgagccccctatgcccctgtcctatggcgttaaagaaatctttatatgttgaatgaataaatgaaagaagaatttaaaaaatagttatctacagcttggtagaccctgtgttggtatttgcatatagtctctaatacttatattgtgacaaactttcaaggagctactaacatcaccattttataagagagaaatgtgaaatacagggtggttaggggatttcccaaggttacagacttagaaggaaggaagggaggccgggctcacacctgtaatgccagcactttgggaggccaaggtgggtagatctcttgaggtcaggagttcaagaccagcctggccaacatggtggatccctgtctctactaaaaatacaaaattagctgggcatgatggtgggtgcctgtaatcccagttacttcggaggctgaggcaggagaatcacttgaacctgggaggcggagattgcactgagctaagattgtgccactgcactcctgcccagaggacaaagtgagcctccatctcaaaaaaaaaaaaaagaaaaaaaagaaggaagggagagaagaatgggacagagttacataatgggaaggaaagcatacaaaaagaggaatgaggatagactagacagaagagtgagctacacaagtgagttaagaaagtgatatgctaacacattaatgattaataggtacgaatttgtccatcaaatcttaaatagttcctcatatattataccttggacctctcttctgtttcttctgacaaggttttcttgaaataagaaacaaaaacaaatgactgccttcccaaggcaaagggtattttgggaaatctgaagcagcgttagaggtttagcccagtcttcctcactacagcctcttcaacatttctgaaaagtgaatgtccatcctccctgtgagaaaaccatctcccaagacagtccctgccactctttgataggctgaacactagaaaattcgtccacatactgatttccaaccttcccttcttataacttccaattagaagcttgttctaattgtgccttcctaaatactcttcttcattcagatatcatgtgcctacctagtctattcgatcttgtgggggaggcaggaaggcaaacattacttatgcaatactcaagtcaaatacatatggattcaaactgagtcctaaaatgtatatgtggccgggtgcagtggctcctacctgtaaccccagcacttacggaggctgaagtaggcagatcacctgaggtcaggagtttgagaccagcctgggcaacgtggtgaaaccttgtctttactaaaaatacaaaattagccgggcatggtggcatgtgcctgtaatcccagctactcgggaggctggggcaggagaatcgcttgagcctgggagatggaggttgcagtgagctgagattgcgccattgtactccagcctgggtgatgagcgaaatcccatctcaaaaatatagtaaaatgtatatgcaatttccaaaaaattaaaaatcatgtttttgtgtcatctgggaggtaagtataagaaccagggcttggccctataaaatttaatattatctcatttttacttaagaaatggacttgctaaatctgctgaccatcccaaaaaatcatcagcaacttggagagtcagctttacattacaaacaagtctgaaaactggaatgataaaaaccatgatgaagttctaacttgctgacttcttggctgtgtttggacagccacaacttccctgcctttctaaaggggcagagaatagaatgcgaaatgtcaccatttctacaattttattcatccttctttccaaacatttatttttacttccttagggtatgaggaagagcatgttctaacacaattgttctgagttgttgccaggaagtcaagtgtatctttagcatcacctctgggcaaatagtacaaacagaggaaaatgatgtttgaggccaaatgttgaaaacttgagacttgtgtagctgagctaaaagagcagagagctaaaatgaaaagttaattatgttgattctgtttttttctatgagaatttctatttaaaggagcagcagtagtgaaaacaggatgggctttaagtaccaacagctttgggttcaaatgcaggcttgtcaattgctgcctgattgagttcccttgaatatacataacaaacatttaattgagtgactcctctgtgccaggcacgttgtccttacagagcttaaagtccaagtaagttaattaccccttggaatctttttttttacatcgaaaagaaaatataatactatatgcagggctcttataattaaatgaaatgacatatctaaagttataaagcccagtgcctagcatatagtagttgcttaataaatcttagtttcttttccttgtcttcagaataaccaaattaatctctcctttgagtcaaactgtgatttaaaagcacagccctagtacatcactaaaaataaaatcaacagacagttccacacatctagacactcctaaaatacccaaaggggtttggaggtccatcagctgtgacaggcagacttcaaaaaatcagactcagatactgccccattcaaatagttctattttgactccaatttgtttttatacaaaacaaaaataaactgcttttcattttaattaccagccagcaagtatagtatatgtagcatagaaatcaaagatataaatgatgctgcagtatcagaactgctcattctaaaacaatctattcattgtctgtaatgtgtgagacattgtgatggtattagactaataaaagaaacaaacacgtccttaatctgatagagcttactctgtaggaagggagatatacatctacctttagggaggctaaacaaagagatgaaacaagacaaatatgtattaaacattagtggccaatatgctgtattacaagcattaaattttgaactagagtctctaatgtagggattcaggagaggtaacaaagtcaaggagactttttgggaaaaaagtggaatttgagcctagacacttgaagcttatggaggattattcaatgccttctattattcctgtgcataaagatcaaatgcaccaaaactcaaagcagaagccagctataataatgccttctctttctgaatgcatgtagttctgcatgaactgcttcattattcactagtacaaattttacttgggtcccatctcatccaaaaggcagcattaactactcttgggtaaaaggtcattggtttttatatctttgtagagtttttaaagacgctgttcagtccaactagcttccactgcctcacatacacacaaaagaaagcaaagagaaataaaggaagagagggagaaaatgcactatttgcattttctgattgtgaaaattcctcattcctacctcccaaacttccctatgggcaagacgtaatcacaacccagacagtggatgcttcccctcttactacccagaaatgggagataaagaaaatgtggcacatatataccatggaatactatgcaaccattaaaaaggatgagttcatgtcctttgcagggacatagatgaagctggaaaccatcattctcagcaaactaacacaagaacagaaaaccaaacaccgcatgttctcacttataagtgggagttgaacaatgagaacacatgaacacaggaggggaacaatacacaccagggcctgttgggggttggggagctaggggagggatagcattaggagaaatacctaatatagatgacgggttgatgggtgcagcaaaccaccatggcacatgtatacctatgtaacaaacctgcacgttctgcacatgtatcccagaatttaaagtataatgaaaatataaagaaaaaagagatttgatatcagaaatcttttaaaattttaaattgtacttagactgggcaaacttcagaggtgagtactctgagacagggattcatccatactccctagccacatcactgtgaagccaaaacaaccacattccattcttggcatggaatacaacatcctccccttaaagtactgcacatttatcttcagctaagttgtgtacatttgttcactccaacctttaccttcttccatctgaagtgcttgatcagccactgaggaatcgacttcatgggaattcatagtccaaaattatatggcctgctgtacatttacagctttcttcaaattctccccgctatggagaggagccagagctttaatcaaattccttcccacccccacacatccccaaaagtataagagcctatattctaaatctaccacagtcaacttgctatttatttcatttccaaataaccatactctaaccataattcaagaaaaaggaaaaaaaaaagacatacttcaaaaaaatacctccatgcccttttttttttttttttttaaagttcagggttacatgtgcaggatgtgcaagttttttacatagaaaaacatgtgccgtgggggtttgttacatagattatttcatcacccaggtattaagcttggtatccattcattatttttcctggtcatctaattttacctctcctcctctggtaggccccagtgtgtgttgttcctctctatgtatccgtgtgttctcatcatttagctcccacttataagtgagaacatgccatatttggttttctgttcctgcatcagtttgctagggataacggcctccttatctgctaataacaactaaatactgttagaaggtttgtctctgacagtctcagttagtaaattatattaaaataattttgaaatgcagttttttttctgttctaatactttaaaattggctgggcgcggtggctcacgcctgtaatcccagaactttgggaggccgaggcgggtggatcacctcaggtcaggattttgagactagcctgaccaacatggagaaaccccatctctactaaaaatacaaaattagctggcgtgatggcgcatgcctgtaatcccagctcctcggaaggccgaggcaggagaatctcttgaacctgggaggcggaggttgcggtgagcccagatcgtgccattgcactccagcctgggcaatgagggcgaaactctgcctcaaaaaaactttaaaattatccagatgccagaatcagtgaataatgatcaatttgggtcttgattacatctttttttcagtatctaatgacactttgtgagtatcattgtagcctactgagcactatacaaggtgaagtacataaatccagacttggaagcttacaatcaaattgctttaccaataatgtataatataaaacaactccaccctctctttaccctgcagtgatagagtagataaggtttcaaatagccccaaagggaacttattcccaatgagcttagatcttattttatacattgctaaaataggggatttgtaacagattaatgtaggattagaatagtcacaggtgttctctcacaccagagaaaaaagtacaaattagatgatatcatctcactgtctattttggccacaaactaacccttcacttctcaaaccctcagtttattcttctataacttgggaatggttctacttgcttcttctatcttacagagttatcatgaccctgagataatgatttcaaaaatatactgaaaatgatggtttccaatttcatccatgtccctacaaaggacatgaactcatcattttttatggctgcatagtattccatggtgtatatgtgccacattttcttaatccagtctatcattgttggacatttgggttggttccaagtctttgttattgtgaatagtgccgcaataaacatacgtgtgcatgtgtctttatagcagcatgatttatagtcctttgtgtatatacccagtaatgggatggctgggtcaaatggtatttctagttctagatccctgaggaatcgccacactgacttccacaatggttgaactagtttacagtcccaccaacagtgtaaaatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggcgggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaacattaaaaaaaaatatatactgaaacatccaaaatgccagacaaataaaaggctgtcttctctcctagcttccttggattcttgctctttctccacctacacaaactgttggcaggaccctcagcaagatgtcatcatgcacctgtgagcattcatttcaagaacagccaaccatttatctggaaaatcagaaaccacagatagggcagaagacctgcatgcccggatccattctgtgcaatttagttttttgaaaacaaatttaagattccatgcagaaagcaccctgaacactgaaagtatgcacttcctttacaaagagcagctcaacaaagccagctgggtttagcaaccccatttctttctttctttccagcactttgcatctatagatcaatatgttgtcattccagaactttcactaccttattctatctttctctcaataacctgtgaggttgcagaactttcttccaactttcacttattgcatttttacctttagcctacacagtgacctgaggtcaaggcagtcttcctaatcaagaagccccttcccctaaagctctgtagatttcagagcccttagaataacattccaactccattccacggcttacaaagtccatgagatcccacttttggccacttcttcatctcacaccactttctccttccctcaccagctttcagccatgttcactttttgattctttgcatatgcgacaagcctcagggctcttggacatgctgtttcttctacttgattagctttcccaccaattcttgtatggctggctcattgtcattctttatctcccagcttatgtcatctcaactgaaatcatctaaagccatctcatcattatccagtatctcaacctctcttttgttttcatcatagcataatttatgactatttcttttcttttccttttcttttttttgtttttttttgagatggagtctcactctgttgcccaggctggagtgcagtggcacactcttggctcactgcaagctccgcctcccaggttcatgcctggctaaatttttttttgcacttttagtagagacggggtttcaccgtgttagccaggatggtcttgatctcctgacctcgtgatccgcccgcctcggcctcctaaagtgttgggattacaggcgtgagccaccacacctggccaatttatgactatttcattttctgttttattcatgtctcctccataaaggtgtaagctgaagaacagacactgtgcgtggtcagctcatgattagagctccagtgtgtgaaccatcactcatgctaacatagttgatgctccatgaccatacagtgagtgcgtgaaaaatatacatggagtgaaataggcaatttgagtatgtacactaaattctgtttcccatgtgcatgtactagaataggaatgttgattaacttgttttgaaaaagaattcctccagcaagtgtaaatctaaactatttttgactaactttgggagctccagacctgtactgtgcaacacagtagccactaaccacgggccactattgctcacttgaaatgacaccagtctgaattcaatgtgctgtaagagtaaaatatacactgagttctgaagacaacatgagaaaaagaatgtaacatctcataattgtcattttgattacatattaaaataatatttttgatacattggattaaaatattaaaattaattttatctggccaggtgcagtggctcacgcctgtaaacccagcactttgggaggctgaggtgagtggactgcttgagcccaggagttcgtgaccagcctgggcaacaaggcaaaacccgtctctacaagaaatacaaaaattagctgggcatggtggtgtgcacctgtaatcctagctactcaggaggctgaggcaggagagtcacttgaacctgggaggcagaggttgcagtgagccaagattgcgccaccacactccagcctgggcgacagagtgagactccatttcaaaaaataataatagtaaaagtcaggcacagtggctcacgcctgtaatcccagcactttgggaggccgagacgggtggatcatgaggtcaggagtttgagaccagcctgaccaacatggtgaaaccccgtctctactaaaaatacaaaaatcagctgggcatggtggcacgtgcctgcaaccccagctactcaggaggctgaggcaggagaatcgcttgaacctgggaggtggaggttgcagtgagcctagatcttgccactgcactcgagcctgggcaacagagagagactctgtctcaaaaaaaaaaattaattttatctgtattctttattttttttaaaagtagctactaaaaaattaaaattacatatgtggcttatgttagatctcttggaatgatgctggtctagaatattcctctattctctcatcatttcagagttaatctgattttaatgcttatgactttttcttaaacctgcctataatggtatatattgagagtgaaaaatatttagaagtctcaaagccactgccttaaattcttatgttattctacagtattcttatctcatgcagatcttagaacattgttcaagtatcataaactataatacatcagactatgggtgggaaaacatcttcatataattttagaatcattatttacactactgttcaaatcctttaattctacttccagagctactaccatcatctaggccaccgtaatctctcaactgatctgtatgactgaagtaacttcctaactggtcttctacctctatctcattgttttccaacaatagacagtgtaaaagtcttacatgctgccttcttgcttgacctgcctgtagttgtccactaaccccaggataaagttcaaatcttcaattcagcctttaattcctgacataatagacttacttcctcctcttgcctacttcctcctcctcttaggctcctcacaccagtcattctgaactccactgttctgtaaaggtgccatgcttcttttggtttttggattttgctccttttacagaacccacatccattactctccttttatctggtcaacttctactctattctcagcttaaggttagaagcagcaggtgtgtctggtacataggtgcctgccttgcaagggaaagcatctcctggcctccaggaacccaccacagggcttgtgctctgttggtggtggatgtagaacacaagccacatgcccaaacctaggcgtgcactaagcactctccacaattctgccactgaatcctcaccacaaacctgtgagcagacagcagcagcagcatttaagtcctgtgtgccaagacttgtttcaagtactttaaatatattttctcaggcttcaggaaaactccctaaggtaggtatttactgttttcctattatattattctcttattatccaattcattgatggggaactaaagcccagatggatttagtaaatcacccagccccatagcaggggatacgagctcctgcggcttggcttggcagcctatgttgacttgtgcaggtgttatcaccattttagagatgaggaaacaaaagctcagcaagtttagggaattttcccaaagtcaccatatcaggatttaaaagacaagttagatgccacatcatgtttttcccaatagctgtccatactccgtcattttacctgcgttacagtcgcctaccaacttactggctccccctactagactgtatgtttcttattctttagttttttttatcttattaacagattttatttttaaaaatagatttagattgacagaaaaatggaacagatagtacagagagctcttctatacctcttgcaggatttctcctattgtgaatatcttatgttagtgtggtacgtttttataagtaatgaagcaatattggtatgtaatcattaaccaaagtccatagttcattcagatttgcttaattttctaatgtcctttttctactctaggatcctacccaggatagtacattacagttagttgtcatggctcctcaggctccttgaggctgtggcagtttctcagacttaccttacctttgatgatcttgacagttttgaggaatagcagtaaggtatactgtaggatgctcctccagtggaatttatttgatgtttttctcgtgattgaagaccacagagataaagtgccatttccatcctatcacatcaatcaaaggtacctatatcaacatgccttattttcatgttggacttgatcacctggctgaagaaatgtttgtcaggtttctccactgtaaagttactcccctctcctccaaactgtactctgcacccttagaaagaagtcatgatgtacagctcacccttaaggcttagggagctatgccaacttgctgtcttccttgagggtatgttatctgcacaatttatctggagttctgcatgggagattttctcctcctctcctatttattcaattatttacttataccagtatgaatttatgcatattgattttatactttgggatagaattcaatgctatattttattgctcggattgttccactttggccattaggagctcttccagttgatttcggtgtccttttgacatacctccatcagtgcaggcttttttccttttttttcagtacttctttactttctggttctataagaggctccagactcatatacttcctttgctactagtagcatcagacatttcttcaagaattcctggttccttttattaaagaatggttttagaaatcaagatctgggtgctagttgctactgggatgccatttcttttaggccctctcagctgacacagaaagaaatatatgtgtgcatataaccctatgtatatctacataaatatttctatatgtagtcacttgtgaatatataaagttaagcaggggttcttgttgatgtctctaactttaattcattaccacatgtagcattctaacatcctcctcttgcttatctgtaaattctcactccactagtgagaaatgactgtaagcttcttaaaggcagaattagtgctttaatcactgctgtatcccaagtatagtgcttggcacatataatgtacatgttgacttactgttgaatttactccataatctcaattctggaagggactacagataaatttgcaaatgttacaaaatacggatttcaaagactaaaatcacaacaatttattagggcaaacagtacaagagggtgcactaacaaaggtctgatttaagtgcttttattcaacccagtgaagggaaaatgacagtaatacatctaagccatgcaaaaaggattcaggcttccttgaaaaggattcaagtggcataaaatggtttgtttctccacagcaatttacatttattaaaatagataataggcataatcattgtcaaaatagagcttctaccctgtataatatcttaatacatcctcgaagttcctgacaaacaggcacaaagccatggcagattagagtctaagtggaggatcactccaatagcacagcagaaaaaccaatctcacacttctaggaaggaaaataagacctgagaacagcctttgaaggtggagggtaaagtacaaagggaaaggtgctaaagtgatgcatcagctggaagtataactgggctctaatgtgacactctgcattaacgatgctaatttatgtctgggtaagcgtgtgtgggtgacacagaggaatttgaagaggtctatattataccatgggggagctcatcttgaatcttttgccagggtacatgctttatgcagggactgcttcacgtgggcatatattatgtacattttgtgtcagtttcatctgagtaaatcacgtgtctctttagatctattctagaccctttccaatctattctttgcactgcagccagaatagtatttttgaaaagcaaacttggtcactttccccaatcttccctacatttaagcatttaaatggcttcctgttactcataagataaaaagcaaaaatggctcatatatttttgcaagactctgcaagatgtggcttctgtctaatgtccatcctgtgggaacttaagccacactggccacctttcactttttgaacacacactctctctactgctactaccataaagcccttgtacatgcagttctccctgcctgggtcatcttcccatctcctcttcaacagagctaactcttattatgactttcggatttagcaattattctttcaccagggaagccttccctgtctaggtccaataatcctcttattacacactctcagagtactactaactccttcagagtgcttgtcacggttgcaattgtacatttatctttattattctttattaatatatttccccagagggtcttgtcactccatattcctggtatctaaccccatagctggtatacaataagtgcccaataaacacctatcaagtaaatgtctgaaaaatgaccacgcaatctatccatactgctgtaaagactttctagaatattaaagtcctctttggattcagaagaatatgtcacttcacataataaatttgattggtcaccccaaggatgagtaaataaacatcactgccaggtttggtagtttccaaataaacatgaggtcctttttatcatatcgaaatgaatattattcaatattacatagaagtggacataagaggacatgaagaaacaatctcatgcagtaaaggttcacaatggtgccaatcatctcctaatcctgtccctcagagatctgtttattaagtaatttttctttatttcacaatatctcaaatgctactattgggctcaagctctcatcattggccttggatttcattcaacatttaacaaatatttactgagcatatttactagattccaggcactgtgttagagcctgggatacacactaggcaagagagacaggtgctcaccttcaagaagagaggataaccaacacacaaatgagtaaataaaatgattgctgattgctattagtgctaacaaggaaagagatcctgttccatgtgagtgagatcatgcccattgcttcatcatgattgtaagtgatccaaatgcctcactgggataacctgcatcattattgcttcgtggtaccaggtagatcacagtcttttctttttacttgatgaaggagtaaagaattttctgttttaatgccatggtttcctataagaatttaaatatactcactttctcaaattaaataagtgtaggcaaaacacaaggtataccttttctaaggagtcactataacacctcaaaatctctattgtcagctttgatgcaccccaaaagatcaaagtgccttgctctttaagatgcatatctcaacagagcagctgtttcatttcaagagagtcttcattttttttttagtgataagtttacaagcagttgttagtggtacagaaaatcttacgacatctgtggagaagttgtaaatttttcagattgggttaggattctcttgataatcattaaaatccttgaggtctaggatagcatttggagcataatttgacctcaattatgtgttaaatgtttgctgaagaaatggtgatgctttgagaaaattagctatttgaagcatgagaccagagtggagctgaaagaaaaaaattaaaattaaagtggctcacttatcaaaaaccaaagccacagagaaaggggaccaataacagcatcctcttcattccattttgattaaggctgcaggcttatgaggggacaggaagctgggagaatctcaagaaaagaaaatgcagtccctaaatgccacagctcaagaggaatgctccagcctactgtctccaatggagaagaacaatctgcagattgacaaagccctctgtttacactcctgaacaaataaactaatcatgcctttgtttttaacctaacaaatcatagcctgattacaggtcattagtgaccattaatatgtgaaactgtttgcatttcactagtatatctgaataacagtcttgcctttcacactagctcagtcaagtttccaaaaggaaagccccgttatcaggccacgagcaggacttaaattaacaattagcctctagaatcgaactatgatgcagaagaattcattattttggttcattgtggttccgcctactgtagaaccagtctttgcctttgtagtggagacatgctctttgtgccaaaagattgtgtgaccacctctctccaaacattctcaacaattcccaatgactgctaatgtgttggccagcaacatgaacctgcttatgtgacaatagtatagacggtcctaagttcacaatacgatggctgattagagtacagataaatgcagggagcacattgggaattatcagaaacatagaagtgacaggaaaaaggtctatttgacaaaaaagcggaggcagagtagagagtatgtatacctgagtgaacctgataatctagaatttttaaaagtgcaattagagctttggattatcagcattaagaggcaagattcttcaaaggaattggataattgccaagcctccatttcattttgtgctgagcagtcgtcacagaggggcatggagtgattaacagagattaaagatctcaggaatgtttgagaactttctaacatagcagttgccatttaggagcaaacccatggtccaacttatctaatgttctgttgcttcaaaaaaatgtcccctaggaaatgccacttttgactactaatgtgttgaggccatagaattagaggcattgctaacaaatcaagaaatggcagcccatatattgctgcaatcatttttactttttattctggactagctaccaaccacgtgattcatgccccagtttaaaatgcataatgatagtatagagttccatgtagtttaaaaagtccttttaatccattatcctgctcatctctatatcagcttatgaaagttagattatgaatagtatagtaatggtgcaaaacacaggttctaagttaaacttgtctgttttcaaatcctggcttttctactgctaataaggtgactttgagcaaatttcttaacctttctgagcttctttttgcttatctgtgaaacagataataatgatgcctacctcaaaaggtgatttcaaaaccctaattgagtaactaatgcatgtaaagggcttagtacactacatggcacataattagtgctcaataaatattaactgctatcattttttttttccaccagcagcagtatccactatggccaccatctccatcttccacagaataaggaaaataaaatatctacgatagactttttcctgaagtcacccaattactaaataactgaggtgggactaaccatcatcttgactaccattctccctgcttggaatacttttcattcttcttccctcctcctcatccttcaggtctcagtttagccatctgcttcctcatgagccctgctctgagccctcttatgtcatttcacattctcttgtacttcctccatcagagaacctctcattctgcattataattgcctgttgtcctgtatgtgtcccctactaaaccacaggttccttaacagtagagaccaggtctatatactaaacctttgcatccccagcaccgagtacagcaccagacacatagtaagtgcacaataaatacttaataagtaaaaggatggatgccagactcttcattcccaatctgctgacacacattaaattattatttcacactggaatggattttagaaaatcagagagagccctacaaggcttcatgtcttatactgctcttaaataatcataatctcatgtcagaaattcaaggcaatttttaaaatacataatatgttacatatttatggggtacatgtgatattttattacatgcatagaatgtataatgatcaagttatggtattcgggttatttatcaccttgagtatttattatttctatgtgttggggacatttcaaattctctcttctggcttctttgaaatatgcaatacattgttgctaactacagtcactgtactctgctatcaaacattagaatttataccttttatctaaccgtatatttgtacccattgaccaacctcttttcatcaaggcagtcttaaccagattctaatagattcaatttctgaagaaagtaactaaacttgtgaaaatgacaccttgaagtgattcttacattatattaaaacacaagcacgtgtgtatagacacacactcaccttgtacctcacactgatcgctaagctgtgcacaatacttatatagtcaccaaccctccaaatttggagaagggcactgtctttgtactttgaagggatttttcagaaacatttggacttgatgaggcacagtgaaaagcaggtatttatcctggctattcttcacgacaagctcttaaaatttggactctgaactgtctctcgcagtttttatgtttttagaaattttgagtctgatatgacacaagtcgtaaaatttgaccaaataacaaaatacttccattttttttctccctccatcttggaggaggaatagggggcataaaagttggaagctccagggaaatccactcaaagctattcagtttcatctcattaaagtaacatcatcaagggcaaaccaaataaaactcaaacccccaatcaatattatattagaatgcactgaaagtgttacttagttggtaggaaggaaaaaaaatcgtacattgaaattacaacagatgtaagccttttattcaaatagaccagagagcaaaaggtaatttttcaatagcaagggaagagctgaactctacctcacatcaccaacactatttaaaagcaaaacctgctcttattattttatataaaaacacatttaaaaatatcacctgcatggagtctctataaatgcataatgctaacattgcatagttcccttaggacacaaatgcctcacacatctttatccatagtctgatggagaatattcacaaacatatatgcatacagacacaaacacagtatacatacacatacacacatacctgctttttgttttcttccctttttgaactgtgaccaccttttaaattttattagctctatgataaaatatttatctagagcctttttccctcttcgttccttttattaaagggagctcttctcttctgaatgttgtactctttgatctctctcagggttcatacaaactctgttacaaactccacctctaaagagaatctctgatgattctctttcttaaatcaaaatacagttcttttgtattaaattttattttccattatcccaaaatatagccaaatgtggaggctgtaaagctaaagcctcaccacacactgtatcgagaaatgaataaaaaagcctagcagaagccttcatgctacttcatccaaatcaagtgtaactacttaggagttaataatgaaagggctttagaatatttgatacaggtgagaagttgtttttcctacacagtgatttctagatctattttctcattggaaattacctgttcagtgataccttttattcttcgttatattcaaagtaagatgcccatattgtctttctttgcctcttgaccccaagctctttttctttgtgtcttgaccccaagctctttttctttgtttgagcagttaatatatctactttgttctctagcttattcaacaaacctaacatcaataaagcaggctctattcttgtttagccaacactctctctcctggtaattttataaccagttatatcatccccatgtacatttggtcaaaatatgttcttgttcttaaaacagtaaatcaaactatgcttcctatgtacaataactatttaaaaaatgtaaattaacttgtgtcctacggaacaaattttaagcaactggaactatttaaaaaatgtaaattaacttgtgtcccacggaacaaattttaagcaattggaactatttaacacttctatactgctactttatcaagaagagtaggtataaataataatacgaatacctttatttccataggtgttttcatctggataattcatgcttcattattgggccactattctctgtcttgggttctcccttggctcctgtgacaaacatggggttcagatccagactccaggaggtagtgatgcttcaacttttggtaacatacaggtgcatttacatactttccacataccccctaccatctctttgggagagtttgctccaggcctgtcaaaatccaggctaacaaggtaacacaatcaacactgtaaaagcttccttgcctcagccccgtcgacctgaagtggactgcctactcacttgagaagacagacagagagccacggtctcaaagtgttgctcctgatcatcatcagcagcagtaggattacctgggaaactgaaaaaatcaaactcacaggcctatagacctattctaagcttgagggggtggagcctggaaccttgtatttaacaaatacttcaggtgattctaatgcacgttaaagtttgaaaacagctgctgtatgacctctagggagttttgaagaggctgtagtgatcaggagagctggcttcatatagccaaagtagggtcctgtggacaggatactcagcgtttggggtagggttttatggtgcagggctaggagcagtgggtgaaagagaatgctctggtgcagaacaacttctatgcaataggaactattcaggagcagaagtaagtcacctcactcgttagaaatggccccatttctctgcaagcgttcagaagtatgaggttatatcctacgagaaactatgaaaaaggtgatataagaagaaatattcaaaataaacgtgtaagattaaaaaaaattaggccttaatgggaagcttcaacataccactaatatagaacaaaaggttcataattagtccattattgttaattttttagtatcttaaatttattatccttaaatatcctgctgatggtgcatggagtagataatgagttttagtttcctcaatgtttcatttcatattcagaaaaagaatccaacctaacagattatttaaaagagataaaatcaccaccagccagtactgatactggatcaaagattaaggttagtgtattaacttatttgtcctctgttttgtaatcaaaacaactgtcttctaacggtaatatcttaagacatatacataactgtactaatttttttttttttttgagatggagttttgctcttgttgcccaggctggagtgcaatggcacgatctcggctcattgcaacctccgcctcccaggttcaagcaattctcctgcctcagcctccctagtagctgggattacaggcatgtgccaccacacctggctaactttgtatttttagtagagacagggtttctccatgttggtcaggctggtctcgaactcccgacctcaggtgatccgcctgcctttggcctcccaaagtgctgggattacaggcataagccaccatgcccagccaactgtactaacattaataaaaatacagcttaacatttagcaattactacctactattttcctgggactgtcatgagcacattacaggcaccgtcacttttaatacttacaatagccttatgaggttaagcattgttatctttattttacagatgaggcacctgggcttagagaggttaaataacttgcccaaggactagcaagtggtggagccaggatacaaacccagtcatctccagagtctgttttcttgactacttttttcatataattctaaactctagggttgggagggtaaaaatgtatgtggtccagtgcaaataatacttatgaccacttaagtcttctaaaactactaaaaacaaccaactactcactgaatgtttaatctgtgtcagggactgaactagccatgtacaagtattatctcacttaatcctcacaacaaccatggaaagtagttactactattgtcttaactttacataggggcaactgcagttagaggatttaagtaatgagcccatcttcttatcaaagatttcactgcttacataataaaatggaaatgaggcaaaaaaaatacacacagtactcagtaaatgttgtttactagtcactagtaaattagtgactagtttctggggatcagaatggtgttggtgatgatcaatccattgtttttcttacctattttcttgctcattccaaatggtagatatctgtgagttagatacttgagcgcaatatacagccatgacataaaagtaaatccactggcttctctatgtctttattatcaccaaaccctagtgctttaaggcttgcaccactgtccaggaatgtggttccagagactcttccacttggcaagagtaacaatgagtgactttaggaatgagacacaacccatgcccaagccccaaaatcaaaggtgtaaagcacaccaagttgttccacccaaagaaccttgttctaaaaatgttagtggtcagtgtcttacagagagtcagcaagcagatgcacttttttccaagactataagatttcatctagttgggagtttattgatttatctgatattccaatatcatagaaagagctcggttttatgaatcagtctctaaacctcagtcttttctccaccataaactaggtatgtgatcatagacaagttgattaactccactggatctcagttttctcactgaaaaaatgagaataaaggaaatttactctttatatttgttgagcagagtagataagagctgtgaaaatgctttgcagaaatacaaaacccctcccacaagtataagatgacattactattttacataactccttccttgcctaatatttagctgctaatgtatcaacctgtttggagaagttggtttattgaagaactaatttaaaagcaagaggaaggggcaattcttaagagttgaaaactatcagcagtgccaaagacaactgaattgtttgatcagttgttttgatggttaagagggagtaagatatttattacctgggtaaccaaataatgtgcatgttgcaaacccctgtgacatgcagcttatctatctaacaatcctacacatgtacttctaaacctaaaataaaagttttaaaaaaagagggagtcaagagccagtaagcgtggcaaaccccccagataagttcatgttggtatgaaatagcctgagaaacctttctgtgaaagcaacaaggaatatcacaaaactaccatgtaaatgaacaggacataaatagcagctcaacaacatgggctctttgggtttctattcaaatttcaaggtgccaagtctcttgcttgtctacatcagagagtagaacgtggcctatgtatagattagaacatcagggaaaggaggtagtatgaaggacagttttgtgtagggaaaaaaaagaaattctatctgaagtttaccttggagagatgaagaaaatatggtatttagcactattaagtgtttttccatcttattggagagattcaaccaaaaggtataagagcaaaaacacaaaaatcaggaaaacaatttttctagtgattttacctttatcttggactatggtttcctctcaaggtatctagcagattaaaattgctttgtgatgtggcaccaccatcctgcttttccttttatagctctcatcttaaaacgttttacaggtccacacaaacaggtaaaacaaaagccatcatgctattttaagtatacattttccctgggcctatcaaatttagaaaagcatattcactctttcaagttgctagttgtggcttgaactgattgcttgattaatcactcaaactctggctctagaccatcttacccatgttcccttttcagtatatcaaaaacagaggtcatgagattgcttagatcatgaaaccaagaaaggaaatcaagcctttgacacagaaaacacaccacactttctaaagcaagatcatcttatgagtggatggtagtattctcctatgtttctctgacaaaatgtacccatactctgtctttaacagcctcattgccatacactacacttgacctgctgccccatatgcagacctctccagtaggtccgatagtcactaatccactgactaaacattttaaaactggctttggcaaaacatgccagaaattccttcagggtaattaaaaccaccctctgtgtcaataaacacagactgaaatctttcatgtgcagaggggctggctctgacccactggctctaggacattttttcttagatgagttttccatcattgcaattgattttcactgactcatccagaccgttgctcagtccccttataaaatgattggctgagatcagagatatagtcttagctttcttgtcgcagccaagacataaggaccaaaggggctataaatctaagggccaggctcattgctaaagccttttcacccagatcttcaggtgacagaccttaaaaaggattcttgctatagaagctgacagtcacagtgttcacttatcactcctcttccagcattcaaactgaattttttcttttttttttttttttttttgagactgagtctcctctgtcgctcgggctggagtgcagtggcgcgatctcggctcattgcaacctctgactcccaggttcatgtcattctcctgcctcagcctcctgagtagctgggactacaggtgcccgccaccacgcccggctaatttttttgtattttttgtggagacagggtttcaccgtgttagccaggatggtgtcgatctcctgacctcatgatccgcccagctcggcctcccaaagtgctgggattacaggtgtgagccaccgcgcccagcctaatttcctatatttttagtagaggtggggtttcaccgtgttaaccaggatagtctcaatctcctgacctcgtgatccacccagctcagcctcccaaagttctgggattacaggcgtgagccaccgcgcccgtcgtcaaactaatgtgtcttcaaagtaaaaggaagaactcaggtgaatattcgctacattaattcccagagactagtcacatagcagacactccatgaattgtttctcaccacaatggcagccttactgtttttattatataaacaatgtatatatttatttaaaactgtcatacattataaacaatataaaaacagtagaagttacctaaaatttcatcagcctgagttatcaatatatttttgttgccatttttccatggaattctttgtctatacaaataaaattttatataagagaaatcatactttacataccctttttatcatggatgaagctacctttgactttctttaaaatacagcattgtttttttttttttttggcttgctgctttcatccccctcatagccaatattaataaactttcacataatttttcttattgatattatcatgtaataactcatataatatgaatgaagtttcagttgctcagtaaatacctgctgaatggttaaagagtgaaagaacacacgcataaacacgagtgaatgaaagaataaataatctattatgatcttaattagccagtacagtttccaagtgattgcagaaatctcagatcacatcttttgacatctcccctgcatctttaaactttagttggggtaggaggacctggctttacctcattcagagggacctgcaagtctaaactcccaagaaaagaatatgtaactggctgctctcctaactacagaaatgctgttaatctactctcaaattgaaatcaaattcaaaaaccattactaagcacctgtgtgccaagaaccctactgtcctttgtatggtaaactagagggaaagatgtggtcactgccttcttggagtgtctgtcttgttggggagatgacgtgcaggatctgtgtctttagatctagctgtctgaacttggacctcagttgccacattcgtgaaatggggaaaatatctataagctcataggattgctgtggtgatcaaacaacttgaggaattcaggaaaaacttcacaggaaaatgtggactggaggcaggccttgcaggtaccagggaaggggaagcaggaatggcctggagtagtgaggacccagcacaagccagcctcaatgctttgaagatcaattaggagagacttaaaagatgagaggacaggcaggaaacatgaaggtttataagcacaggagaaaactgtgaacagactaatcttcttaaagggtcaaagaaaagtaaatttttttttttttttgccttttcagcatgtgccaatgtctacatcaaggccattcatatgagtgactcaaaggcaacctgcttgtcaagtaattggaaaaaaaaaaaaaaaaaaccctggcttacataatgggctcaaatccaagtttctaagacttataggaaaaattctgatcagaaaatttccatctcaaattgtgctgaggaagcttgaggactgagtaagcatgttgccagctgaagtacaatacgataatcagactgcttttgcttttttttttttccacagtgcacagagatttgtaggtcctggtgggtgcttaccaagtttctgatctctgaccccagaaggggtcagagaacctacagaaaaatacatcttgttcacaaatggaactgcacccaaaactttccctctatatcctattaagtgaccagaaggtcttgacttctaaaacatagtatgtcagtttcacccaggctaatcctacagaataggaaaagggattagaaattagtcattgcaggatatgtcagctggaaacactaaactgtcctaatctcttctgatagttcagggttctagggaagctcttctctgcctgtcatatcttctccttttaaactggcaccattgatgagttccagtttgcatgtccctacagatctgcgctactctaattaatcccacctacccttggctccaagacagaagaggaagaggatgaaaagtagattttaatattgcacccccaaatctccattgaaacttggagtttctagaagatgctttaacacttttagtcctctgagaaggcaactgggtcacctactaaccaccacaaatatttatccattcaactgcccatccatccatctatccatccatccatccatccatccatccatccatccatccatcctttaaattttatgtgcttatcctgcgtataatttttaaaatattgtataaacttttttaaattaaaaaaatgcctcaaagagcttaatatttttatttcaataacccaagacacttcaaagaggaagaatgttctaaataaatactcaggctaaatgaattgagatttcacaccgactcccaactgtaacccccaaagactgctgaaatgcagacagccaatatactttgaaagtggactaaaaatcgctcactgaaaatatggacagaacaaaagtggaaaagggccatagcaattacaaaggtattccttggaacagcgattttagaaggaaatttattcctatcatctagaaacataattgttcataccatttaatccagtaatcttgcctttagaaacttgttctaaaaaataaagacacggtttagagtcatgccattatttatctatttcacaattattacagcaatattggaaagaatctaaacttccatcattaggtggctagtaaaattatggttcaactatagaatgttaactacagtggtaatttataagatttgtactttttatttagattaaacaatagtgccagttttgggagaagactagagatgtctggaagtctaaagtcattgatagttaaagtctaatttttttcagatttgcctgggttcaaatttcattcaaccacacatagtattaaccaaaaaaaaaaaaaaaaaaaaaaaaaagcacagctttccgaaatgtcaaatttgtaccccatgagagactagctcattaaacaaccatactggttgtcatactgggtcaatcattctttgaagttacctactcaccagtttgaagaaaattaacatttctgggtcaccaggttccatatactcatctacaaatgatgccctggaaccatgaaagtaattttatttaatataggtgggcaactgaatcccagggtacaaactactcacccatgtgcttaatggcagaggctgagaattgagcctgcctctcctctcagaaagggtcgaagtacctggagctttgcggggtagaagggcaatgggatcaaattaaaattcaatggctgtatctttaagaattttttctctgatcttcaccccacataagtttcctaggataaacttaagcaccttgaaaatttgtgacaatgtgaggtggaagcaaaatatggatagaacaaaagtggaaaacgcctacagtaattacaaaggtattccttgggatagccattttagaaggtaatttagtcctatcatctagaaacataattgttcataccatttaacccagtaagctacttttagaaacttgttctaaaacataaccaaagacatgatttagagtctataacataaccaaatacattatttatatatttcagaattagtatagcaaatattggaaataatctaaactttcattattaggcaacaggcaaaattgtggttcaactatagaatatcatagaaaaatgctaacagtttgtgtctggggcaaaagcaaacaaacaaaccctatagatgatgttgttttgcatagaatcctagcattctccattcatctctctctttgtctctgacacacacacacacacacacacacacacacacacactgagcctggaaggaaatatagcacatcaaaaatgtttataatgactgtctctggcacagctagaagtaaatttgattttctcttttagaattttctgtacagtcaaaattttcataatgaacatgtactttattctcttaaaggatcttccttctttaacaggtttcatattcatattcacgtgtgttttttaacgtatatattcccaatagaaggcaagttctgtgagagcagggtctacatttaatttttaaatattttatacctaggttttttagcacagtgcctaatatataataaatgtttttaaaataactactgagtgaactattggacagacactgattagaagggatatggctatgtgtgaggactctaatgagctgtcaaacattcattccattacatctctaatctccagctcacttgttaaaacaacatgccaccttcctcgcatacttttgcctcctaacatcacacaagactctgcctccaatgaggaaagccattgccacccatctctacctgccagcatcctaccaaggccccacctccccacttaaccacttctggtgaggtgagcttccctctagcacttactgcagccactcacttagacgattaatactgtttggacctctattaggttcccggtactcttctagaacaggggtcagcaaatgatggtctacaggctactccttgattttgtaaatagagtttcactagaatacagccatgtccacatactacaatggaagaattgagtagctgggacaaaggctgtatggtcagcaaaggctaaaatacttatcatctgaccctctacaggaagagtttactgatccctgctctagaacatcgacataattttacaaaatggagataataccaaagtttcattctattagaatattcataggcaatatgagatccaaagtatatgtccaataactttgtacagaaaaattattgtattgtacgtcagtttgctcttaataacatatatttttatgtcagacatacctgcattcaagtcctgggtctgctgattgatactgggaaagatgacacaaattctctaagcctcagttttatcatcagcaaagtagaaatctattttctctttcactccataagtgtgtaatgagtgctttttcaccagatactatactaggagatggataaacaatggtgaataagatctaaagtctcacctaattcagctctaattatacatacttttgagggttgtggtgaagattaaattatatatatatacacacacgcagatacatacatatatatacacacacatatatatgcacacagaggcatctatatcatatatacatcatatgtagtataccatagatacataatacatagtatatcacatagagtacatccagaatacttaacctgattcctgctacattgcaagcactcagtatatagtggctcttcctcatgatcataattacagcagaagtccttttaacagacctccaagtagctgacactccaagaagaaaaagtgccttccattctttctgtaaaacaggcctacaacatcctttataagtactcacagctaattgagtagactaatctctggtacataggcaaacttctgctccttcaggttgagttgcatgtttactgagagtcatttgtgtttgtttccaaatctcctgatgcaagttatacttgttagttaattaaatatcatgaaaggtaatgagaagaatagtgttaaaaggaggatgattgtttcatatgaaaagtcagttgaagaatttcaaaagacttgacaaagcattgtcaaattaaaagtaggagatataaaaattggggaacaattacaaaaatctagaagtattctgtagtaagattgcttctgcgatatctatggtcttgttcaacctcaaggaaatcaaaattgggcatggtctttgtcatttgggggacagttcatgcaagaaaaatattacaacccctaatcagcagatccatactcaaaggtaaggtcttgattcttcatcgggcctttcattgaaattagtaaatttaaatggtatgttattttttatgactccttgccttaacttttcaagtttactgtcaactattggtcccaaatgcatggagtagagagggaatcttttgtatttatttatttatcacatataaatagtaacatgttgcctcatcccctgccatatttttgttggcaagaaaacactcagcaagatgaagtgacctgcccaaggccacagaactagcatagccagaggtgtgtctagagccaggtgggctctgattccaccacttcggccacctcatgataacagagagataaacaggacacagtttcacgcaccctggcttctgtggttaattatattttgagaaggacggagtgtcacctgcccaaatagatggaaagacatttgagaacaagactataggcttatacttcaccatatgccccagaacttcctacatagcacttggcaataaataatttttgtttgaattgttaaattttctttcctactttataatagtggaagaaattggggccttcctggtttctgaaaaaattatgctcccttggagtttataacccccaccatggagtataaaataacaggagagaaattctattgtgcctgtcagatcatgtcattgagagcttaacctcattgattggcacttgctcttccccatcagtgtggcaagatgagcagcaccctgctcaccagatggttatttgttccaccagccacctttgctgagtccctgattcactccagcccaggactgtctccagcattcatgctgcaaggcagctcctgccaacaactttgccaaatggctcctctcaaagtcatggctgcccagacagactggctcctccatctgcagcagcttttggcaaagagaagtttccctttctggctctgcctcttggctgcaccagaaccttcttgccagaaggatgatttgacccaggaagtacagccagacctggaatttctggggtcatttaaagcctatggccatgttttcccagtctcacccctgaggtgaacatcagaacatatcaaagagacctagatgatcacaaatacagaaataatgcctcatagaaactgagagtcagaaaagtctgtagagagcatgccttccctcccccatcttcaacctcattatagtagcttaggaaactgaagcccagagaataaaagtgacaaattatggtagcaggactggaatcctacccaggtcttctgatgtgcattccacataactgcttacgatactgcattgcctttccatttccccccagttcattttcaaatccttggtagaaattggacccttgtattgattgattcagaagaatattttttagaaaaatgaatcatcttttccctatcaacatcataactgttcttttaaacaggtgttcatatactacattgtgatgaatttttgccaagtttaagaatacagggtttggaatcagatagacctggatgtgacttctgttctactcactgttgtgtaactatggactagtaatcatattattctgctttaacttttcatttaaagggggataagaacagtatcagcctatacaagtaaactggattacatgagaaaaatactttaaggctctaagcctgtactggtgcacagaaagccctccataactaccagcaatcattattaattattaacattcaaatccacaatggttttggaagacacagtactgggcacatatgaataggtagatcaggtattctcattctctacattaggaaattcaggttcttggtttaaatgactgatccaaggttacacagaaaacaaatagaagaccacagatttctgattttttcttgccattttgctaagaaatgggaactgtcatctcagctttaaagataataaaatcaggaaggaggacatttaaacaaaaacacatatacacagataatcactgcagcatcttatgtaatataaaagctggaaacgattttctatccacagggaactactaaataaactgtggtactgtcatactatggagcaccgtgcagccattaaaaggcatgagacagatgtaggtgttctgatatggaaaaatcttgaagacgtatcactagtagaaaaacaaagtgcaaataaaacgggcagtgtgtactcatttatgcaaacatcctccccaactatatatctgtacatgtatatttaaatgtatgaatagaaagatggctctgaggaagtctaccaactactgataatggtaacctttgggtaggaaagtgggatgggcatgggatggagggtgattcatgctttatttacttatcatgcttgaatccttttaagtaagaaagaatatagtattatttgacttataaataaaaacataaaggcagagggaaatgtgaattataataatgcagttggcatgaaccaacagacctcccaacttgagtgtctctagccctaacctgacttctacaaagctacataagcaatgttagtttcactgagtttcctgtgtggctctcccactgtggtagggtccttcctggtggtattttgtacttagggacccaagttctatctttcagaccacctgggaactctcagcagcatcttgctacaatattccctattagagacatttacagctttgccaccctctacacccttgtgtgtctgtagagggacatcaagctgatccttctacgtcaagtggaggaggcggcctgccattctttgaccacttcaggttcattgcttagcaaggattcataccagtgtgataagcaatgcttgatggaggaggttttcagttccccagtgttatggaccaaattgtgcccccctccaccccaatctatatgttgaagccctaactcctatgtgactgtatttggagataggtcctttaaggagataattaagattaaatgaggtcataaggataaggtcttatggggctggtgcccttgcaagaagaaaaaaaaatgccagagattgcgctctctcttttcacacttgcacacaggagaaaggccatatgaggacccagcaagaagttggctatacatgggaagagagaactcaccagaaaccaaccatgctggcaccttgatcgtggacttccagactccagaaatgtgagaaaacaaaatttctgttatttaggcaacccagtatgtggcgtttttaaaaatgcagtctgagctgactaatacaccaagcacaaaggccagtacacctgaaacacatcctcccacaggtaaggtactcttcgccacgctccgtccaacagaccccatccttctcaggttaaaacctgttcataagggcccctctagattcctaaactccatacatcttttttccccttacacacagacccccaccccacttcatttaacatttgttgtaagcgatcaagtcatttacctctaaagcacagaagtgaaagtctgactacccccatacaagcacacaccctttctcattacccaggatgaccctttctccaaagaaagctatgaacattaacaattaatatttcccactattaactctttccacagtgaacttggagcaggagaactcaaaggttcctgggttatttctgacaaagttcctagtggacttataaaaataatctgtgctttctgcgagatagttatgttggggctgactttcagcctgattctagagttctattggagtcaaaagaaggaaatttggtggtaaagatgacaagttgggtgaaagcaaaatcgtcttcttattaatggaagatgaggggaaccagctggagagccactctggccaaagtgaagcctcagacatctacatatttatgtgcaaaagaacatctgccatcccacagctgcctccgtcatatttctcttgctgtggcccaggcaactatatgagttgtcatgagctgggaagagtgggtgcctagatggcccagcgggaccatctcagctcagctcagtctgggagctgcatgcttactgtcctacactggggatgagtgacatggagaaagctattcaaaaaactccagctagttctcacatcttgattgctcaattccataaacatttttttctgttcttattatataacagaagaaatctacaggagtaagtcagctaagaattctgttactgggtcgtagaattcagcttcctccctgtgggataatggaaaaggcccagagacgtgcactgctgtgctaggagaagatagatcaagtaaatccagcagcaccgaccaggcgccaatgggatatatgtggagggtggagcacaacttgcatttctccaaaagatcctgagcagcatgggtgagcaaagaacatgtgccaagaatccacacagtcatgagctctaatctggttatgccacttacaagtgagtatgtttgtaatacatgtgtatttgttatgcaagttcctttggttctctgtaccttgaaatttcttattttaaaaatgaggttaatgcaaccattctctctgggttgttgatggagattaaatgagtaaacataagaaatacctaggaaaatgcctggaatagacagtactcgcgataccttagtttctttccctcagctaagtgtcgaaattggacccctatttcttcttaaatgcaaacgccaaagtctaggaatgtcagtctacagctgtgctcttttcattgggcattaccaatattttgacaggactggcctaatattattcaccccaggatcattggtacatttctgaccagcactcataaagggcttgggattgcccctggggacctggatgctaataatgaatacttgctagtgattttcaatgcattctggttattatgtttagtagcagaacatttcccatccccagaaaggtcatttacaatagtgtaaggcagctacttctcacctcgcatttcaggtttctctgagaacagcagagagctcaaacattcatccatatgcattggaaacagcattctgatctggcatttgcatacaaataccaaagcaacttaaggaactatgaggcagctctccatcatatgacactacccccttttattttttcaatgccttcccagcatcttcatatcaaaagccattttcatgtaccttcccagctttattcattataagtttcccctttcttgagcttatttggaatgggggatggaggaggaatctttacttcctcacttttactctctgtggccctaaaaagctaatgtatttcacaaatcactcagatctcaaacctggagacgttctaaactcaactcatccaagactggactcttcttatcctaccacattgctgagaaatggccatatattatagtattacttgaataatatcagtgtgtggttatttatgcttaccaaggccctattctattgtgaggtacttttttgctacaatttcttcataccaagccaagatccacttccttgtactttctcactcattggttcaaattttgccctgaaatgttcttatctgaggcatctcatctattcatacagttttaagtacctttaatatgctggtgatgtttaatctcaaatttattatctagtccaggtctttctcttgagcttcagacccagaaatccaattgtctacttgcaagtctcactgtgaaactagatgtctcactgtcttctcaaactaatcagttttcagtctgtttccgcttttagtgatgcgccccattatgcatccattttcatggcaaaattctgggagttgtccttgacatcaccttctccatctgcacccaatcatagtaagtaagtgcaatgcaatctttctctattacgtatcttaaatccatctaattctctccatctctactgatgccaccatcctggagcacaccatgacctcctaattatctcccaactttcattctttttcattacatgcctggctctctaaccccatcctacacagcagccagattaaacttctagaaaaacaaatctgatcatgtttcccttttccttaatggctttccattcatctttggatagagtccaaactccttgtggtcaacaaggcttgatatgatctggtccctgaatacttctccagtctttttttcccccaacattttattatgaaaattcaaacagactgcaaagtggaaaaaaaattacagtgattatccatagacccaccacctcaatttagttattaactttttttttgagatggagtctcgctctgtcaccagactggagtgcggtgtcgcgacctcggctcactgcaacctctgcctcctgggttcatgcgatttcctgcctcagcctcctgagtagctgggattacaggcatacaccaccatggctggccagtgactaacattttatacttgctttatcatatgtctatccatttacccatccctctctcttagcattaatctttcttgcttctggtacatttcaaaatgaactgcagactccattctcatttttatcactcttctccctgttcctagccatagtcatctttccattccttgaatcagttaggctattttatctctctgggcttttgtacctattgtcccttctacctaaaatgctttcaggtcttgttaattgcaaattcatcctttagttctcagtttcagctgtctgagaggctgtccttgaactcccgatctaaattagatccacctttccaccttatgaccccaaggcatcttgtgcctttcctaaatatcacttatcacaattggtaactatatatttatttgcaaaattatttgtctcatactatctcctttgctagattgaaagatccctgaggacagagaccacgtctgtattggaacatcccgtatcacctctgcaaaacgtcagtatttgttgaaggaattaaaggcagaatgaatcaataattgaaaggagctacttggaatagtaaacttgttcttcctttaatatgtataaacaagacagttttttaaaaaggcttctgagggaaggtggaacccacttgttgccagaatataaccaggaagtacattaagtaacaataacagctataatgaattaagggtgggctttgtattaggcatatcccgagtgcttgagtgctttctctgcatcaaataatttttctttggcataggttctattgttattcccactttccagctaaggaaactgagaacagagcagttattttaaaacaccccatctatgtagaatatttggtctatctgtggccccatttgaaagtaggaagattaatctagaaaactcacagactgctataatggagatagggttttacttggctgtaacagaagcctaaaaatatagcaggaaacccacatatagagagatttgagagatgaatccctggttaggaaacctggggttccatatctgaaaaaaaaaatcaaaccattgtgttgactttatttttgtgggaaatttcaaccctacccaaggcccttcctctatataaccccatacacacacttcaaattttccctgcaaaggattttatgcctgatggaaatatagcttatacactgagataaaaccattgcaatctttcccagaataagagctgatggttaaaggaaaatgaagtagtgcagaatttcctagtgggagaacctggccttcagacactggcttgagtttgaagacaaggttttccattgaatgtgtgacttttggcaaattagtaacatcttcagacctcagttgcatcagtttccttctttgaaaatggaaatgacaacatccatttaacagggtttagatatattgaaatgctatacataaagagctcagcacagtgcttggaacatagaagatgctcaaagatgttaactttaaaagaggaggaaaggtaggggagggtggtaattttcatgctcagaattaaaaaaaagtcctaggaaatttatttattaaatgcacaccatgcattcttttgagaaagacagagagagagaaagagactgagagaggggagcttgggtgaaagtgtcctttagcatttgcattgctcttagctggatgaacttgcctgcagtcaccacttacaatgcaaattgagtttagagtccttcacactaactacacagcaaaaacctttcagctttaaatagaacactgcaatgtggaatgatctgagcaaacagaagaaaaattcagaaatacatgtgaaggagatattttggaggaaaaaaaagaacaatctgacataactgagcaggtaggaggaaaatgtagaaatagtaaaggaaacagaaaagcaagatctatggaaggactagaagctaattccccacccagtaagagggtataagttaataagggggaagaaaacttgtggggcaagtccccagtgaggagaatttttaaaaagtcttttgatctggtgctttttcaaggtatactaacacttcttaaggaattcattggaagaacagggactcttccccctctggcaacaaaattgcatgaatcttccctgaaacgaataggtcaaaactgtagggaacttcttgttctatccaacttctggtatttacatcgtttaagttctattttccttttcttttcataccttctctaagatcagattttaaaacctagaagcttctgtgaaataaaggtttgttagttttgagtgtgattagtatgtgtgtgtgtttgagaaagagaaagaaatctgagaggttgattctcacatgccagaaatctcattgctataaactcatatctatttttgactatgtgaacctagatattctatccagaatcagagttttcaaaaatggaataaaaataagaacaacggtaatatccagggccctgaaaacaataaagaatgccatttttaactgatttcttcacttcacaattgacactcctgtacacatagctccactctgggcattttctcagcttgctaagtttctcttgcctgcataatgtaatatacaagaaaacatgaaggcagctctctttctttgtggttacaaacagaaataaatgttcccccaaaagccaacagacccaaggccaacttctctcttggatgacatgcttagatacagagttagtcatgtgctatcaggtcactgagtcagtgacaaagcactaagattgagggagaacatcttacaatcaggttgccatcatgcacagaaaaagaatcggtaagtatggtgctctgtataggggagggatgggctgcacatcttaaaagccatctctaagctcctggaagccagagcttacaactctgctttatctgtctagcaccatgggcatactgggcttgatgctctccaaaaatgatgacaaatggagaatatactttcaatagcactggacattctttctgtctagaacttccagggatgtttatagaagatgccacctttacccccagatgtgtgtgtgtctttttatttctttcagagcttgaactcttttactccccccatcacatttctctagcagtcttttgatttgattaaatattacagaaatgttagcatccaagaataataattttaaattaatacaccttgcaacattgtcctaaagcatttccacatacattttctcgcatggatattacaatgtgataatgcaacactttgtatgagtggctaaggataaaaggcctacaggtagaaaatgaaagcaaaaatgcaaaagttttggcactgggggaaaaaaatgcctctactctctattcacacacaaaaggcagaatgagattccacctgctgactttcccttcctgcccgcacagcactagtgcttatgtcagaacaagctgggagagagggagagacgacaatttcacctcttggcaaagctcagcttgctgaacccttttgctttctgctggctgttgattcagcagaaactactgctgcagaattcataatggtgatttttaaaggccccaccgatcgcgttgctcaccccacgtgtcagcctcattcgctgcccgccagagcactatttccccagccacctttttatttttgctaatgcacttccaaaaggaaagaggttcgcccgtctgcaaagggctttttggggttttgattgtctaagcaggtaacctggccggccggggagatgaatgggcaggaaatgaaaccttgccctccctgcagccactgagagacataacatcgtttcgctcagggaggggggaccaaggtcctactgggcccctcccttcttatctccccccaagacccctgcgaacatctcggggaaggggtcatctgccttcctggggtcatctttctgggcgagagccccaccctgaaaaagcctaatccctgagggccattttaactcccgtgggcgccgggtccacctgctgctgaacgccgagctcgcctcgcggagcccggatggatgcgaggtgcactggggctgccggggccagccgagcccccgccccagccctagggcccggaggagtctccgccactacgcgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagcagcagtggtggccgaggcagaggctgcggctgctctttgctgcagtggggcgcatgcagccgcgaatcggcacctgggcagcaagcgactagcttgcaggttcaggtggaacgcatagacgcgctcttccaacctcctcccctctcgcgccactcagctaagggccacgtctacgctagcacccagagcccctagctccctgcctttctccggacgcctgaacttgagaacagcaaagagaagtaggttcctttggatagtcaggaagtctacatccaggtcccttttcctcacccttatatgatgcatgtggtcccttggtgaatttaaagggcgaggtttggggctcgaagcttcagaaaaagaggagaaagtgggaagtgccgctcagagcctatcttaagccctctagtaggaataggagggggatcaggggccagaactttgcaactggttcccccattcctaagagtcaaaataccttctaactgtaggaggctggtgttcaataaagcatctgtgtctacacaggtggaggaaagcaccagactagtaaacaggatcagtctgaaaaagtccactctcccttgcagtttgcacttcgttttggacaaattattgcagcctctccgttaggttttgcttgtgcaggaacaccttctatttgctgtcagcatggaaggtacattgaagcacagaaacataagcataagagccctgtgcccacagagagccactgctaccctgggggaatttcaggagtccaattaatacagaaaagagacctgtcttcctacttcaactaggaagaaaatgtagaattccctccccacccatgttttcccaaatttcaaactctacttttgaaagaaaatgagattactattgttatgaaacaaccaaaaacatttaatgaagcaacccaaatcactagaaagccaatttggaaaagacatcaaccccaatcagtagaaagccaattggaaacgacatttcctaggtttcatcttgtagaaggtattcatttcaatgggtaccactgtagggagagacatcagcaaatgttttgctcagttaagctccacaagtttagctagatgggcccagagggacctatgagttaattatatacatacaatgcttcggctaacacaatttagaaagtatttgaagttcagaaaaatggaaaaacaagtccttaactgaggttgggaattgtcattagatttccatgcagtatggatacttctggtagatagaaaatgacatcttcctcatctccagaaattgactgcatatccctgggagaaaagagcagaaatgttccttgacatagttattttgtgtgtgtgtgtgtgtgtgtgtgtgtgtgtgtgtgtgtgtgtgtggtggggggagttcagttcaactttcaatagattctattttattttcatctagtgcttaagacttatacacttgtttgttcaaaatccacatttaaaattttagtaacaggtgaagacgggtacaagttgatttaatccacttcagtacaagttgtcgtggctggttcttccatgggatgagctgtatctatcaccgaggttccaacattcagtccttttgtagttacacattgcagcttctcttggatattggcacaatttggagtaggagcagagtggggaaaagctaagttcatctcttagtgaatcaaaatgatgagaagacattgtgccttcggttggaatgatcttaaaattgtttcaggaggccttggaatagtatttgggaaaatttcccctgtatctttctgaatcaagggctagattgggacagagctgtgtgatgaatcaggtaggcccaggctcattggccaggctgtgcttgaggaattttccattgtaaccaatggggagaatgtcccttccacagatcgagtctctgggtttatttatttttcttttcacatatgctgcaaactttctcctgcatttattcaacagtccaggcatttttcctaagacacatgttctgagaaggcagattggataggtctccattgtttaagtagatttcaaggtttccatttggccaactactcttttctaatatgagagaactagctcatccacccaaaaccaaggggaaaaaagctgttggctctgtgccataacacaacgacctgtggtggaggtaagggagtgaaaagagccctgtgcaccactgtggagctggggggcggggtgggggagagagtgggggagatgggagtaggctgcagagatcagtcttcaaaagactcactggccacttctcttttcctctaaaatgtcaagttctttccaaaagtggtgggcatttccgcatgctatgttctttgccacttcctcatgtcttggcattcagcctcttaactgtccctgcttcgttgaggcattccctgaccacacgatagtcctgacttccggtgttttctgcctccacattttttttttgtctttttcatgtcctacagcgttttataatatttgtttacttattattgttggccattttcactagatcttttatttttattttctttttttattttatttattttatttttctgagccagagtctctctgtcacccaggctggattgcagtgacacgatcaaggctcactgcaacctctgcctcccaggttcaagtgagtctcatgcgtcagactcctgagtagctgggactaagacatggaccaccacacccagctaatttttgtatttttcagtagagatggggttttgccatgttggccaggctggtctcaaactcctgacctcagtgatctacctgactgggccttccaaagtgctgggattactggcgtgagccaccatgcctggcctcactagatcttttctattgactaactgtcacttagtagatgcttaattatatttgttggagacaaacatttcttaaacaaatgaataaattgctgaatatcttactttaatatttaggtttcatacctccccccttcttaaaattcatattaaaataatctgttgtgagctggaaattttctagctcataagctgtattcctattgaaataattggttcgatttattcctgtatgcatatatacgatcaaaatttaccaagcaattatgtaaagaattattctggccaggtgtggtggctcacacctgtaatcccagcactttgggaggctgagtcaggcagattatgaggtcaggagatcgaggccatcctggctaacatggtgaaaccctgtctctactaaaaatacaaaaaattacccaggcatggtggcacgcgcctgtagtcccagctactcgggaggctgaggcaggagaattgcttgaacccgggaggcagaggttgcatcgcaccactgcactccagcctgggagacagagcaagactccttctcaagaaaaaaaaaaaaaaagaattgctctaggtgccaaggatatagatttatataaaacagaatttctttcttcatagaacttaaattctatcatctaattttaataacgtgaactttcttagcaatacagcaaatgcattctatatcgacagactatagtgcaatgttaagtgccaaggctccgatatcattttctgtcacttatttttctgtcctcaagcaagttacaagatctccctaaagcatcattttcttatctataaattaggaaaatgaatagtatttgtttcatagagttattacaaggattaaatgagataatacgtggaaaaaatacattgctattactatgagtatttactttcgtcatcatcaccatcatcaatgttcagcaaatgtgcaagtacttaactatgtcagacactgggataggattatagattcagcaacatcagtgtataagatgtagtcagtctctgatgtcatggaacttagtgtctaatttacagtttatgtaaaaggggccatagtcttcaaagggggcagcagagggaactctgaaagactgacctatttcaggcttgtgctttacatagaaaaggccaattacaaatacacagccttcttatgttacccagttcagtattgacagcatgtggatacattcgtttttttaaccacccttgtcatggtcccctcccccaacactcacatacccactcttccttccttaggctaatgcttcctacacaggaaacttttgggtcaccctgtccaattagcacattaaatatctataattttattaaaacctttgacctaagccagtctggagattcttaatagaggctttaggtgtcagacagtcctggtttgtgtcccagctcaggcatttataaatttcatgacctttggtgagtagtttaacatctctgaacctctatatttgcaaaatggaagaaaacaatagttgctacttcacagggttgttgggtggcttcagaggtaaggaaagtgcttagtccaggtttggctcagagccagccttcactaaaatgacccttcttcctcctgcggtacttcatgagatctcccacttgcagagaattggagagatgcactccaagtcaattgttcatgtgaacagaagtgacctagaaacctcagttttactgcctatcaatctgtcttaatgaacaattagaaactggatacatgaaattttatcatcttgcaaaaagccctttataaaccatgaagtctcctgcaaatgaaaggaatcaggattatcttctcttggactttctcattatgtatgtgcagacctagtcacatttctctattgtggaatcatatggaatttctctctatgatcactaagcaccaattgcacaactctctctctaaggtggtttacgtgctgtctagagaatgacctcttgaatttctagcaagtttgcaattcctgtttgtgcatgctacaacatgtaatgccacataagtgatcctttaacgtggcatttaatctgggaaaagaaaagaaaacctcttgccctcaaagtgttgtattaattctagactctggggtcttaatggattttaccatgtaaatgtctctgcaactgaaattcaagtacagaaacttatgaaaatacacagtggtacactgaagctggtaggtactggctattgagagctgattttgctgatcacgtacatgtctttctagttctgctttgagtgacatcattaacatcagaaatctgccatggtaggatatttatatcacagaaaattaaaaaaaaacactatgtaaattcagggtttttttttttttttttttttttgagagccagttgttaaacatttaccagcctaccagtagaaacacattacttgctgatgtgtctttcccctcatctctgttatcggtgcaaagtcccctccaatttctgtacaataaatctcccaagttatgtcagttccagagcattccaccattcaaccaaacttctgccataatgttaaataactcttaaaatcctacctttccctgagggtttcccatatccatcagaggaaaattgatgtcgttgtctgatcctttccaggttggttatgaaattgccatggtagacttgtgagtaattgcttttatagggctcctagacctaacaacgtaggaatgttcggtcatgcccactctcaaggaatcattccttttgactattcaggttctattgtgaccttagtcttgcccttgatttgcttcaatactaaacaaaaatatctactgtgcgtgatttcactgacagctgttttacttgtctagttaggatattgatgcaaagggagaaaagttacaaaactcaagagtctagatctgagagcatgagataaaacatcttcttgtacctcttaccattcattggttttagagttaaatttaggctgtcctgtgcaagaaagttttagtttacagtatatttgttaggtataaggtgagaatttccaaaaccaggttagcaacactccagggatatactagtacctgactacattgctcaaagtaaaattttagtataatttaaacaagaataactattgggaaatgtctttcaaacctttaaaaaatataccaagaaataccactttacagaatttattctaagaaaataaccatggatgtgggcaaaaatttagccataaaattatttctaaagaacattgcttataatcatgaaaaactggaaacaacccaaatgcccaacaaaataatttgttaggcaaattataatgagttcatatgatggcaaattattgattcatttatatagtaattatagctaacactgagcatctattatgtactaggcactgtggaaagggttttacttgcattgtctcattttattctaacaacagcctctatacagtatcatctccattttactgaggctaatagaggtaaataatataaccaaagtcagatagatgagagcctggcgccaacccatgatctgtctctacagcccatgctcttaaccactgtgatttgagctattgtgagtgtgtgtgtgtgtctattgcagtgggtttaggtcacaacagaatcacctggaggtctctttccaaaccattcaccgctagattcttacttgtctctcttagggataaatattctctcagttgaaaatcaccacaattgtgttggtgaggatgtggcaaaaatcagaaccttcaaatcctacattgcttctgggattgtataacaatgcagccacaaatagtttgccagttcttcaaaatattaagcacagttaccatatgacccagaaatttcacttctatgtatatattgaagagaattaaaagcacgtgttcccaccaaaacttgaacacaaatgttcatgtagtagcattatttataatagccaaaaagtggaaacaacccaaaatgtccatcaactgatagatggataaacaaaatgttatatgtccatacaatagaatattattcagctgcagaaaggaacgaagtattgaaacatgccacaacatagatgaaacttgaaaacattatgctaaatgaaagacaccagacacaaaagatgacatattgtatgattccatttatgtgaaacgttcagaatagacaactgcttagacagagaaagtagattagtggttgccagggactgaggataaaaaaaaaaggggtgggaatgactgctaaagggttcaggatttcttttgcgggtgttgaaaatgttctaaaattagataggggcggccgggcgcggtggctcacgcctgtagccccaacactttgggaggccgaggcgggcggatcacgaggtcaggagatcgagaccaccctggctaacagggtgaaaccccgtctctactaaaaatacaaaaaaattagccgggcgtggtggcgggcccctgtagtcccagttactcgggaagctgaggcaggagaacggtgtgaacccaggaggcggagcttgcagtgagccgagactgcgccacagcactccagcccaggcgacagaacgagactccgtctcaaaaataaataaataaataaataaataaataataaaactaaaataaaataaaataaatttggagcaatagctacgcaactctgaatataattaaaaaccactgaattgtatagtttaaaagtttgaatcttatggcatgtgagttagatatcaatacagctgttattaaagataaaaatatcatcaccatcataaaccactgttacttatggggagtatggagtatgctatatccttaaggtatagcagtgcagaaacgcttaaaagtagtgacaaagatagatgttcatgatgttcaaaaaatcataaaccagaataagccaactgctacaattttttggttaaaaaatgtgcatatgctaaaaggaatatatcaaaatattagcaatggttatgcgtagttttcttttgtgttcatgttttcgttaaaatattttagaacatgcatcattttagattttttagattatcattttaaacttttttagtaaaaaaaaaaaataagtatttttaatgccatgaaatactttataggatgaaacttgtatagaaaagattaaaccattttcttcccaccaggaagtcaagagacacataaaacaattctggtcacatataaaaacatatatgtgaccagaatgtatagaacggctctgtgcaatagaaatataatgcaaaccacatttgtaattgtaaattttctaatttccacattaaaaagtgaggaaaaaaagatgaaattcattttaatatatttatatttgaattttttgaagataaaattatcttatttaatctgtcaaaatataatttcaacatataatcaataaagaattactaatgacatatctaaattcttttcttatatcaaatctttgaaatctggtgttttacactaaaagacctctcaaatctagctacatttctaggggctggtaaccatggttaccatattggacagcagaggtacaatggaactgtttcaaaatttttattccatttgcaaaaagagttttaatgtgttctttaagaaataaatttttacctactagaaacttgaatgtaatgctaaaaccaaaccaaataacattaatctgataagcctcaaaactatttaaagttatacaaactgaagacgaaaatatatacagacatacctatatatatatattatgcagaatagtaattttgaatccaatctgcattttcccctaaaactagtaagctgaataaataaattacaaaaagaccaggattctaatagtaagatgataccatataacaaactcagacaagaaagatgtgatatataattccatcactgttatagttaccatcctaataggtcaaccatttagttcaacatgtataccttcaattccagctaagagaagaagccaaatagccagatgtcactgccaaaagggcactttcatatctgggcatctggacactattataaccaatgaaggtggagaaatttaaaggtacagtttgtaggcatctagtagagaaccattagtagtcttttagattgtactggagagtagaatgttgtggtcacatgatcagtggattaatttctgaggacttattgaattaggtattccattgtctttaactcatacatgcaaacagtttgttttgtatgcaattgagtactctctccttcctaatacagttttttcactgattcctgggcattgctctctctttattctcctactgcctcagtgtacactcctcaggctcacttggtagctcctcactgctgtgacctctaaatgtataactaccctagagttcaaagttcaaagtccacagtcccacagctcaccactcacataacaacaaaaccctaaatctgaactttgagcataaacctctccccagacctccagagcaatatcaccagcagccaagctgatatttcacagggtataaggcatctcaatccctaattctgccccacaataccctgccccaccctcctgttccttcattccactctctcattcccatcttttcaatcctgcctgctctaactttgaaatatgtccagaatcaaccactactcaccatctccactgctgctaccatgctccaactatcatcctatctcaccatgattatatcaatagattcgaaccagtctctgatcctccttcacccccaacccctacagagtagtttccaggcagcaggcagaatggtccttttaaatgcaaatcacttcatgtcacttttccgctcaaaggcttttattggcttcctacacattcagactaaaactttcttaaaatgctggaaagatttagctccagctatagctcttttttttaacttatcaaatgcagcaccaccaaatttcacctcccctcccaccaccaccactccctatagacatggaaggaagacaggacaggaagacaggagaacactcccactccaagacctttgcatcttatgttccctctctttcagacaccagcatagctcagtgctttacttcttctggtgtctgttccagtatcaacttcactgggataccttccttgactactctgtataaaataaattagcacctccatctctgcccgtcactctctatccctatattgcaactagactgtatatatttatttggttttggttattacagcagtagaacataatttccagggagagagaaacgattttgttctctgctttatatgcagtacctggaacagtgcctggcactactagttatgctaatatatcttttaaaagaataaaagagtgaatatgtgtttgctcaataataaggatgaatcacaagggaaaattaatgaacaacaaacctaggatgcttatgtagtaaagggtttacccttgcctgaagagaggcctgggttttgccctaggcttcttggaggtaatctgtatcatatatgacagcaatgtctttgtttagggtgaggactggctccagtggaacttagggtggggatggcaataccagatgaccatgtgacttagggtggaagctttgggtcacatggttatcaggtgacctgaacactaagttcaatcttgtatataatcagtcaatccatcatgtctacataattgagctctaataaaaactctaaatacgaggttcagataagtttctttggttgacaatactttatgcatattgtcacatggcaggaggttaatggcaggggggtaatgcatgaggtcaatggcaggagggtaatgcatccaacaattgaaacgttgcaattggaactctcccaggctttgccttatgcatctctttctttggtttattttaatctgtaacctttccgtataagtcataaccttgagtataatcactttcagtgagttctgtgagttcttctagtgaattatcaaaactgagaataattttagaaaccctctgaatttgtaattgttgtcagaagttagggcagttttcgggattccaccctcaaacttagcagttgtctaactccaggcaatgctaatcatacatctggcaaagttatagctaaaaaatgggcttagagagcattaggtctagcccgtcattttgctgatgatgaaagcctagagaaaagatgcgacttgcccaggttacctggtaatttggtgacagacgagcatgagacctggtgtcctgaatcccatgatcacatccgcacacacacaatggctcttcttaacttttgttttgcgtcatatgcaccactttttcttaagaaggttaataaaaatttattggacaattaagttggcttaactctccagtatgttaaggtcagtgtcaaggggagaaattactactgtctttcaaaactcaccagggccagccctggacaaaattgtaaagtaacacagttcctcttttctcccttgcctctgcttttaagccctgtgatgggccagggaagtgctgcaggaggagctgtatcagtcctcctgagccacggctgtagaggtcaggttggaagcctttatgctcagttctattatctttaaccagttctattatccttcacctacaccatcatggtttgccacactctctttctttggaggaaatctgaaaagtataggcagctttagaagctttgggaaacagcacgtggtaaacttagttcatcatgtgggaaacatgttgacaaattcaaggcattatgcaaaaaaggttgtcaatctggccattactgtactagtgtgataagttacagaagccagaattcaagagttagatggaccttgaacttgtaagcaaggttgtatatattttaaaactcaataaatatttaaggaataaatatagagtaaaaataataatattaaacatcccacaaatagagacctttgcaatttccatttggtatctgacagccctacaaggactgaacaaaggatgaaaacccaagtttataaatttacaattgaaaagtagcataggccctgagccatgactttaacattttaggatcatagatccttttgagaatttaatgatttctctccccaggaaaacagcaacagcaacatagtttagagcacttcctgcttccaaatgctgactcattatgtctatttcacagataggaagaaaaagagagagagagaaaaaaataaggcctgggtccaaagaaaggtacacagttgagtgcaagtttagaattacagtgctatcatgtccccagcaaattttttcgtagagaataaaagtggctgtcacagatacagcacttaactggtaatgatataaggccagatgtgagtctcctttctatgatgggtcagtaaagtgtaataggcaaatggttaaaggcatgatttttgagaaccaggctacttgaggtcaaatctttactgtgggcaagtttcttaatcatgttgtgttctaatctcatttgtgaaacaaagattataataggatccacttgtagagtagttgtaaaaatggaatgaaatgcctaaagcaatgcatggcacataatccacacccaataaatgtttgctcttggtattaggtgttggatactgtcatttttgtgaacactgtcattgtctacatggatgctagatttattcacttgtgtagtcttcacccttgaattatgttagcagatttgctctttttaattttttttaagttaactcaaagacatggtttcattataaaggagtatgaaactcatgtcagtgggcttctaatggaggtatattcattcaacatcaaatttttattacctgcctactatgtgcttagcactaggctttctagttgcttgtaaggagattatgacttgattgcaaagataactgttagtaatttatgtgcgaataagagaccaaccaagtgtgaactaaccacaatgtaaaaatgtagaggcatctagtggaatgagaatagctttgacagataaaatagatgatcagaatacctaacctaggccttgaagcaagactggctacataatttgtggggcccaaatcaaaaaaagggggcatcttttgttcttaaagtatttggaattttaagacagcaacaacagagcattaaaccaagcacaggacccttctaagagtgggtcttaagacactacacatcacatgctctgccttgaaggatgggaagactcatggagcgattaccgtcattagcagagtgacactttccagactgtcagtcatgccattcacatgcctctgtgtcctttcttgtactttttctctgaagcaaaatgtttttacttactttttcaacctatgcaaaccctacctatccttcaaatcccagcttgagtctgagctcagagggaacacaatagaataaaaagagtcccagacttagaagagcaaaggtcaattctgcattccatcagctctagaactatgagcaaattctcttaacttttctcatagtgggtttgcacacatgccacacagggggatcaaaaggcatcagaaatgtaaaatagcgttgaaataataattcctcatattgacaaagagctttacaatttcctgtaaacccttccctagcttctgcaggctacaaatagctcttgctaagtgtccagtgcctgattaaaatatacatgcacacatgcacgtgagcacctctctgtccctcccaccacctctctctgcttagcatatatgatttttcttattatctcatgtaacttcttaagatcatcaggccttcagtctttaccccttccaagccacgctcctcactaagtcagtatgatctttctaacttatggttcctcactgcctagtgtaaagtttcctaaatccaatggcacagaatcagtgtcttttgaggcatttgttaatcagtgttctgggaaaagaggtgcagtttgaaaaaaagcgtcatgctatagccctctgttgtaggtttccaatgcacatgtaaaacttctgagaaatcctgcaataaaaaagttaatttaactttgttcaaatcagaatttttcatattaatttgtgcatatttacattttatacaatacctaagttctgcagaaacattttgtcaaatgctggcctgcactcaggcattctgcttgttttatagaacctctaggatctattgctaccctaggtttctagttcattttctgtcacccctttcacaaaccctatgcgcagaaacagtgggccattttcagtttcttgaagaactctgagctctgcacctgttgtgctctctgccaagaatgtctttcctgtcactcatccatccatttattccctcgtgatgtgtttctcttcactgaagacccagctcacttgctctgtaaagacatctctgacattttcagtaactactgtctcctacttccagtggttaacacctctaaagaacttcatatacaaaaatgattcctgagcattaatgaatgctttctttgtgtcagttatgtagcttttattttgatgtagacaaccatctaagatgattaaaataaggtctactttacagattaataaatgcatggattaagaaacccacttctttttctgccttttgagtggtgcccaccatcgacctagctgccccattccagaaacacagaagacattttgaaaatcttcctctaccctacatccagtcaggtgtcatgtcctataaatcccagattcctaaacaaccttaaaacctgtccataggccaggtgctgtggctcacacctgtaatcccagcactttgggaggctcaggtgggcggatcatttgaggtcaggagaccggcctggccaatacggtgaaaacccgtctctactaaaaatacaaaatgagaacacatggacacagggagggcaacatcacataccagaggctgtcagtgggtgggaggaaaggtggggagagcattaggacaaatacctaatgcatgcggggcttaaaacttagaagacaggttgataggtgcagcaaaccgccatggcacaagtatacttatttaacaaacctgcacattcagcacatgtatcccagaacttaaagtaaaattgaaaaaaaaaaaaaaaaagccgggcatggtgatgggtacctctaattccagctactcgggaggctgaggcatgagaattgcttgaacccaggaggcggagattgcagttagccaagattgcgctgctacactccagcctgggcaatagagtgagactcagtctcaaaacaacaacaataacaacaacaatctgtccatatctatccatttacgctgctactaagttagcctggatcagtatcatctcttggctgtgttcctgcggtagcttctgggcaaatattccacctccatgttaccacaagtacaatcatttcctaaagtgcagatctgatcatgccaattgccctgcttaaagttcttgagtgccttcccataactcttaggaaaggaatccaaggcccttaatacaatgtaacagatctttaaggattagctactctctgcttttcacctatattttgttattaattaggatctcatagtctacacaggaaggcttgcagagcctattgtgatttataggccttgccaaacattcttttgcctctggactttatttttatttttatttttgagacaaggtcttgctctctcacctaggctggagtgcagtggcacaatcatggctcactgaagccttgacctcataggttcaagaaatcctcccacctcagcctcctgagtagctgggaccacaggcgtgcgccaccacacccagctaatttttgtgtttttagtagaaacggggtcttcccatgttgcccaggctggtcttaaactccagggctcaagtgatccacctgcctcgatctcccaaaattctggtattacaggcatgagccaccacacctagcctgcctctggacctttgtacacactttttctacttcttgaaattctcttcattctcctcctcactctgctaattcatgagcttcctaaatgtaggtcaaggatagtgctcttcctctagggcgcatagcatcttgacatctttttctctcctgtaagctctttggggccagggctataccttaatcatgatcttatctgtacctaatatggtgccggccctagaactggcatggaatagtcatttgttgaatgcctgaatgaatcaaataatgaataaatgagtaaatgaaagcaaaactaaaaggacagcttggggtattacaagagaaggaatttagagcttcctttcacacatcctcctgcctttgtcctctatgtcaaaatacattgtcctcctttcaactccccgaaagctccatgtatgctccacctgaaaagcctttgcatctccagagtgtttcttcttcattcacccacagttaatatctctttatccttcacatttcagattagtcatcttttcaagaggaaagaattcttgctgatgcagacaagtcggccccctgccatactgctctcatagcaccaagtgtctccttcattactttcaccacagtgtagctctacatctatgtctatgaatgtttatttagcaaaagtttcctccaatactcagtaagctcatgaaagaatcatgtctgttttttattcactattggattcccagtgcctaagtactgacacacaaaagtttgttaaactgattcatgaattaaaaacagtagtttttaatctcatcagcagttttttgtttgtttcatcaccgtgtacatgcatagtagggttcagtaggtaagggctgtttgttaaatgagagactataactgatttctttccccagtttataaacagttgttaactagtaatggttgagataaaaaattttgttcctacaaatttagtaatatttgcatattttcatactattttgtaatatgtttatggcttctcttgaaataaatgtcaaaagaattccatctgcctagctcctggactccacctcattaggaaaataaagaaccacaaagtccatctccaccacaggaaaggacaatagctctaattcataaattccataatgtgtacataattggaagacatcaaaatatgtcctgtcacagaccagtccgtgattcttcaataagaaattatgaaaatcgcaaaacaaactgtccaaaggggtcattactgtttgacaattcatcgggctaaataatattgtctgagtggtcgcctggctctgtttgaccttaaacgaaggcagaggaactgagaaatacattaaagaaaggctatggtcaggcttttggagttacacaaactttgatatgtctgggaagaagtgcttttttacccccataattttaagaacagggtaggcaatgacattttaaagcctgtttacctcataatcaaatcatccacaatttgataggtgcttaccaagtaccaggtattatgcatgtctttatgctcacattaactctatctctcaccatcaccctgaaggaggtattattaactatcattgaggcaactgagactcagagacctgaactatcttagagaaagtagaacatgactgatgtggggctcaaacccactgttacttgactctactcaataatgattccacttacatttctctatgcaaatttctgttccagccttccactcagtaagtacatactaagtatttatcaaaaagaatcaaagtgccataattcccataatcatttgaaaagaacacctaaacagtcaccaggatgatttttctctcaaagaagctattcagtttgaaatgccctgtggtggtgagatcttacaaaatgataaataaacccgtagacattttgttgtttaattttttaagcccatttctttcttccttttttttttcggtgattcactttcctgttattcagaacattacacacctacacacatcaaataaaactgaatattccaagatttaaaggcgttagtgggggttgtcaatacatgaaagcagagaagctgtttagtataattggggaaaagtggaggctcagactgtcaaaaaaagatggcttttgtactttaaaactaaagttccaggatatagaagtggaccagctaagaaatgctggcttagcctcttaagaaggtaatgatcctccttgatttagaacaagcagaaaaagaaaattaaggtcaatgatgaactgagcatatatttgtcatctccttttcccaagatctctttaaaatgatagtaaagaagcaaagcagatacagccccagaacaatgaaaagaatataaagagggtcattaagtgaacgatgcatttcatgtgtttctgagagaagacaggtaagtggaggaatgatgacagattgagggcacagccaaggagggcccccatctatcttgcaaaaacctagagagagttaggatttagaaatgccaaagatgatgtgggatgaagggtgaaaaatggagcgggtgtgaaaagggatttacctgccccccgttcccactgtttaactcttctcatcacaccctgggtggatacaataaaaagttcttccttttgaaagaaaactaaaatggtctggggtggactaaggtcacaagtgtgggagttgggtcttcagagcaaagtgctctgcattttggaattagggactacaaaatacaagataatctctgtgcctactcactgtataatgaaacccaccagttggtaagtcctattcatattcatttgacagttctactgattcattctcacatatgacttggcaatggaagatcatctactcaattgagtgaaacctacactgtgaggggaaaaaagaacaagataaacaaatataaaaacatatactggagacaacagggatacttttagggccagaaataaataaataaatcctaatttgtatgtgcagaaacatttaaaaggagaataaacctacaattcaagaaccggatgctatacaaagaaggaaaacatagagaataagaaaaaaaaaacatggaattaaaaaatatggcaaatttatttttaaattattagaaggttaaaatatactggtcaaggaaatctcttaaaaagtaggaaaggccaggcgcagtggctcacgcctgtaatcccagcactttgggaggccgaggcaggtggatcacctgaggagtttgagaccagcctggccagcatggcaaaaccccgtgtctactaaaagtacaaaaattagccgggtgtggtggcaggagcctgtaatcccagatactcaggaggctgaggcaggagagtctcttgaaccagggaagcggaggttgcagtgaactgagattgcatcactgcattccagcctgggcgacaagagtgagactccatctcaaaaaaacaaacaaacaaaaaaagtaaagatcagatagttgtagatatgcagcattatttctgagggctctgttctgttccattgatctatatctctgttttggtaccagtaccatgctgttttggttactgtagccttgcagtatagtttgaagtttgacaaacctgagaaaaacaagcaatggggaaaggataccctatttaataaatggtgctgggaaaacgggctagtcacatgtagaaagctgaaactggatcccttccttacaccttatacaaaaattaattcaagatggattaaagacttgaacattagacctaaaaccataaaaaccctagaagaaaacctaggcattaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccacaatgagataccatctcacaccagttagaatggcaatctttaaaaagtcaggaaacaacaggtgctggagaggatgtggagaaataggaacattttacactgttggtgggactgtaaactagttcaaccattgtggaagtcagtagggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaagtgtccaagaatgatagactggattaagaaaatgtggcacatatacaccatggaatactatgcagccataaaaaatgatgagttcatgtcctttgtagggatgtggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggtgagggatagctttaggagatatacctaatgctaaatgatgagttaatgggtgcagcacaccagcatggaacatgtatacatatgtaactaacctgcacattgtgcacatgtaccctaaaacttaaagtataataataataaataaaaaagtaggagaaaaagataaagccaaaatatcagagatatacaaattaggaaattattctatgaagactaatatccaattaatagaagtatcaggaagaattaggaaatcaaaaataaggaaattattaaagaaatacttgaagagctatttcccaattgaataacaggagtgttcgagattaaaaggagccctttgtatacccatattggttattttaaaagatatataactacataatcattgtgaacactaaggatacaaagaagatcctaaaagtttcctggaggaaaacacaggccatatctatgttagtaactatcagattgtcactggaaaatttcttcaacattggtccctaaaaaacaatgaaatgacagcttcaaagttccatgaaagaacaactcaaacaagatttctatactcaacctaccaactgactgaatggctggggctggggaaccggaaatttattgagccatgcccttcctttgctagatgctttattgtgattattaacactcctttaaaggaagtattatttttgccatgcacagacaagatccactaataggtcgacccaaggaataagtgtcaaaaataagtgccacagtcagaaaacatacctgagccaatctgctattcttcttccagagtatatcactgggcctttgaacacacaaagacaggccagctcatagggaaaagaagatacaatgtagaaacagggagaaccatccactcctgggactttgaggcaaggttagactgttgccatatgtaaaggaacattatgtcattgttgctaccttggcaaatttcaaaggttattgttccagcttcccttccttttctttcctttctcctttcctttctccctttctttctcctttcctttcctttctttttccttcctttcttccttccttccttccttccttccttccttccttccttctttccttcttttctttcttttctttctctcttaaattttattttaagctccgggctacaggatgtgtgcaggatgtgcaggtttgttacttaggtaaatgtgtgtcacggtgatttgctgtgcccatcaacccattacctaggtattaagccgggcatgcattagctatttttcctaatgcccccctctccccgtgccccatccccatgcactggacaccccccagtgtgttattgttcccctccctgtgtttatgcgttcatttcattcagctcccacttaaaagtgtttaattttctgttcctgcattagtttgctgaggatgatggcttccagctccatccatccccctgcaaaggacatgatctcattcctttttatggctgcatagtattccatggtatatatgtaccacattttctttatccagtctgtcattgatgggcatttgggttcattccatgtctttgctattgtgaatagcagctatattttcttatgtaaacatagctaaagatattttacaaattgaggcacacccagttttgaagttgaatatgaccaagaagcttccattacagatagttaacttattggtgctaacataaaatatctgtacaaataaattcaaacagtggctcactcctgtaatcccagcactttgggaggctgatgtgggaggatcccttgagcccaggagttcaagaccagcttgggtaacatagtgagacccaggctccacaaaaaattaaaaagaaaaattagccaggtgttgtgacatgcacctatcatcccagctacttgggggactgaggtgggatgattgcttaggaggtcaaggcttcagtgagctgtgtgatcgtgtcactgcactccagcctgggtgacagagtgagaccctgcctcaaacaaacaaacaaaaaccaaaatacaaactcccctacatttccaatgctatttcaacctatctgttgaatctcattcataagctcatgaaacaaatattcattatacctgaggtcctagatgctgtgtcaacaacacaaattccctatcctcatgaagctttcagtctaggaagataatgaagagaatttggtgaaagagaagaatgcaagcaggaggaggaagatttacttggttagagtggtcaggaaaatactttccattgaggtaacaattcagtcgattcaaataatccagttatgtaatggtcggtgtgatgagtggttgcattagaaggaaatggaatagtagtgcaaacacctcaagatgggaaaatgcttggagcgttcaggaactgaaactgtgccaaagtaagtgagagaggatggccaaagatgaaattgaaaaggtaattagagccataattcacggggcctgtaggctattgtaagaaattagaagacaattcaaagtgtgatgaaaaaatctctgaagagctgaaagcacagcaaggacatgaactgatgtatggttgcatgtttgacttacctaaagacctcaccatgtgcacactccactggcatctcagaatcaacaaacacagacatcatcttccttgcccccaaagtcaccatttctttctattcctctcctctccccattccttttccaaatatttattgaaaatcaactctgtcaaaatacttcctgagtccctatagtagtcaaacagcaaaatattgtcatctcagcattgttttatttcctcacccacacacccacacaactacatcctatgaactgttctgcaaaatgtctctcaaactctgcctagttcaagcttttattacgactcatctaatataaataataatagcaataataatattgctactacccacaacaattattacaactacttctaatacaaataatgcttaccatggatcaggctttgttatatgcattttacatagattaacacatttaattgtcacaaaaatcctgaggtctggctctagatatacaactacacacggcctcgttaaagtgctcttaactggttgccttttctctgtcctctttctaatccatcctactcattttattgacagactaattgtccccacacaaagatctgatcaagccaaaagccatctgtggttccccagtgcattgagaacaacattcaaactccttaagctgataatcgtcctcccaagatctggtcctaatctatacttcccaattcagagcacacctcttctctacacataacaaagttttgctacactggaatcagtttatttctaattattttcaatgcactaattctcaaattgtggtatgagcacctctagggatccctaaaattgctttaggaggtccatagatcaaaaccattttcataatacgaagatgttatttgcttttgtaactctcattctctcatgagtgtacagcagggtttcccaggcactctgtgatatgcgatattacaacagactgcagaagcacatatgagaacctgtcttctattaagccagatgttaaagagatttataaaaaacataatgtaatgctactcttctattttgggggatatatatagtaatttttcataaaagcatgccattgatgttaatatgtaatgagtttattattgttatttttaattgaattaataaataatttaactgtcaatagacattaaccacattaattaaagaactttgaggttctcaatcatttttaaggttataaggtggtcctcagaccaaatagtttaagaaacactgttttttttgtttttgtttttgcttttgttcttttctttcttgctttctttctctttttttttttttttttttttagagacagaatttcactctgttgcccaggctagagtgcagtggtacaatcttggctcagtgcagcctctacctagcaggttcaagtaatcctttcacctcagcctcctgagtagccgggactataggtgcatgccaccacacctgtctaacttttaaatattttttgttgagatggggtttcgccatgttgcctggactggtctcaaactcctgggtttaagtaatctgccacccttggcttcccaaagtgctggaattacaggtgtgagccaccatgcccagtcaaaagaaccactgttctaatgcttaagagtacatgctttaaaatcagattgacctggagttcaaatcctagtgatactgataatttttttgaccccaggaaagttaaagttgtatcagaatactcagttttctctacagcaaaatggggataataattattgaccttacagggtaatatgagcaaaatgcttaagccagagttggcacacagtaccaaatggtgccaaatgatagattcttcccatttcatgactaacataatgatcattatattgtcatcttctaaacatgctccggggtttcctggctcagagtaattagtgatattcttgtctctgcagggattgtcctctcagagacttgtctaactactgagagccaactgtagtaggctagtatttgtagaatgcagacatcactctctctctcactcctatagaaccagaaagaccaaagtattgtatttgttcttgagtttctaactcatgaactgtaagagtctggtgcctaagaaggagaaaaaaatttttgaagatcaaaatcttgcctttaaatactgatccacagttcctaaaagtatgaaaggtcagtattctggggaagaaaaaggaaagaatgcaagtttattatataagaacattattataaaaggagaccaaagtttgaccaagtggcagaaagtaggaaatcaataggcttagtctagagattaaatatctactcagcctctcatgaggcttatcaagcccagtcctggggtaggaggtaactaatggaactagaggaaagttgtagaaaattccacaggcagtattgggagcgtgttccccgagtcctaaagtatagcccagagaggttgtaagcttcttggagaaacctcatgtctaaccaatatggtgcttgagtaatggttgtaaccactgatcatacagactggctgaagacatctgcttgaagtcctgtagcctcagtatagaatgaaagagactgctaaaagtagcttcatctccttgagagaaaagcagaaacagttaagaacacagtgatgaacccaaaggtgccaggagtcaaaatgagggcacggacatggtactggaggtcatggtaacaccacatttaacagcagcaggttaacattaacatgaggaaccagatacaaaaaagtcacacccaagccaagactgggagaaaacatatacaaaacatgtttgctaaggaacttatattcagcctatttaaaacaacttttacaaatcaataattaaaagacaacctgataaaaatgggggcaaaatatctgaacagaaattttaccaaaggatatatatgagtggcaaataagcacctgaaaatatgctcaacattattagtcattaaggaaatgaaagttaaaaccgcaatgaaataccattgcatctctactagaattgccaagactaactatgtcaagtgttggtgaggacatggagcaattgggactctcatactttgctggtgggagtggaaaatggaacactggaaaatatttgttattcccctataaaattaaacacacaccattcaatccactcctgtatatttattaggaagaaataaaaacatatctcaatctactcctctcctgcatatttattagggagaaataaaagcatgtccacacaaacatttgtacttgaatgttcttgtcttaagtttgaaatttttaaatttttaaatttttataatagagatgggatctcactatgttgaccaggctggtggtcttgaactccaggcctccagtgatcctccagccatgatctcaccttgacctcccaaaatgttgggattaaagacatgaggcactgttcctggcctgaatgttcttaacagctttatttataagccaaaaactggaacagcccaactgcccaccaactagtgaatggtatagtacatctatacaatgtaatactacttagcaattaaaaggaactcactcctattaaataccctctaaataaatctcaaaatcaatgtgataagtgaaagaagtcaaacaaaaggctaagtgcaatctgattttattcatataacattatagaaaagacaaaactatagagtcaaatggcagatcattggttgctagtgcccagtggtggtaggttgggattgatttcaaaatagcaggagtcagcttttggggatgatggaaatgttctctgtgctatccagtatggaagctcccaagccacatgtagctactgaaattttaattacatataatttaaattaaataaaatttaaatggaaataaaagttataatggaaagcttgtaagcaggattgaaacaatttggacatttgaacctattttttcagctgtgaattttataagttctaaataaaaattaagtatttctagtaaagatatattgtctgagttgagatatgttggaagtgtaaaatacacaatagacttgaaagaatggatgtgaaaaaagacataaagtagctccttaatatattcttatattgattccataacaaagtgataatatttgaatatattaagttaaagaaaatatattattaaaattaatttcacctgcttcttgtaccattttccatttatttatttatttatttatttatttatttggagacagagtttcactcttgttgcccaggctggagtgcaatggcgcgatctcggctcaccgcaacctctgcctcctgggttcaagtgattctcctgcctcagcctccctagtagctgggattacaggcatgcgccaccacgcccagctaattttgcatttttagtagagacggggtttctacatattggtcagactgatctcgaactcccgatctcaggtgatccgcctgcctcggcctcccaaagtgctgggattacaggcgtgagccaccgcacctggcctttttcttttatttttaattgacacataatgattatgcatcatcatatttatggggcacagagtgatatctcaatatatgtatctttcttctactttttggaaatgtggccactggaaaacttttaaattatgtacctggctcaccttatacgtctattgggcagtactgttctacctcatgactgtggcagtggttacaacactgtatgcccttgtcaaaacatattgaattgtacatttaaaactagcacattttttgaaatgtcaattgcactttatgcagctgattaaatttaaagagacaatctacttctaagaagaccagccgagttacactgtagcaggagacaggatgagtaacacaggaagggggcgctgcagggacagaggcctaaagggaagaccaggaaaggcaagaggctccttggctgattgtggtgaggacagaagatagcgcaggatgccattccgacagggaagtaggaaagtacaggaggcttttgtgggtgtaaaatggaatgtttagagcctaaattatcagcttaagtctgaaaacgattgtataagcatgaattggctaaattacatttttttttccatcagcagatgtagaagttaaaatctagaaataaagctgcatttttgcacaagcgagctgggggattattacaactacgtattttaagccatctatgtgcattttcctgaagctcagctcaagcagctcttctcccagagcttcttcaggacattggttaaaatgaatgtgttcccatatgagcgttcccaaagttcagcttatattcctattatggaaaatttcatgtacccaggagccaaagaaagtggaattaatgtccttacagaagggcaaagtctacaacagcatctctgtgctgcctggtcatcaccaagttggagaaagggctaagggcaggtgtacctgaacatcccccctgaggccaacccatcagctatagtgtggaacacactgtgcctcacactgtttaagttctctacttgggagaaacccccttttccattatcctgtataaatgctgttgatttgtcaaggcccagctaagtttttgtcttttcccataccactttcattttctactgctttgaaatcctacactactttactgtttagcaattgtgagttattaactattgggtcctgtgtgtttattctgtctcctcaatcaaatggtgaggttcttgggggcatgcctttcatttccatagtatgcagtggtttgttagtctttcaaactggctgatcaaatgttggcagcattgaattccctagaaggaaaaaccatgttgttcttccttattaataaatatgatcatagagaaaaactgccgagcagaacagcagcagcaatgattttatgagcatacccacagccacgttctttacattaattctcacgttttgtcttctaaatcaaactacatgatacctataaccatggttcctcaagtgactggaggtaccccagggcaccacagtgaacttacaggaaagccaagacagattttaaagttttgagggaaacacttctgtgatacaccatgcaaaatattagcttgaagtagatcacagttgcaacattagattgtactacatgacagatctttgtaaaggttggttgtgatgaaaaccaagtatggtgcaaaattcaacatggaagagaaaagtctgattccaagtttcaaggaattatgcagtactcaacaggcacacatattctactagtaagttcttggtgtttacttaaaaattaaatttttttttctttcaatatgtatatttttcaaaagactcctaaattttttgaacatacatatgtatacagctgtttgggcctagctacgtaataaagaaattgttagatttttttttttttttggcataggggtgtgttaaacaattactgagacactaagggctccattaacagaaaaagtttagcagtctgcaccctgtaaggctcacatcattgttttcaggttgtagttgaagaaggtgatgacctagagtgttgagaaacttcccaaaggccctacactagtcagtgtcagacctaggattcaattccagcttcccctcaatataaaactcatgccttctttcttcctttcccgccctcccttcctcccttcctcccttcctcccttccttccttcccacccagggttttgctatgttgcccaggctggagtgcagtgccgtgatcacggctcactgcagcctcaaactcttgggctcaagtgatcctcctgagttgcctcccgagtagctgggattacaggggtgggccctggagctcagatcgtgtttttcatcctgggtttactttaagatccttcagatcagctcctggaggcagccaccaaagagaaagcagatggtccatggagaagtaatagtgggagaagatttcccctgcagctaagagagggcagtgggaggtcacagaaagtagcagggtgagtgaccttgactgtttctgaccaccagctattaccacaacataaatttacactgaggaattaagagactaactaggggttccatggggagctcatccatcctcctagaccatgacattcccccacactaacatcagagggaagagtgggtaacttatcagtaagtagagcagttcttgaattcagttcatttgcttctgggatattcttggatttttattccaaccccaatacacttcaaagaatgacaatgtgacccttttcttgtcctaatgatctgggagcattttcctcaccattatgcacatgttactaccctcttaagaggtcagtaaagctcttcatttcaaaacctgatttatttgcattcataatctccctgttagctaggcaatctgcataataacctggcatgaaatatttttaaccaggctttccaaaatatagaaagaagccttcctaataatggaaggcattcactatcttaaactggaatccatttacagattaaatttgccaagaggtcagcttgcagctgccactgtgttgcaagcccgcatgtcctctgtgtcacatcctgtgacatatcttgagaagagtcagggtcttttccagtctgctggttctgtgtttcaattagaatagatttaagagtccccaagctctggtttctaggtggctttgcacaatattattaataattcaatcatacctatgctgataacagattacatttctaccatcccacaaaaaagcccaaacagattaaggactacccctatggctaatttctttagcagtttcatatctgattgacatccatttatctaattgcagctagaagatttaatttccatttcattggcttaaaattaataggaaaaacctgtttactttttaaatatttgactcatcctttctcatctcctgaataatgttgagatagtccattctatgggatggattctacaacttatcagttttcattctctgaattcatttcaggcaagcctagctatttacaatttgaagtctaacataaaatttaatctttcattgcaagtaatttcatttttcacgagcctaataacaagaaggtagcagggtgttcatttagaatttcaaaaaattttgcagatagaaaaaaatttgaaggctatacagctatggatgcaaaagctagtttgatcatttatgagctacaatgcccagaataggttacttaactcagatttgagacaaggatgagacaagtgtagtgcctcaagtgcaagatttaaaggaagtgctcactcttggtgttatgcaaggttgggagagcacatgtacaaacatgcagtgaatacctttatccttaaattttgtgccatatgattgttgcttcctttactctagtcctgggaagatctctgaccattagttgcctcatctgcaaaagggtgatggtaatagcaaccttcttcatggtggtgtagtaaggataaaataaaataattcacttaagcacttagaatattgcctggtacatagtaagcacttaataaatgctccatgatgttactgttaataatacattacattgtattgtacaatttgatcatgttacctatagtctttcagaagtttcttacttttttaagaaaatgtataaaatcatatttttaaaaagaatatagtataaaatcattagcatgtcccccaaacctagcataatctgactccatgtacttttctgtcaatatcttctaaagctctccctgaatatcccactggtcttcctttgggttcttaaataatttatgttccatattcgtctacctgtcacagggcttctacataggctgttcccagtctaaaattcttttccatcccttttcatatagttaactctgcctcatcttttatatcatagttcaatcatcatttccttagggcccagatcagattgtctgttagacactttctttttttttttttgagatggagtcttgttttgtcccccaagttggagtgcagtagtgtgatctcagctcactgcaatctctgcctcctgagttcaagcaaagctcctgcctcagcctcctgagtagctgagacaacaggtgcacaccaccatgtccggctaatttttgtatttttagtagagacggggtttcgccatatcggccaggctggtcttgaactcctgaccttgtgatcctcccacctcagcctcccaaagtgctaggattacaggggtaagccacggtggccagcctcttgacttttaaaataaatcacagttggtacttatggatttatttttctgattattggattactttctctctatgccactagatgctaagttagttccaagagagcagagacctttctgctttggttggcaatttatcctcaccacagtagcctgcaatcagtaggtgcacaataagtaattgtttaaagaaggatataaaaataatattgccactggctatcctagccagggacgaggaagacacttcttcacatgggagactattgccttttggattaagagttcttactgcttgtcttcctcatagtgaacccaaatacctcttccctctatatggccacacctaggtccaattttatttcataagcaaccactttctttgaacattttattagttcacaaatacttgtcaagtgcctagaatgtgtagcacactaggtttagttgggtatatacaatgaataaaggtacacttcctatacttagggttttttcagcacagtggaggacgaatcacatgcacaaagctctgatttaagaaagtgtagagtgtatattcagttccctaagaggccaggtgcagtggcccacgcctgtaatcccagcactttgggaggctgaggcgggcagattgcctgagctcaggagttcgcgaccagcctgggcaacaaggtgaaaccctgtctctactaaaatacaaaaaagttagccgggcatggcggcatgtgcctgtagtcccagctacttgggaggctgaggcagaagaactgcttgaacctcggaggtggaggttgcagtgagccgagatcgcgccactgcactccagcctgggtgatagagtgaggctccgtctcaaaaaaaaaaaaaaaaaaaaaaagttccctaagagaggtacagcataccctaaagagagtgaccttatcatctgaggaatcagtggccacttcctgaatgaggagattttctgaggtaacatctgaagaatgagtgggaggtatacacatgaagagtagtggggagagagtgagcattctgaaagaaagaatagaggggggatatttaggcattctgcatacttgcagagttgacatatccacgatctcttgttctttcaacttttcttttttctttttttttttttgtttttgagacagagtctccctctgtcgcccaggctggagtgcagtggcacgatctcggctcaccacaacctgggttcaagcaattctcctgccttggcctcctgagtagctgggattacaggcgtgtgccaccatgcctggctaatttttttttgtatttttagtagagacggggtttcacaatattggtcaggctggtcttgaactcctgaccttgtgatccgctcgcttcggcctcccaaagtgctgggattacagacgtgagccaccgcacccggcctctttcaacttttgattcattcattcatctgcttattaattcataacaaacaccaagtaagtctcttcaatgtgtcaagtactaccgtcatatggaaaaaagactagtccaagctcttctggggattatatgctggtaagttcaaatcctatctatagccaagaaactctcacctaacttgcagaaaatgttgttaaaaacactatgtgttcagccctgtaggcagatacttgcctaatgctttatttcaggcttttttggaatgcagctgtcctctggaggccctgtctgcccatgcaggtaagatgttctgaaggcaagaatgagtttatattcggcggaaatagtctatttcctgtgattttagaagcatagagtcaagtgcttaaaacagaaacagtgccaaataaatgtttgtccttgttattattattgcctcttcaggatggtaggagaaggcagagggaaaggattgatgctttggaagaggtagtcttcacacgcagccatcccatgtttaagaaaggcagggaggactccaagggtcttactctctcccattacagtgtctggccatcttagcccacactttcaaagtagccctacatccaaggcagaaacatgcaaggaagttctatgcttagtaaaaattgaaagaaatagaggccaacatatagttccagtaatgactgaaattctatttatattctaggcctctttactttttgattttctcattttcaatgttttttttttcaaacatcacattaaaacagctcactcggtctcttgatctccactttgcctttagctgaggaccccacaagacatggttcttggtttgtatgctcatctttattttgaaaaacataaactgaattgagagatgcaaaatttgaggaacgctctctaataccataaatatacattgattgctgcccaatcattcaactttaaggactaaaagctaaactcttaaatcctttagtgaattaaactgcaaaaagggatacttaaaggtgatgggactatttactccccatttacctcctacgtcctactaaaatggacctagctcagtgcttttcacttactacttacgtggtctttggtaggatttttgttctggccaacccaacttcaaatctatgaggttataaggaatcagcaaacaaaatgacatatggtggagagcaggtggctttgagaggcaatattaactatgtatatatgaaatcacaacaactataaatatttaatttccaatgtttgaaagagaaaagagggtttctttgaaagtggacttagtgcatatgtaaattaattacaattcatgacattcattatttcagaaaatgatgcaataatttaaaaccaatattgacagtttgaatgttacaatacttttaaagatttattgccatacattttcttttcccgttaaagaagaccttctattatgagcaagatgaaatgcaaaatagaggccacatgctttctgcttgtcaagcttgtgtaacttggactcagaggagaacatccatggggtcctttgggaagcagtggttagggtggtggcagtttacacaattgtcccactgcactgcatcctggtacgtcattacaacctatgtaaagatcacctccaaaattaatgatttgtatgctttcctgggcaccattctaatctctggtgatcttcaactttagtatgcatctgtatcaacaaatttgatctcctgacataatcagcttttaaaagcacttaaaatctgggaaccaattaggcattcatatggtgtaaaggagctattgctgcaaaaaaatgttgttggccaggttggccctaatttgaggatgagacatgagtagatggggacactggcaaagaataaaggtcatatgttgatgaataagtatagggttgggttttatgaacaaagccatttctttggctacataatgtagacagcagatttggtagcccaaatggaagatccaagacctagtgggagttggcatatcttgtgtggtacaatttagggccagggtacttaaagtctttctctagctcaaatgtatctcccctactagtcctccactttcagtattcgaatcgacagtggcttccaaaaaggtcattttcataaagatgttctggttaaaatgcacacattagagagctaaaaaatcaagatgttgttttttctcttttcttttattctccatatcaaatttaacagaagattcaaggttttatgtactacattgctctcagatatatccttatctatcttcactactaccagtctggtccaagccaccatcatctttcatctgggcttggtaacagcctcctcactggttttcttacatctaattttgcctcttgaaatttgctgtactctgccaagtagccaggaaaaaatttttaaaataaatgtgaatcagatcatgtcattcttctacttaaaatcctccaatgtctgccacttggattcggagaaaaattcaaattgctcaccctggcattcaatgcaaaacattcttcttacagccctttgcatgcccagctctctctcattcatacatcatcttcccctcctactcaataaatccaaagaagtcattctacctatgtacacacacacacacacacacacacacgtacacatgtgtgcaatttacatacccctcccccactgctattccttcataacaattgccactatgtgaaattttagcactccaggcattcagccctctgtcctgaagatgttgttcctttaccctaagtttagctgtcacactcaggtgcagagttagagaaagaaacataatatttccttaacgactgactcatagattcactggcctttgttcctttccaggttaccattctatttggtttatatattatgctgcattctgagccactacaacaaaaatcactgttattgggcccttctcctctgcccaaattcttgtgcttgcctcctccttgctaatatttaaaaatcattaaccaagacaaaaaaaatcaatttcaacactgttacaacatctttgtcttctcatccttttttgcaatgaaactcttttaagaaaacttactgcctcattactctgaattctcaccctccaggggtgatggaaaagtcatgtttttagaaaccggacttgtaagacacgtgactttcactttggggtgagttatgtttcccattaaactaaaagctccttgaagacaatacattagtatagcatctctaaagaaaataaaaaattgtatcactttgaagaggtttgtacagcatctgacccacggtttgtacttaaatatctgttttgaaacaccacattacccacaacaaaaaaatgcaaagggttagtacttttaaaaggcatttcaatttttgagttattcaagttcttttcatcccagaagagtgaaaaaaaagaaaattctaaccacatgttaccaccgttttttttttttttgacgactcagaggaagttctatctctttgagtatatagtaggtctcattatatatttaatcaaatgatttcaagtatgaatgctgggcagagagtgacagagagaactaaagcaggtgactttccttcattcttctttatctgtcttggttgctattgtactcctacagccaaactcaatatctgacacgtgactggcacctgaggtatgtgaaataaatgaatgaatgcatgcagctaatacatgacagagtattccaagccaggtttttttctgattaaaaacccgtatcccacaactaaactgtattgacttccctcatccatctgagtgagtccatactcactcagctccaaacagtagctccagattcttgctatgtagttgagtgtttaatgtttaatctgtagactatgccagaatagcaactctacaggtgaaaagctcagtagtttcaattttgtgacttgtagtaagaaaaaaagttgggcactgaattaaacatttatttagaaaattaaattgaaccagtttgcatatcatggcagccactgatatagctctgcctcttaatagctgtgtaacttttgataagttacttaacatcttaatcatgaatttgctcatctaaaaattacttatacaaatataagtaattaccaaaggtatttttgtgagaagtaagaaaacgaaggtaaagtacataatgtgtggcatgtaatcaggccttaagtgaaggttatagcaattattacaaataatccctatattataggaattatttgggtttctgaaaaggtggctgggcagaaaagatgaacaatctcttcctttgagtctatttgctgatttaaatttagtggcaaaagcaagctgcatcatagttgctcctgtaataaccagcgacatgggctctacaccctgcctgcacaggctgtctttgctgtgcactataaagcctttgccaggcccaatacagtgtgaggcacacagtgggtgctcaagaaatgcttgtgttttccgatgccactttttgatccttgctatataccctcctcgactgccattatctatgtttgtgcttttgtcaccaagcgcctacctcagtaaaaggtcattccttgtacagcattatatatgagcctcagagccaaaaaaatgtttattctgctcattggtgtctatcaatttaagaaatccattttataaataaggatcttcatttatatagaggttcaaagttatgcccaagggcacacaattaatggtagagttggttctagaacctaattgacttggtcccttcacattttttataaataaggtgggttacaaataaataaatatgtatcttctgcctcccagttaatattctaataccacagtggctggcaaaatcaacctcttcaattctttagttcaatcttatttcataatctatctgtagcaagatctgaggtgaagcaatgtgagcagtctaatgaacttagaaatgatacattttgctttcctcaccttttactgagtcctgttgttttatttgctactcaaggatgcgaagtatctgtttaacagtaaagtgccaagcaatctgacatctcctcctgattaaaacagagtcatctcaaatacagatggatacatgtcattatgcaagctatctgcttttcagagctgctgcctcaaacttcctgcagtaagatgccccctcacactccctgcagtcccccatccctggcactggctttccttgaaaacatataatcttgtctacctgcatttttgtatgtttaggctcaagcaaagaatccattatgaaaatgacagaactgccagaaagaattatgacttcactgcttaacaagctgtgaattcactgtggaggtagcaaggcagagaagcaaagaaacaggaggaagaatatatatgaagggaaactcgccttgggctctgcactactgcaagttgagaatggttttcccagcctttcaggatttccatgtttgctccaccacaaactacctaagtttctttccatagtatggggcaggatttttgccttttacctaaagttggtaatacttagaatgatgaagttgatgataatggcagcttgcatttattgagaggtaaataggtactaatagtaggctaagcatttgtgaatattattttattcaatattcacaacttctctatatagccctctcatttaaatcctttaaggacttcccattgcctttaggataaagtccaaatgttttaacatagtttatgagactctctgagattccacaaacttttgcctctctctcaacctcatctaataccactctgcccctttctggatgggtctggtctcatctatacttttggttcttcctgtgtttatactttgtcttgccaataggcctttaaatatattcccttgtaaccacatttctcccactagtcacctgattatctcatacctccctttaagaccttactattttttttcctgaagaggctatctccagttttccctgttgtttgcttccaaggttaaaaaagaggaaaaactcttttgtaactcaatacttgaaatgactatttaaattgcaccttttctgctagatttaacctctacgaaggctgacaccgtgtctactaattcacagttgtttcactagcctctagctgaatgcctgacacgagtagactttgaataaataattagaaatcaattatatgcaaaacctatatatgaaagttcccatttcctagatgaggaaacaggttaagaggagttaaataacttgcccaaagacataattagcatatggtgaagccaagctttgaatcaaagactgatgtcaaaacccatgttcacaattactctacagcactgtcttctcaaaattccctccagctatcacaggaaaaataaagaatatttctacaggatatttgtcttagagaaaaatttagtagaaaaagctcccaggattcagggaggtgatctttttcccaactaatttcagagctacataaaagaagctcagtgatttaatatctttctgcaccctgggcctgatggtttacctccccaaaatctggtttctgtttctcaactataggtggtagtggataacaggcaacctatagctacagctgttagtccttcccacagatcaacatgcaaaagagaaagtgagtttctcacattctgagagagatgttgcccaggcaacaaagacaaagccagagcaacagaccacccagctgagacaggctctgtcttccgcacattctcccataccagcgcccacttctgtggggcagcagatgactatgttcatacacccttttaatggggtgcccctgaaggactcacctgccacaactggacacagttggcaaagacatctccatggacagcccaaacaatagctccagattcttgctatgtagttgagtgtttaatgtttaatctgtagactatgccagaatagcaactttacaggtgaaaagctcagtagtttcaattttgtgacttgtaataagaaaaatagttgggcactgaattaaacgtttatttagaaaattaattaaaccagtttgcgtatcatggcagccactgatatagctctgcctcttaatagttgtgtaacttttgataagttacttaatatcttaatcatgaatttgctcatctaaaaaatgggcttacaaatataagtaattaccaaagatatctttgtgagaagtgagaaaacaaaggtaaactgcataatatgtggcacataatcaggccgtacatgaaggttatagtaattattacaaataatccctacattataggaattatttgggtttctgaaaaggtggctgggcagaaaagatgaacaatctcttcctttgagtctatttgctagtttaaatttagtggcaaaagcaagttgcatcatagttgctcccgtaataactagtgacatgggctctacaccctgcctggcacaggctgtctttgctgtgtgctataaagcccttaccaggcccaatacagtgagaggcacacagtgggtgctcaagaaatgcttgttgaggctgtcaaccatgggccgtgcaggcagtttaaagcacagtaggcatctggatctttaaaggaaattgtaccgttctaagagtcattaaatgagttcttcagggagggcagtaacaatatgccacctgattgctttgttcagaagtgctttccgactgagttaacctactaaagatgctgttctttgctacataacttcatgactgccagtccctgctaggaagtggcttttcatgatggcttgctggtacgtgtgtacatggaaggaagaggctggctacgggggagagagccccagagcagaatgaagctcctgccaacctgttccagcacactgctccagcacactgttgtgtccttttatgctgtgtgtgtgtgtgtttgttttgtaggggagtgggtgggtacgtctgcagtatcccctacgtttgaaaaacaggtctgaatctcatagaattctgttagaaaatcattcctcaagcataacttaattttctgaaagtattttatcctttgaccaccaaaacctctttggagagaattaaaatggaaaaatgtgttaagtaagtacatctctaaattaaaccatttctgcctgggcagaccaaattagtcttttctagggtgcagggtacagtatgttgtctctggtctttgttcttcagtaaaagacttcagagggaaaaactattctagagtgaataacctccaaatgttaattttgcaaaactaatactagtgactcattaatatttgtaaatcatctagattttgctattttgaaaaaccccataaagtgctaattaataaaagatatcatgtcttattaatgttcacatagtaattaccaaaatcacaaattcatctgctaagtagtcagcaaacaagacaaatgactgtgctcagctgaacagattatcaaatgcctttgggagtacaacctgatagccccaactaaaccatgaatcaagcagctactccttttgccacatggacaggcaacaacaatttcatctctcatgtgaggtgggacagagcagtggagacatccagcaactcgcattccctagagcacacgtgcttatgcaagtgtcagcattgctcgtgtatctttctcttacaagcttttactgacacttaagatttcgtttcttagagagacatgagaaaagactcaaaagatgtcacctaaagttaaacataatcctgctagcttctgcatgtaaaatacatattggtgagccttctcagctctcaaaatggagaagaaatttcatcttcctgtgaacttctatatcagttcatctctgcttctctgtatcagttcatctctgtttctcttctgacactcattacctgtacacattccacacctcctcccctagaaaggcatcttaagaacagagaccatgtctcactagccattcaagtataacaacaagtactactactattaattatttagatgcctaccatttcttatggctataaatgtgcaagtcacttggatgagtgctttaatttatttaacttttatttcttcttgtcatttaatatttacaacagccacttaaggtaggtatatcttcactttaccatgaggcaaatgaggctcagagaggctgagtgacagaactgggattcatccctaggtctgaaagattctaaagcctttgctaaactgtatgctaaactgtacctatgctaaactgtacctatccaatatggtgcctagttgagggttaagtacatagcagacattgataaatattggtagaatgaatgaataccttaatatcaattagcttctgcatccccttggtggttaagattaaacctttgcagtttctacttttctgttttcttccaagtgtgcatgatatcaaggattattgttagtactgtgtatcaaaatgaaagctcaccttaccttttttatatcagaaaataaacacctctccaggactctccctcctagctcagagactgccgggatgatattcactattggacacatttgatggcttttcatttgtattggtgttactcacatgttggactgtaagctagatggtaggaagcagcctagtgttcttggcatctcctcccagctctcttcaacatcctagactccacagcacatggggcggggagctcagggtctggtggccactgacttcacaatagtcaatgtttcctaatggtgggataataggcttttgctagtttaaccctctcagcacatagcattctcccactatcctggtaacagtacctttacccatatagcccatgtgcttggaggaagtacaccctactctcagttctagagtagaactctgggtggtttaagcccatcagcacatcccattggctttgctgcagtgatcagttaaaatcagaagactcagttcaggccagtgagaaacaaggaggtgtttgctggggcttctgggaaaaaatgcttcctggctcagagaactacgagggaagaggttctctctccctgttggagattcatgtagaacaataaagatccggaagatagtggaaataattttggaagtgtaatggaattcagctttaggagtaagcgagatgtcataggaagccaagaagaaaaatggaaaaaagtatttcatttgatgacataggtgagccatgtaatcaagccttgctccaaagctttgacagctccaggtttttccgctacatgagagtctaaatttctttttttgtttagccggttttgagccagattttctctgacttgacactaaaagattctcaatatatctaggtgacaactttgattgtttcatgctcatcctcatatttactcttctttttccagaaaaacaagtatgacagaggtctgaaggaccagaggggaccacttattagctcatcacaaacttgaaacaggcaaaatgtacctgtcagagcctaagtagaactggattgcatgatgtatggcagtgatcttccagagcgctctcaagtgtgtttgacacgagtgaactgtgttcgagttgattctccctatggcagtcccaaagcctaattatgaaaacacgataagatcattgcacagttagaccattgcaccattggcattcctaataaacagatcagcttagcccagcacgatccctagtgggtttgtcggaagcccttcttgggtttcacaaatactaaacattttcaaaggaattagtgaatggtaggagtgcaaattaattcagccattattgaagacagtgtggcaattcctcaaagacctaaaatcagaaataccatttgacccagcaatcccattactgggtatatacccaaaagaatatacatcattctatcataaaagacacatgcacacatatgtttattgcagcactattcacaatagcaaacacatgaaatccacccaaaggcccatcagtgatagactggataaagaaaatatggtacatatacaccgtggactactatgcagccacaggaaagaagaaatggtagtttgttcctttgcagggacatagatggacctggaggccattatccttaccaaactaacacaggaacagaaaaccaagtacagcatgttctcataagtgggagctaaatgatgaaaacatatggacacatagaggggaacaacacacactggggccttttggaggatgaagggtggaaggagggagaggatcaggaaaaataactaatgggtactaggcttaatgcctgggagatgaaataatctgtacaacaaatccccatgacacaagtttatctatgtaacaaacctgcacttgtacctgtgaacttaaaataaaagttaaagaaaatatcagctacttagataatgatgttcttctctgacacccctgtgctgtctttgcttacaaggacaactgcaactgaaaagcacaaagtcagcacaaataagagaattacaggtttcaatgcaaaaccatcttcaccaaagtataatggtagctgcctgaagttgaagtaacagcttggatctggtctcttggacttctgattgtgaaggatgggcccttcccaagtactggagattttaagtacaaggataagaaaggacaggacaacaggagtcaccaaagggggttatccagagagtgagaaaatgggatacagtagcctcttgctttttattagggccagcttcatagatgaacaacttgtgcagtcacacaggaccctgtggtcagaagggcctccttgtttaggtttatgatctgctttcaccatcctgaaatttgaaatactttttgaataagggaccataacttttcattttgctttgtgtccagaattatgtaggccatcctgcttgttatagatttttatttccctctttactaaaaatcacaaggagcaaaaagaatgtgttagtttgctgagaatgatggtttccagcttcatccatgtccctgcaaaggacatcaactcatccttttttatggctgcatagtattccacggtgtatatgtgctacattttctttatccagtctatcactgatgggcatttgggttggttcaccatatgcgttttaatgtatcatgatcttcttttggttaacagtaatttaactccagaaaatacaagaagtttgctccaatatactgccattccctcttccctcctttgtgctattactgtcctatatattaaatctatacatgttacaaacccaacactacagtgttaaaattattgtttcacacagtcctatgtcttttaaagaaattgggaaaaaggagaaaaaatatattttatggaatcttttatactaacatagttatcatttacagtgctcttcattttttcctgtggatttgtgctatcatagagtaccatttccggaaggccttccttcctttggtacatcttttaaaacagggctgctagcaatacatttgctcagtctctgtttatccaaaaatgtccttattttgccctcatttttgaaggatagttttgttagatacagaattcttgtttgacattattttctttttgcagtatggatgtgctattcttcttccttctggcatccatggttttagatgagaagccagcttaattgcatggatgctcacctttctatggtgcgtgctattcttcttgctgctttcaagattttctctttggatttggcatacaacagtttgacaatgatgtgttcaagtgtggatctatttgtatttatcctgcttgggtttctttgagcttcttgggtgtatagattaattttctaaaaaatcaaattttggaagttttggccattattttttcaaataggttttctgtccctttctcttctctccttccgacattcccctgacatggttgtttctgtgcttgagcttgtcccacaggtttttgagggcctgttaattttactgcagtctgttttctcaccattctctagattgagtaatttctattgatttatagttcactgattccttgtctctcaaatctgttgttgaactctctagtgaaaaattttaaattaccattattgtacccttcagctacagaattttcacctggtatttttaaaataaattcaatatccttattaagaatctatttgttgatctcttgttaccccacttttctttaattctttaaacatggcttgctttagttctttggaaatatttataatagctgccttgaaatttttgtccacgaatatttggtaacacagagtttctattaactgtttttcttttcttgagtatgggtaacacttttttttcttaaaaatgggacatttaagataacacattgcaacgactctgaattctgatattttttttccctttatggtggttgttgctggtattttgtttgtaactttcctggactaaatctgtgaaatctgtttcccctaggctactaatgcctatgctagtctaaaatatatatacattcctgattttatttatttatttatttatttactttttttttgttttcgagacggagtcttgctgtgtcacccaggcagtgcagtggtgcaatgtcagctcactgcaagctccgcctctcgggtttatgccattctcctgcctcagcctcctgagtagctgggaccacaggctccgattttatttttaaacttggcttgctagaggttgctcctgtgtctgtatagccttagtggtcagctaatgattgaacatcatttatgttcaaacaccttaaaccactaagatttccatcctttgccctttttcacctattttcaggtagaggagcatatacaaagttcaggctcttttcaagctcccctgagtctgatatctgctggacctttttgagtctcctatgcacatgcattgagactttgggtaaaccagaagcatataaagggcttctgtctcttcagtctccactgcccatatgcacagcctcagccagcaatatgctgtctctgatcacaactgcaacttcaggctgatggagctgatggccctcccaactcactcccatccaagatgatcatttctattgacaactttgcttggtgtctgcactgcccagctcttcaaactggttgagtctccttcaacatctacagagaagctactggtcatcatggcttgctgtaccttggcagaacctataggctgggttgaggtggatgagaggagccctaggtcagaacatctcagattcccagtgttcctgagtgatgtcccatgatttttaaaaaataaacacgtctcaggttgtcataggcctttggctgatttccagagcacaaatagttgaagtttccaactttgcacagctctatcattgcattttgggaagaggatttacccaacctcctcctagagtcatagctaaaagtccactctttgccttgggttttgactcgtctctctcttcttccttcattttcccctttcacacacttaagtccaacacttgctagtggctctagagcaataaaatctttcttgcacatataagataacttcagcaacagattatatagtactattgatataaaccacgcagattaacttgcggcaagtaaaagcattcagtgaactctctaaacaccgcttgccatctatccttaggcttgtggcctttcctgcaggcaaggagtggtggatatctgatgctgcctgcatgctgttacacctgtcacaactctagcacacatcactaaatgactgcaactttcttccccactaaccctagacatggtctcagaatcttcctcagacagaactccaggcagccattatatggatcagaagatgagaccttgtagccatactttcttctttttttttttttttagatggagtctcactctgtcacccaggctggagtgcagtggtgtgatctcggctgactgcaacctctgcctcctgggttcaagcgattctcctgcctactctctcctgttccctgagtagccgggattacaggcacctgccaccatgcctggctaatttttgtatttttagtagagacggggtttcaccatgttggccaggctggtctccaactcctgacctcgtgatccacccgccttggcctcccaaagtgctgggattacaggcctgagccaccacacctgaccaccttcaagtccccaaagctgaaatgtataattcatcgcactatctgctgtgcttccacatatcagtcaaggcttggggttggtttcctgaggaacatgtctttttttacttgtgcctcaagctcagctcctgtgacagtttttcttctgaacctttgcacttattcctttggtgatttcatcgattttcatgattttaaatcccatccatttattggccctttttaggtttatatatatatttttttagatcagatctctcccccaaactccaactctctacatgccatctccacttggaaatctaaaggacacctctaagtcaccatacccaaaactgaactgttcccacctggggcctcttccacctataggctttttccatcttgattgatattaatttatctgctcagatgctcagaccaaaaaaaaaatcaagttattcttaattctcttcattctctctcataccatcaggaaattctgctggttttactttaaaaatgaatcagaaccctgtgccttcttaccacggtcactgctaccatcctagtctgagaaataccatctttcacaggactattgcaactggttttactacttctaactttgatctctcatattccatactcaacatggcacccagagtgatccttaaaccctggtatactatactcagcatcgtagccagaaagatcattttgaaaaatgaagctgatcatatcagttttctactcaaaacattctggtggcttcccattttgcttagggaaaaagccaaaggcttttcagtgacttacaatactcttcatagtctgtcttgccaccttcttcaattcactcatctttcactacactgcctcttactcctttccagccttgctggcatccttaatgcttccggaaaacatgatactggctttttggagcctttgcattggctattttcttttcctgaaatcctctttcttcaaatatccaagtgactaattctctcacttccttcaagtctttgctcagatatcaccttctcaatgacgcccaccctgtatttataattgcaaaccctatccttcccatctgtgtgtccccactgcccgcctacctctctcttcttccacatccctctcactcattcccacatttctgttcttttcacagcatattactttctactatatgatttacttatttcctatccttaatgtttgtcatctgtctcctccttctctagaacgtaactcaaaatgggtggggacttttgttcagtgacatatcatttcacagtttctagaaatgtgcctggcatgtaatagacattcaaaaaacatctgttgaacgaacaagtcagcagtggttctatggttctgatatagttttagaaaacatgcaccaaatgtgagaacactttccaaagaaatgtcaggaggagcataggtaaaagaaatgtcaatagactccatgaaaaagaagagtccatggcaaaaagaaaaaaagaaaaaaattgattgggaaatgatggatataatatacttatcttggtcaatcatggggtacattagcatagtaaaagttatgagaagtcctacaggaaaaaaatgggcttaattttattatttaaaaaaagaattcaacacaagctcaaacttcaaaaaaaagatctctatattacattgtataaataaaataagcagcagttttgcgtgtgggctctggagatagactactagggtttatatcttggcttgccatttacaagagttatttgatatctctaagcctctgctcttttatctgtaaaataaggtagtatgtatattacaggtttggggttagaattaagataatataagtaaagagggcctaatacatagtaagaactcccacaattttacaaattaaacaatgatataaatgcctgtgatctgccagttattatccttgattctggggatacagattagaaatcggtccctggtctcacagaatttatgttctgtaggcagaagacagactagaaacgcataaaccaatagatgaacattttctgatagtggcactattatgaagaaaataaatcagggttatgtgatagaaagagtggaatggagggccgctttagattgaatagtccagaaggattttcagaggagtggttgcttatactgagagctggtcagtgaggatccagtcaagcaagggtctctctggagggacagcagcacaggcagaaggaacaacaaggacagatgtgtcaagggaggaataagcttggcttgctcaggattagataaaaagtccatgtggctggtcatgtggagtgctggagaaaaatagcattttttgtagctctaaataacactaacccctctgggtctttatttgtgggatgacttttcaatttataattctttcttgggggaaagaagagaggccctggagggattgtggcaatggcccagtggtctggatgggaagagagaggcaatgatcacagttctacaattcagggagaattgactagcctgttttgaacaggcttcccaggttaaggtggtaatcttttctctccaccattcacaaaaagggcagtggggttaggtggacatgaagtgtcaactcagaggataagggaatatgaattaaaaatgcagaagaaaaagcttgtacctgggactcattgacattgtggtttctcttgaaccctgatgctctcattcttgttgaagcctaagctcatttctctttgtcgatattagaattttatgtctaaaatttcttttttatgtattctcattccacctttctctttttggaatgcagagactagtctcttggaaatagctaaacatccaggagaatgcttagcaaataccacatggtattacttttaacttgcaaaagcttaattgctcaccatattataataaagatcccctcacgtgtccagtgaatgtaaattctcactggtgttccagctagttgcctgaatattttgtttgctattgtgccaaagataattttttttttagtgctcttctatactctatagttctatactctatacttctatagttgagctcttctatgctcaactatagttgaaaggaggagaaagtgatatctctgtaacgcaagccagaaccttccgcaataatacattggcaagtggtaatgtgatgaaaatgttttaggtttaagatgtttcccatcttagtgtttctgagtgcagatccaatctgcttgttattcttctgctacacaatgggaaatggaggtaagaagattgctgacctccctgcagctttgagacaaaatttcttgactgctagctcacaataggccttcttggaactgtccggaaatagcaccctctctcaataatctcttctttctaaatgggcagtgctgttttgatcaacttaaccccagtcaagggtaccctatagcaccaattcaaagattcaagggttgactgtttgcttatcgagatttactcagatgtcatcttccttccttcttggcttttgaggcatttcattattcctagcaactctagtcgagggtaaacaagaggcactgggaataaaattgaagtcacttttagcttcttattagcaggtatgggaaaaacctggggataagttgggtgggtggtagaaaggactgaaattgtccaaagtgaggtttgagaaatatctatgtgttctaattagccccaccttagctttttctttccataacatagtttacagtgagttgactataaatggaaaacacttcttaattctcttaacaattaataaagaagttactttcctatataatgtagaagactaatttaaaagagaattgtgtgtgagtgcacgcatggcatatgtgtggatgcatgcacatgtgtgagtgaatggattcccccaacctccagcagcatatccatgtctggtcatcagcaataatctgaaatatttcctgttattcttcctgaaacaccaggagaatttcaaactctttgaaccttccttagtatgtttgaactgaatcgtttagattggcccacccattcattcagtaactatttacaaacatcactcccttttatttgtttgttttccttaaattaggtcaaagtcatctccagggaactgggattcttgaattcaaggcctattgtatttaaggtttatcaaggtatcagcctgtccctcagctttctatcctggtttgaaaggataatttgaattaccaaagatattaaattgatatggtttggctgtgtccccacccaaatctcatcttgaatggtagttcccataatccccacatgtcgtgggagggtcccagtgggaggtaattaaatcatgggtgtggttacccctatactgctgttcttgtgatagtgagttctcaggaggtctcatggttttaaaaggagcttttcccctttttgcttggcactttttcttgtctgctgccacgtaagacaggcctttgcttctcctttgccttctgccatgactgtgaggcctccccagccatgtggaactgtgagtccactaaacttctttcctttataaattatatttcctttacaaagtgttgggtatgtctttattagcagcatgagaacagactaacaaacagatctttggacaatagattccatgaagagactgaagactctagtggcccaggtggctgaatcttctcctagctttcttcttctttatatacatcccatttgtgatcatgataaacaaggtcaaagagcagtgagaaaaggaaaactaaccacctagtatatgcagagagatatcaaatgctgaagtagatcaagaagacttccttgagcaagggggcagaggagaaagctatatctagcagagatattacagctgtggaggtatcaaagaagctttgagaatctggaaggacagcccaggaaactgtttctttacctgtaccagcactaagcatgctaaaatattcacgtgggaattatatcatatgctgttttaattaaagctggttgtattcaaccttggaattgtaactaattctgtttgctctttgagaaattcttatatatatttttaatatcctttgcttcagcagctgagatttcaagtaacagggattggaaaataatcccatgtgtttccaaccagatgaattttttggttgtaaagttatttcctaagattttttttcaattaacatattagatccttgaggaatatcctggataaacgcccaagttgctctttggttaagtagaatagcacaaagtctgtatccagggaacccaatcctctgattacagagcaggtcaaagctgcaccttaattatttctttaaaaaatcaaaagattttgaaaatgattattagggagtttttattcccattctctctcagataagtattttgtctatgacacctgattcttgagaaaaaaacaagagaaaaaaataaaacctattatcaaccacacttgggataccattaagggccacctcactttattctgaaatttctacttcagggagattaccaagcttccagagagaagcaaaatgagacccatttaagaacatgtgacctatcgtgacaaacggaagttcttttttttttttaagttttttttttcttttattattatactttaagttttagggtacatgtgcacattgtgcaggttcgttacatatgtatacatgtgccatgctggtgcactgcacccactaacttgtcatctagcattaggtgtatctcccaatgctatccctccccctccccccaccccacaacagtccccagagtgtgatgttccccttcctgtgtccatgtggtctcattgttcaattcccacctatgagtgagaacatgcggtgtttggttttttgttcttgtgatagtttactgagaatgatgatttccaatttcatccatgtcactacaaaggacatgaactcatcgttttttatggctgcatagtattccatggtgtatatgtgccacattttcttaatcaagtctatcattcttggacatttgggttggttccaagtctttgctattgtgaataatgctgcaataaatatatgtgtgcatgtgtctttatagcagcatgatttacagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgataagcattttttcatgtgttttttggctgcataaatgtcttcttttgagaagtgtctgttcatgtccttcgcccactttttgatggggttggacaaacggaagttctgaggtgtcctagagttagaagaggtagtttttcataagaaaaaaaaaaaaaaaaaaaaaaaaaaaaagaacgtgtttggtgcctggggagactttggcctcaacaaatatacctgtagcttttctaggtttagctgtagcctaaaatttaaaactaaatatttgaaagttgcatccaatttcctcaaagctgaaagagaaatcagagaccaaactctttttttttttgattgaaaggtgttgctgaggtgaacaaggactattattctaacaacatagagcacgttcttccagatcaccagctgataatgtctgtaaataaggaggggtaatctgaatgtagaatgatggagaagatagaatttgcctttggtatggaaaaaaagatgggaaattatcacttttctactgcaaagcattcatactccatcagttaccattgattaatttatgcatttatttattttccctacaattatgtattgaacttatattagtttctaggcattgaagattcaacagtaaatcagacagacttagatccagtcctcaaagtacttaaaatctatctgtgcctctcaaaattcatatgttgaaatcctaacctgcaaggtgatgatattacgaactggggcctttgagaggtgactagatcatgagggcagagccctcacaaatggaattagtgccattatgtaataggctccagatagatcctcattccttccatcatgtgaggtacagctagaaggcactgtctatgagccagaacacaggccctcaccagactccaagtttaccagcactttaaccttggactttccagcttccagaactaggggaaataaatttttgttgtttataaggtactcagcttatgatattttattatagctgcctgaatggactatgacactgtctaatgaaggacacagacaatgatctaagagtaattatgccatgtaatccatgccaatatgggggaatgccaagtagctctgggagcacttagcaaggccacccagcaatatgtggggatggtggtaggctgtcaggaaatatattccctgaagtggcattttatctgaggcctgaaagtgtgagccaggtaaaggaggattgaaagtaaagagggcaagaaaagagaaaaaaagttctcatagtatgttggagaaactaaaagaagtttgatatgtcttcagtgtaaagtttggaaaagggtagtagaaaacatggctagaggagggagcatgtcttaaagctgtgccaatctgagacctaacttttgaggtctgcatatgcttggactcagatagagctgggtttgattcccagttctcatctttcccagcaacttaggcaagttatgccacttctaagactcattttccttatctatataatggggaatatacctacttcctaggattgcttggaaaattaaatgatggagcatatttgtacctggcagattggaggtattcagtacatgggagctacagctgttgctgttactacagtcaaatagaatggcattccaacaaggaataatgtatcaggaaagtaagctctgctgccatcagtttaggcatcagcagagccacatatgttgacattttggggtagggtaacttcctgatgtgtctcagtatcttatcttttgagagtttagccctatcctttgtttcaagaaagcaaagatttcctgctgtaagcagtggagtcatttgatacaatcattgtgcccatccattattacactttgtcctggtcattcatgctgcctaagaagatgcctaaatgatcatcccactccccctctgagtgggcataagaagtaaatgaaataaattaatgcagtggttgctaatacctatgttaccttctttttgttatcagcattaagactccttgtaagcaggaaaagaaaaaaaaaaaaaaccctagacagttatgaaggatggtttctcaaaaaaaaaaaaaagaaaaaacaagacatgtctattgagatttttacagtcgttttgattgcttttcacatcactaggctcaaacaaacagaacctctctgtacagagagatagtaagaggacatgcacaaagcactaaagctctctctgagccaaaaaaagaagcctgtcatttcatttcgtttagcccctacggctgtgggcttggtttttctatgttaatactctaacacacctgtactgagaatttactccttgccaggtaactggggatcatagaaataaaagacatactctaagccctcccgaggtccttgttctgttgtgggagacaaaccagtgagccagggtttttttttttttttttcttcaatgctgtctaatggacagtccctgtactaaatgcttcatatactttattaaagtcctccaaatcattcttcgaactagacagtataaaattccatttgtggataaaacaattgagatttaaaagtggttactaggctaggtgtggttgctcacgtctgtaatcccagcactttgggaagccaaggcgggcggatgacctgaggtcggcagttcgaaatcagcctggctaacatggtgaaaccccgtctctactaaaaatacaaaattagctgggcgtggtggcgcctgcctgtaatcctaactatttgggaggctgaagcaggagaatcgattgaaccagggaggcagaacttgcagtgagccgagatcataccattgcactccagcctgggtgacagagtgagactccgtctcagaaaaaaaaaaaaaggggggttactagtaacttccccacagatagataggtagtaagtggcagagctgggatggggccagggcagtcttgcttttgcactttatgtcacgctacctccacactcctcacagtctgtcagtgggttactttgatatgtgttattaaggggttacttaaatactaagtactgtggaagaactgtgggtccacagagaggaggggcttttgacagaaggcagagaaagagaaagatggagtcagaacaacttgccaagggaggtggcctctgctctgagatttgaaggctgagcaggggttggccatgtaaaagcgtgaggaaaggagacatcctttgagctagagtgagccgcagttacaccttcacggaggcttagagaacaggatgtcttcaaggagctgcaggtcgctcggtacagctcttggttatctgcaacaatagagggaatgtgtgggacagatgatctgaaatttatgtctgtttggcttctgtatgtacaatgtttttatttatttatattctgccttgttccacaaaggttttgaaagaaaattcattacatggtttttatgcagtgaccttcctaattaagtttttctcagcactgtcatgttcgtctttgtattccctgagccatatgcagagagacttgaacaaaagttgaattgaatttacatactttgagcactctgtaagcagttagcaagggcaactggtcccagaagcttgtgggtggaaaggaaaaattttactgggccaaaacgtaaaattgcttagattgaggtaccgtatttcatggattccaacacactattgattatagggtatgctgttattaaacttgaagtgctatcaaaaaagaaaaaatcctgttcattaaattatagcacaatataaactcactatctattgcaagatgtactctgatttcagatatattaaatgtggaaaaaaatgtgtctttaaagagaaaatgcatggtgatgatattaactcccaccccaaatggtcagaaattctaaaatgtactgattccctggttgacatgagagaaaatgagaagtcttacacatttctggatggcaatttgcccaacaacctaagcccaaaagattctgcaaactctgacctagcaattatatctctaagtctgtgggttcagtttttctatgtaaaaaataattaaagttaaagaaatactaatttaaatttaaaaagttacattgcattttaaaaatcaggtaataaagtatttgttataaaattactcctgtgaaaaaatatatttacatttcatgtttacataggaattaaaatcttgaatgacatatcaaaatgttgacagagattgtctggatgaagcaattttggttgatcatttttatgttctaatttttcaaaaattggaaaactactggttagataatagcctttttttttttttttttttttttttttttggagacagagtctccctctgttgtccaggatggagtgatggagtgcatggagtgcagtggtgtgatctcagctcactgcaacctccacctcccaggttcaagcgattctcctgcctcagcctcctgagtagctgggactacaggcgcatgctgccacacctggctaattttttgtattttagtagagacagggtttcaccatgttgcccaggctggtctcgaactcctaagctcaggcaatcagatatgggcctttaagtagacaatacacatgtgaatattggaaaattaactcccttgtcttagcaactttattttttatgaagtaggctcctgaatctttcctgtctcatcaatgagtctgtccaggctccaggtggttccaactgaggccctggttaaaagggtgtgaagattatttgattcccaattggaaatacagctttatcacctggaattttcccttaaaagttgatacctaaaaggagaaaataaaaataaatacttctacctcagggtaccagagggtctggggaatgagatctttatgatgtaatcttagtctgaggcaaactgtgagaccctgagcacatgcaagtcacgttcaaggtcctgcgagtgggaaagagggtgatgagcagaagtcaagcttaggcttcaacttttgccatcgcttaaatggtaaatcctccatctctaagagtcacactgctacaaattcacaacttttgttttgtaagtcattcataattcttcataaatgttttttctaaaagacaaactttttggtggcctaggctccactttaaggggaaaatgcaacactgactatatctatttatgaggtgaactggacctcctgcttcatagaggaaacatttttgaatggtcaaacatagtattcctgcttgaataggaaaaattgtaacaatgcatttggtatttgtattttatccccaaattagtgagttgcctttttgacatttttttcaaggtagctttatatttatgtatagcttgcttttaaaaaataagctgttcttatacttcccaacattatatacctaactgttccttaatttaaagctcagctcatgtacaagttttattttgcaatcaagttttatttacttgtttatagagtttggcttgtcattgctttttgtcagctctgcaaggtttgagccatttgtaatctttgaatatttacatagtatctatctacctacacctattttttatataatgtatggcagttgtaacctaaaagagtaaaacaaagatttcaagtgccatggaagtctaggtcaagaagagatgagttagcatttggtgaacaaaagtattctagtgggcatctactgtctgtctttcttgcatcattttcttctttctctggatagcagaactccatgttgatctttccactccactttgtcttaatagagctacaagtctcagagccctgccctcctggctgcagattcaggcctggatgattgaagcgccacatctacttggccaggatagttgattcaaatgtgaacatctattccaaatccaacagagaacttctctggaatatttatatatggacacagagaaaggagaatttttctcccttttttgctttcattttggattgtgagccataagaatgccagtcaggagttatacctacttgttctggccagatggaagaagtccagatggaagaacatttgctaggggaaaaaaaaaaaaacataaggctactgcccaaggagaacatatctaaaaagggagcacagtgacacatatttaatgagcccttagagactgaatgccacctctaccctttgatttcccaacaaaatcccttttccttttcttcgtataaacttgatagaattgggtttccgtcatttgaaactgcccaagtgcttgactaatccttggccccttagttatcttccaaatcacactaggtgcatacatatcctccccatgcatccacagttgtctgtgttccactgaattctctatcatatgagcatccaaacaggtatgattttattaaattagtatcagtgtagttactctaaagagaatatgagtgatttcagcctagtatattttccataagccgtagccttctcctggaagtattccttgttgaatagttctttgccctagtgttcagactttagtactggactaggacatttgtccaccgctggtgcatttagagcctcgattttacattgctgaagacctagcacaatcagaaggaatgagtttcctggagacttgtcttctttgttctcaagattaccaaaggccattttagaaagaaaatgattatgaggctacatgaaatgcaataagattttatagcaatcaagcctgactttggaaggcagctggaaaacaggacactcctcctcccaccctttcttctccccaacaaatgccatatgtctgttcacaatgcattctggctaactgctatgtggttgaccttcgatactgaaaaaataccaaaacacttgggacctaattttcctttcagctcattgttatagtcacatttaatatggttgagggaaaacatgaaaattatgacaaaccggcctgaaattctttaaggtagtccatcaataagacagatctctggataattcataatacttgtgatggttcagagaaggaggagtctttggggcccttgaaaaatgatgcttctgttgcttaggggtgtgttcagaaccacatcagcatttatgtcatctgtagaaaaactaaaaaacattaggttggtgcaattacttttgtgcccacctgatagaacctttccacttcctttttctatgagcaattaattcaatttcagattactatattggatgcagaacagttaatagaggagtttgctagtccatgtgtggcatagcagaatgaagagactttttattgcatctgtatagtaaatgaaatttcctccccaaattaaaatagcttttgtgttggtttcttagggctgccataacaaagtcacaaactaggtgtcttaaatgacaggcatttattctttcacagttctggggactagaagtctgaaatcaaggtgttggcaggggcaaccaccctctgaaacctgtagaggagaaccttttattgcttcttccagcttttggtgtttgctgccaatcttggcattctttggcttgtagatgcctcactccggtctccgcctccccagttgcatggccatcttcttcctgagtgtctctcttatgagtacaacagttatattggatcagggcccactctaattcagaatgatctcattttaacttgatttttcagattacatgcgcaaagactcttttcaaataagatgacattctgaggtgctatgagttaggactttaacatattttggagagaacatgatttaacccttaacagctaaattgttgcctgattgtaaaactaatacaattagtgaaaaagagaggtataaagaagaaattaaaaatcatctagattcctcccaccaaaaataaccatgttaacaatttggtggatgtcttttcaaatatttctcaaaacaaatgttcttttcttataccgtcagaaataagtcaagttcaaggacagaagcagttgaagatgtctacagttttgtgcaaattataacaaatgatgctgtgatgtgtctttcttctttcactttttagttgcacttgtgcaattacttctttaggataaatgcttagaaatacaatgtctgtgtagaagaaaaatatgcatttttatacatattatcaagttatacactagaaagaatggagtaactccattcccaccaataatgcatgagaactcctgtttctcccatcttctttgtcctttagattacaagtattagtatgatatatgttaaaaactttaaatttatgaatatttctatgttctcctatgtgaaattctaaatcatggcatttctttattcttaggtaataaatgtgaatccatagtttttttttttttgagatggagtctcactctgtcacccaggctggaatgcagtggcatgatcttggctcactgcaagctccacctcccaggttcacaccattctactgcctcagtctcccgagtagctgggactacaggtgcccgccaccacgcctgactaattttttttgtacttagtagagacagggtttcaccgtgttagccaggatggtctcgatctcctgaactcgtgatccgcccacctgggcctcccaaagtgctgggattacaggcgtgaactactacgcccggcccaaatccataattttaatctagtattttcacactttgataaatttctaattctgacccatccacacatgtttttagtacagggtatggaattgcaatccagagattctgattgaactgagttttatttctttattaagtcactcaaaattacattgtttgggaatgtgaatgggaaatttagtgtgtttcctgtttgcctttccaagagatcagtttcatttaatcaaaggccttgtactaattcacagaaaaatgcatactcaaaaagtaatcagggacataatgttgagccatggtaataagcagtacttttagcttcagtactcatagttaattgaatttatcaacattcttgctgtaactaaacccttttctctcccattcagcccatgaggttgtaagaaagtaaatgacattacagggttaatcttgactccattttaatgtgttttctttaaattgcaatcttggcacatttgggccttttgattatcagtagttgaaattacttgccaaccatctttcaactctttagaatggacttgatgttaagacccctggtttagagaggcactcattttttttttttatagcagaaaggcataagctcagagagaagtattctttccccagagaaaatctgtaaggagttatatgagaggatccaaatccagcttactgaaacaagcactgttttcagataaaatgaagacaatatcccttcgtatctctttccgtgatccttcacatggattcactattgaggaacacttgctcccaaaatacgcccttcttcacactggccttttactgctaactttgtattggattggtgggtgattctgtctattctttcagcctcattgacatgtgttcaaggagaggcagccccaacaccttgtctcaagtggatgacatttcctgtcagtaacttgctatttagctacagagaccagcctcctcatccttatctctttaaaggagtaaatgaatacaaattaaagttttaatctcagactgtaacatcaatagtattttcactacaagtagttccataatggtctcattactgctcctaagtgcaatacgctgagacgtctaaattgccgattgccactacatatattctttgagaaaaggtatccaggtaaccatggcaattgtgtctccaggcaggatgggagtggggtgggaaactatttcattaattgaagggaagagattgaaaagagattttcaagctttagatcagagagagaaagaaagaaaaggtagatcccacaaccttattttgttttcattattagattatgcaacccaaggaaacgccaaacgatttgaaaggttcagagaaatcacaagattaaataacagcagcattcttagcctttccacattattacagtggttgacctgtaccagattttctttggctgggttttatatagtttgattgaaattcaatatatctcctgagaaagcagaattgtgtcccatgatttaaagagaaaaaaaaaggaagaatactcacaggagcgggaagactgtgtaggtggtataagagctctatttatttcaagttgatagcacctgaaaaggctgattttatcagtaaaattcatttgcaaccttgcttccctgcccttcctccacccttggtagtcctcaacctttaaaacaatttattaaaggtaaagaaatactgtgatgaaaaaagggcatctagataatagggaagaagaaaacgaatgtctgatctggtctctcagaggagtctaatagtttgttttcattgaaaaggtatggcaaattagtgattagatcagcttctgttatttaaccaaagatgccctcttgtaacttactgtgttgactctttgacaaatatgttctaacttaagatttgcaaaaccctcatttacacagatagacaaactgacttctagtatacgttagccatagttggggaattatttttcaaattaggccaacatacagcactttaatgacccatgttaaatctctgtaactcctgatgaatacctgctttgtacttcctacacactatactatctagttaattcaggaagaaaaatagaagacattagatgcaactattaccaaacagggtagtgaggacttggatatgttcttcaggttccttcctcaaaatttaagtccacttttcatcaatcactgggagaggcaatgtaggaaaatttatttacagaaatgaggaaagcaacctaaaactgggtggataattattaaccaaatggattttattttaaaacaaacatttcttttctgccaaacagatttttatcttggaaagcaaatacttttccagaattgggccagaaatcatggtctgaattgtaatagttgtttgggcactgtccaagtccgatatattgactaccttgctccccactgcaacccagaggcttttcgtaacaagaagctaaagttgtgctgctatagcagctgctgatgatgttttttaagggctgtgtgcccagggtgcacccactggagaggcaataggaaataaaaatagcaatttgttttcctaaagtttagaggacagtgggggaaagcattttcagccttgtcatcagggataacatagttttatattgtgtgcacataagtctaatttttgaagacagaaaatcattgtgtaaggcaattcgatttgagaaagaatgttactgatggtatgcaagaagaaccattgtttccaagaatgagctgagacacgtgtcagatctttctaatagccaggtgttactatggacccctgcctaatggtcagtgtgtcgtcagctgctggcaactcttaccttataaagacaaatattgggattgtgcagagactgaagtgtgaccagaggctgagtgagatttgttacatttgggctatcgattctaattcacaatttagtttttgagccaagccagccgttagtcatgtggattctataaaatgatttatctaaaatctctttatccctgtgttcccttttaacgctgtagccgcttaagcaacagctttacacaaaaggacatacaattagctagtagcgagtatagcccaactacccctgtgcacacttcagcaatcaacttgaagcagtaccagatgaagagagacaagtctttttttcccatctttcaaaggtggctctgatatctgtcttccccctgtccccccaccactgcttggagtatgataggacaacagcaagagctcacatgccaagtgatgcttgaattcatggtaattgctcctccttccaagttctggggtgtaagttagagtctttcattgcaagtttcattttcaaaaggcagtgcaatcaatagtgttacttttctgagtcccaagtctgttgcttagtctcagcatctctgatgactgtgggtctattagcataagctagaactgtaagtggtgaatatttttattatctaaaattacactagaactgttaggccgaaagattacaatttgtcactgaatgtggatgtatggagaattgtatgtagagtatataaaatcttttctatgtctaatttgcattgcaaattgagaagctaaccagaggtcttgaggaaataacataaataaaacatggcttcactactgtaaatgctcaattcatgccagaggaggccgaagccattacagaaggattgtttccatctaaacaattcccatctcacacacttcccttctaaagtggctgccaataggacgggaattgggtggttggggtaggggtgggggtatccgtttagacagctttaaaaaatactcagcagagaaagcctgagagggtgtttctcaagaaagccaaagtcaaggctcaatcctgcatcttgttttatgttgaacatcctcacaactgaaggaaagacagcaacctgctcttcagtttcagccccaaggaaccagagatctacacaaggtcagtaatcagacaaagctcattactaaacgtttagggaaaaattccataatatgaggcagatgccttggttagtttacagacaacattcaggatctctcaaaatgtgaacttcaacttcagtggatatttgttatatttctgcacagcatttatgctctcttcttgtgacaacagcaccccaattctactttggggtctatctcttcattattctacctgcatgtgctttgcgcctacttcataatttccaaagcctgaatatgtggtttagacatctgtgcagtctgccctctagtgattggatcaggatcaacagggaccagcacgtgactgaaatctggtcaatgaaattcatttcctgttttttctggaactgttggagaagtggactgtctcagtcgctgagcttggtgctttgtgtaatgagatgattgaggcttggagctgcagccagagaacagagccaatgggacagaagccaagttgagaggccagaagaaagacacaaggtgcctaactaaacatatggtttaaagccttatatacctggggccagccctattttgtgactgcttgatgaggcaatacattctcttgttgctcaaatcacttagactttctgtgagagatctaacggccatatgcacctttctcaccactgtcctttcacatctcaccatctaccacttccttctttggagccgctgtaagtgaacttggcttagccatgcaaccctgtgttctcatgagtccatgcttttgcttatgctaccacttcattaggaatgcccttgcgttctcttcttttcctcaaggcgaaatcccactaatcacctttcatgttcaacccaatcaccttctctgtaaagggattcctaatgaagtggtagcataagcaaaggcatgcactcatgagaccacagggttgtgtggctaagccaagttctcttcattcatatttttcccctactcctctcaaggcaaaatttaaaacttgccatgctgtgttcatataatcgtttcccttaccctataaacccttaacactttatgcaaatactttttgagactgtctgtctctcccatgaggctttaagactggggactatgtttattcaacattcagaggcaggaaacattgttacgggcatgagctgtctttggatgcagactgcctgggtttaaacactggctctgctgcttcctaggtgtttggcttaaatatattatctactctgtctgtgccttggtttcctcatttatacaacgagggataatgttaatacctatttgtcttataggttagttgggaggatgaaatgacttaatgcatgtgaagtccttgatactgttcctggaagatggtaaaatttcaataaatattagctattattattatatttctagtttctaatagtgcctgatgtaggtacacaaaaatataaatgtaacaatgaaaagaaggcttaaattctttaagtcttatatattaagtagaaaacaaagggaaaaaaagaaataacttaatctttataattttgttttcttaaattcatgtgttcctatgagaaatcatgaatcattaaaggaaatttggctgatttggggagatttgttcatattcattcatttggtgcaaaaacttctattaagagggcattatgattggacttgagagttaaaattaagataatatccttactttcaagaggctcatggtttagtagatacatttgacaggtaaataagtaactataattgagtgaatgtgcaacaacagaagtatgcacacataccatgagggcatagagtaatgtttcctgaaactgctgtacataagactcatctaaggactttgctaaaaatcacagaatctcagaaagggcacccatggagcttctgaaacactgggtttggggtcatgtatctgtacttgtaacagaacttcatgggtaattcctggcataaaagacaggataataactttttgcctgaataggtcaaggaatgctgcatggtgaaggtgatacatgtgctaggtacttacagatgattaggagtttgctaacatttgacatgagtggtactattaagcttcaagaatagtttttttttacaatcaacaaagtgaagagacaaccaacataatgggagaaaatatttgcaaactatctatccaacatgagattaataaccagaacatataaggagctcaaacaactcaatgggaaaaaaatctaataatttgattttaaaaattgacaagagttctgaatagacatttctccaaagaagacatacaaatgacaaataggcatatataaaagtgctcaatgtcattgatcatctgagaaatgcaaatccaaactacaatgagatatcatctcaccccagttaaaataaaaaccagttataatggtttttatccagacaggcaataacaaatgccactgaggaagtagagaaaaggcaagcctcttatgctgttggtggggatgtaaattagtacaaccactaggtagaacagtatgtagattcctcaaaaaactaaaaatagagctactatataatccagctctacctagcaggtatatccccaaagaaaggaaatcagtacatcaaagagctatctggactcccatgtttatttcagcactattaacagtatcaaagatttggaagcagcctaagtgtccatcaacagatgaataaagaaaacatggtacctatacacaataaaatactattcagccataaaaaagaatgaaattctgtcatttgcaacaacatggatggaactagagtacattatgttaagtaaaataagccaggcacagaaagacaaacaattgaactcatggagacagagagtagaatgatggttaccagaggctgggaagggtagtggggataggagtggggattaatgggtacaaaaatataattagaaaaaataagtaagagccagtatttgatagcacaacagaatgattactgtcaacaataatttattgtactttaaaaaatagctaaaaggatataattggaaggtttgtaacgcaaagaaatgatgaatgcttgaggagatgggcaccccatttatcccgatgtgattattatgcattgtatgcctgtattaaaatatctcatgtacctcataaatatatatacctacattttacctgtaaaaattaaaaataaggcaatcagggaactttgaacatgatagataatttatgttaaagaagtactgttagctttttaaagcaccattaaaaaaatgaatagctttgctgatatcactgccaaagacagagcacagagcctgacagttgttctacttatccaaaattatgtcacattttttaaaaaaaatttaagtttcaagttggcagcacagtgaatcacctggaaagaccttgaaatatggtgacatttggggcccatcccctgaagttcaggttcaactgctctgagacaaggccaaacatcagtacttttccaagtactgacagctctttttaatgcttttaaaaggtagtgaaaataaatatacagccaaagagtcactgtttaggctgtacatagtatccctagaaagactctaagtgctggacctaacatcacaggttgtatgctcccagatgccaagacagaccaagtctcttgcttgaataaatgtcaaaagagggtgactaaagtcatggtataatttccaaggtttacatgaacaaattaatgctgttagcacaaaataggatacaaacaacataggtatgccatttaccaggtaattaacagatatataagaaatatttaattcttagtgccaaaaattttcggcaatatggataaaacactaaagggtgtaaatacagtcatctttaaatcctggtatactatgatggtatacaacctcaggtagagataaggtcaagcatctaaatttgagatttttcatgattgaaagacccaggcaaatggcccttctatctaagacctcacttaccacttggcagttcttcaaattcactcctggagatgaactccagatttaaataaagcattatttctgagaatggtactctggaatctcttttttgtttgtttttttttaatatcagctttattgaggtataatatacaatagaatgtatgcattttaagtgtacagtttgatgggttttgataattattatacccatgtaaccagtaaccaccaacacagttaagatatagaacatttccattccccgtttaaagttcctcatgccttttttttttaaaaattaagttccagtgtatatgtgcaggatgtgcaggtttgttacataggtaaatatgtgccatggtgatttgctgcacctatcaacccaccacctaagtattaagcccggtatgcattagctatttttcctgatgctctcccccatctcccgacaggtccctcccaataggccccagtgtgtttttcttctccctgagttcatgtgttctcattgttcagctctcacttataagtgagaacctgaggtgtttggttttccgttcctgtgttagtttgctgaggataatgagtccaagcttcatccatgtccctgcaaaggacatgatctcattcctttttatggctgcataatattgcatggtatataggtaccacatttttaaaatccggtctaccactgatgggcatttgggttgattccatgtgtttgctattgtgaatagtgtagcaatgaacctatgcatacatgtatctttataatacaatgatttatatacctttgggtatatacccagtaatgggattgctgggtcaaatggtgtttctggttctaaatctttggagaatcgccacagtgtcttccacaatggttgaactaatttacatagaatctttttttttttttttttttaaagctcctcagtgacttaatgtaggtgatccaccctggcattagaggatcatggaaatttataatctttggcacttttgtaatgctaagattctacaaataaaattctacgtatatgagtaaactgaaaatattattatcatgatcttcaatatcttcccatgggagtaaaggaataactctccctttctttcttgccctgttgattttttaaatcctttttttgggatgaccaagtcctttgtaatgatcacttattattacaaaccaagataaacaacaccataaagtacttgtggtgatttttttttctccatccattcactctttttgacagacaacagcatcctgctggggcacctcttttccatcactgtgtgtgatcttagtgaggctgtcaatcaggatgccttgaatgtgatccaagttaaaatgatcacgttgtctctctcaagactttgggtattgagctgagctacacaaggatggggaaaaaaagttggggtcgattaattcctggaatagctttcagatgggacagtcaattggatacatagacaccctagctgcccagttccaaccctttctcagctagattttcaatgtgctgaactacctatgttctgccaacaatgtcctgttttgctagctttagccaggatcagtttccgttgcttgcaactgaagaactctataaggtacaatgttataagaaaggcagtaacaccatctgtatagtctggaaccgcaggatctggtctggtgatagattatagctaaggtcagtggaaagtgtgagcgagtgagattatgtgattaaccttggctgctaggtatgtgagagtcataagctttagcaaatggatgacctggatggttatccacttcagacaaaatgttagcaaatgaatagaaacagcagataataagtgagaggggtaggggactaaaatcatagtaagtttaggcagatagctgcaaagtttcaaaataaaacccatctctgaggttaacagataaaatatgtaaaaatgataaacaatatttagaatccctggcttcacaagccaaaagctaaatggctgatactcagttacatgccctcctgctaatcaaaacagagcactgagttataaactagaaagtgtagtaagaaatgcacatgaatctgcatctgaacaaaactactgattgtgaataaatctgcaacatggcttctgataaagcatttactctcctcatttgctcgacctgtagctgttgcattcaaaatacatacacatatacttacacagacatatttatatttgcaatttataatatgtctgaaatgtaatactccagttcatttgcaaggttgctaccaaggtatacggggtataattttatcatccagggcacaatggatacaccagctccaaacatagaagtcactgagttgccatatattactatagaacaagcattttatttcaaacgatgggaacctcacataagttaggggaggaaaggcaaaaatgaattcagtggtgttaatggagttggtcaaatacttgttatttaagtcacaaaaagatataaagtgatacaaaactgaatttgctaaattatcagaagaaaatgaatcccaccaagtgaagaagttaatatggcaaaatggccaatgtttatggaatacttagcctgtgttaaacattgcactgagcccttcaataaacacaatctccattaattttataacaatcccatgaagtagttattattcctatttaactgttaaaaataggtttcggtgactatcggctactgaggatgtatccaatgccaaactcctatgtaagaatgcatacatctaaacacaaatgtggatattttaataagacattcaaagccagaaaatgggtagagatgcatgaaaagagaattggtagcatcaactagtttggttgttcactaagaaagaactgaagtctccagtatttctaaattgggatatgaatatctaccaattggtatctgtgaggtagacttggggggcaggtgtgcatgcaatttaattttccctataaataccacattatgacagcatttccctgtagaagagaggatcacatagtttggttttaccaagagacttttttttttttttttcagtttggggagccatcagagccagtctctctccctcctccgaacctcactcctggaaggtgttttcttggtattagttctccaggacctcaaaatatatgaggatactttaatacaactactgctctgctaaaatggaatgactaacattgaaatgattcccatgtcagtttttaagcagatcagttggacctccagaaaatgtatgaattgaaaagacatgcttcacttagaataatagtctccaatctcatccaggtcaggaatggaaaaccaaacattgaatgttctcactcataagtgggagctaagctatgaggatgcaaaggcataagaatgacagtggactttgggaactcagtgggaaagggtgggaagggggtgagggtaaaagactacaaactgggtgcagtattcactgcttgggtgatgggtgcaccaaaatctcacaaatctccaccaaaacacttactcaggtaaccaaacaccaccattccccaataacctatgaaaataaaaaattaaaagaaatgaaaagagagccgagatctttagagaaacacacgcaccagtacatatgtgtatgtatacatatatgaatatgtgtatatatgtgtgtgtgtgtgtgtgtgtgtgtgtgtgtgttgagttgagggtatagtggcaatgatactactgagtgtttcctttacttagctcttaccccaaaagacatattttctaatcagtaaaataaaccaggtacaatcccatagtgtaggtatttccaaacttcactgaccatcagaataaaaatagccagagtttctctgaatgcttactgtataggaagaaccatgatgaataacttatctgctcgatggtcctcccaagtaggtataatttccctctttcatagatgagataatagactcagtcaggttgaattatttggccattaactcatctagtgagagtgaaaaccataatttaaacataagcagtctttaccaagagctcatactctaccaattgtgctaaaatataatacattattgttggagcctaggaatcagaataattaaaagcccccagatgattcttatgcatccagctcaatactggtccaagaatccactggtaagtctttgatgtgcatatcaatcacctacagattttgttaaattataaatattgattcattaggtctgggtgtgggcctgagaatctggatttctaacaagttccaggtaatgccaatgcctagactacattttgagtagcaagtaaatagggcacagcattcagttatacaatgttttaaattgttctgtaatgaaaactataaattacgtccccagataaattggaagcacctgaagtatcaattttacagtatctccatatgctagtagtactagacccataaaaaaattaagccattcaaataatgcttggtaagtaattcccaagagaagtgctcttctgactctttttaacacccagcacaagaagaactggaacaaaggggcttgcttactctcagagtgcaggtgtcctgatttacttctgcatggaagaggttacagattctgtccctctgtctggtcacttgataggttgtcattaacaatagtcttctttctattacttttttttttttttttttttttgagacagagtcttgctctgtcacccaggcaggagtgcagtggcatgatctcgtctcactgcagtctctacctcctgggttcaagcaattctcctgcctcagcctcctgagtagctgggattacagatgcccaccactgtgcccggctaatttttgtaattttaatagagatggggtttcaccacgttggtcaggctggtctcgaactcctgaactcatgatccacctacctcggcttcccaaagtgctgggattacaggtgtgagccactgagcctggcccaatagtcttctttctaaggagtctaagaaaatagttatgaagggatatcaacaaagtcattagaaagcagaacaaaggtaaaatacacatgttctttgggattaaagaaattaagtgcaaaaaaccccacaattttctcccatcaaatttccattcaatttttttcatattaattattacaaggtttttgcacaatttattctcctatacactttaatctcatgaatggaaaaaactttgcctgaattcttgactcccatgctctttgttctcctatctgatccccaactatgtggaactgtcatcacagaaaaataattgccctggtcactccccagaaagcttgctcaagattttatccacttttgtttcaccaaagatttgatcttggggaaaaatatatccaactcagccagcttttgaaataacccaggatattgtcatcatgcatattttagaaacacttcaaacttaagagtacgctccatctctttccataagtctccccatgccaaacacacagaccagtccatagacttgagattatagctctttccagaagacaatatgcatatgtatgtatatatctgtcttagcccatctggtctactataacaaagtaccatagactgagtgccttaaacaacaaacatttacttctcacagttctggaggctggaagtccaagatcaaggggccagcagatttggtgtctgatgaggactctcttcctggtttgcagatggccatctttcacgtgtccttacatctttacatggtggaaagagcaagggaactctctggagtctctcttttgagggcattaatcccatttattaggattctatcttcatggcctcatcacctcccaaaggtccatctcttaataccatcgcttgggggttaagatttcagcatatgaattttggaatacataaacattcagtctatagccatatcctagagtttctaatacattttggaactcaaatatttcattattgggaagacatgaatcaccaagtctttctccaagtaaaacatattgtccaatattttaccacttgcagtaaatatgtgtgttgccatctggagctgtgagcttcaaaatggaggggacatacactacccaggtgagtcttatttaaaaatgcagatttctagattctatgcccagcaattctgatttagatcaacagtcagacttagaaatctacatttgcataagcatcccatgtagtcttgcttcagaagctcatagttcagaatgagggacagccatgtaaacaaatgactgccatccgatatgataaattgaatgacagaagtgtgtaccatgcatagtgctagctgcaagaggtgggggcacagtaggaattttacttagtctagagaaggatgttagaggcttcttcaaatagtgtatttaagttgagccttgagagagaagagaaaattcagtaggcaccagttgatgggatataaacaaataaatacatctttatttgcatgattgttggagataaagttagagggcagtgggagcaggtagaggcacctgacacaaatagttatgtaggttgtactctacccagctttagggcaccaatctcaccatagtcatcatagttttgtacatttgttgcaataacgttctgacctatggtaacactatatcttgaataaatggtctcagtttctaagttgtgcaaagaccagtgggccagtgctaggtctagaggagaggaagtgggaagactatatccctttttcacagttttcagtctcacgtatatcacttcacaaggaacacagggaatcctggaggaagaaaatactataattacagcctatggtgttggctgcatgtcaaaaagatgtacctgctcaaaatataaagtgaacctaggactgacagaaaagggtcgaataatgagggaagtaggaaaatctgagttggaggaggatcatcaaacatctatttttttttttctccaaatgttgctgccaagacattaatcaaacaacccatatccagtgttcctcagatacagcaacgagcagacattaatcgcagatctcccgaaggccccaccctttcagattccaggcaccatctatgaagagaagtaccttttattttcccttgaggatgctcagctgccactgtctctagcccttatctgggtccttggagccctttactctattgaattgtcttgattttcacaccaaagccttcaatcccagagagatctttccattccatttttgaaggaaatatcactagtagatctgcctccatgagcactttctgggtatggcatatttaccttctaaggaaagatgaggaatccataaaattagtgttagtcatcttacctctgtaacctcttattactttattaccgtcactaccaaaaataatatttattcatcactcttcatgtgctaatgaattttactaactctgtattgtcacgattttcatttcatcctcacaaaatttccataatgtagccattattaaacctcatttagagagaacatcaagattcagagaggttatgtaacttatcctgaattacgtagttaataaatactagagccaggatataaactcaagattgtccaacttgaaaggccatagtataaatcagtatatgatactgcctctgccctctttccttcagatcatgagctatatcattactatcttccgagtgcctttgtgtgaacttagctctttgtatgtattaaccaatttaaacctcacaacaaacttatgcaataggttctattatttccatttcagagatgagaaaactatggcacagagaaattaaattacatgcccaagatcatccatttagtaagtagttggaggtgggattcaaacaattcaaaaaagctgttgagatcttgtttatttcacatttggttcttacatagtagccttaatctaaccaaagccaatatttttaaggtgttttaataaatatctaggaaaatatactgacatccagatttacaatttagttcagagggagagtatagtagaaacctggaaattctaagtctaaagtctttgccttcaaatatgatagtccttggaaactaaatagaattttatagtaaataatcaaaacctgcctacctaacatgccttctagcattaatgttttcattcaattgtttaatgaccgatgtgtgtttactgagtgcctgaagcttcagggactggggactctaaggggattgagacataatccctgccttcagaaagcttacagtctggtagagactcagaaggaaacagtgattgtagtataggtatcaagtgctatgattaattgggagctccatgaagacagagtctctgccttactctgctttatctccacccagtacctcacctattgcctggcagagtgagaatacaaatatttatatatgcatgcatgaataaatgcatgcactgtggtggtgctggggaactgcaggcagggttggggggcaggagctaagtcagctgggaatgagacagagaggacaatggaaaggtttctgggtccttgaagaggtgcttgaactgtgctgaaactgaagaagttagcatcagtaagccaggcaagggaagaggaggatgggagaaacagacaaatagacaagagcactgtaagtgagttgttatgctgatgatgggtctgtgcaaggctttccaggtttggctgggggaacatacagaaaggagaaccagctgacatactaaggaagaacaagggagactagaagcagagtagggagacgacaatgacagagctcaagaggtcagcaggagacagatcatatttcccaagctaagcattttgaacctgactctgaaagccatggaggagccattgataggttttaagcacggaaatgtcatgatcacttttagttgattgcaaaattgtaaacccttctttcctaaccctctgtagggatggctgtgttagataatactacattgtttcaggacttaatgagtagaggtcatctacctccagctgtgttctagacctacctgactataattctccctcctaggttcttactcagattcccttggctctattgagagtatccaggatagtccctagtccttttttctgctacaaaaggcatttcatcactcagatactatctggttacatgtgtaaagaaaagacatacacatgcttttttttgacggagtctcactctgtcacccaggctggagtgcagtggcacaatctcggctcactgcaacctccacctcccggattcaagcgattctcccacctcagcctcctgagtagctggggttacaggcgcaggccaccacgcccggctaatttttgtatttttagtagagagcgggtttcaccatgttggtcaggctggtctcaaactcctgaactcgtgatccacccgcctcagcctcccaaagtgcaagatcttttaaataaaagtcgctcagagtttgagcaggacagaagacagaagcacagtaattagaatggaaaaccattagacctgcatgaaaatggaccaagcaatgtagtcaaaaacctaaccaaattagattctgagctctggttaatgtgtctttcaggcaggggatcagccgtagatcctagatgacagatttttacatatttgaggaaaagtagtaacttttaaaatcaaataaaaagacaggcatgatttcttgcatgctgaaactgcaagccctttttcgttgtggaaggtacacctcacagctcctccctgatgctttaatttatatgatttataaaaccaatgtatgcctattgtaaaattccaggaatagagaaaaaataattttaagtaaaaattattcttcatcccaccggagtcaaccaggcttaacatttttgtacaactcttgccccagcttttatcctcttatgaaaacaatattattgttattaccattgttgtttaaagaaatattaccttagttgtataatttgcttttttccagttatactgtaaatatgtatttgcattatcatttttaaagcacacagagtattccattatgcagttgtaccataattgtatcagtatcatcttcataaacacttaaattgtcccgataacagcaacaaaaacgcttaggaagggggaaggctatgatgaacaccaatgtaggtaaatcttatgtttctatgactatttacttagaataaaattcaagaagttgaatagctgagccagtggcatgcatgtttaatgcctgggctacatgctgatgaattgtctagaaagattgtattcatgtactatttcaccaaaaaagtgtctattttgctctatctgtaacaactttaaatattatttttgattctaacttttgcctacctgataggtaaaaattagcaccacattgttattttaatattttgttcctttaattactaggaagcttgaacacctttccatataactatcaggtgtgtattctttttcataaattgtactttcttgtccttcctcatatttgtttggtgatgccttttatatgttaagagtattaacccattgaaaacccatttttatagcctgaaatttggttcagtcatctacagagagcattcagcccaaaatctgcccaacatcagtactggatatttaaacttaagcaatccatagtcaggaagacactggtcccccatggaggagattttttttcaaaggaatggatcataaagcaaaagggattttctatggtgtccctattagtcaaataaagtggtctgactcactttagctttggcaattcctggtcattgcttgtgtgtgtccctagagaacagaatgaattaaggagtcaccatctaaggtgttttcaacagaaaacactttggcaaaagcttatttagctagtctgggattaattttcttaaccagttagaacttcaaaaagaagggaatgagttaataaactcttcgcaacatccctgcccccatactcccatctagtatggtcttctgagtctgcacatggctggggctcttctttccacacgtgtactctgagccctagaaacacttaggctgtgaagcacaatacacttgtttttttctttgggtcagttcaaattgatcatgccaactcttcccattccctcctctttgcttccaatgtttcctttctcttttgtttttcagaagaaggtagaagaatttggtagacagagagagagagagaaagagaatgtgtgtgcattaaaaccagacaaggaagcggctgggtgtggtggctcatgcctgtaatcctagcactttgggagaccaaggcgggtggatcacgaggtcaggagttcgagactagcctgaccaacatggtgaaaccccgtctctactaaaaatacaaaaagtagctgggcgtggtggcacacacctgtaatcctagctactcaggaggatgaggcaggagaatagcttgaacccaggaggcagaggttgcagtgagccaagatcacgccattgcactccagactgggcaaaaataaaaataataaaaaaaaaacaaccttaaagcaaaaagtccttggagccaataccaattgatgacccaatcagagataccatttcagaattacaagtataaccttatttgattctcatcaccctcaagttcgctgcggaacttgccaaaggcccaaagctagatagtggcagagctgggactctaactcaggtctcaatgacttcaaactcatttttatgagattatgtgtctcataagtcaccatgcctgctacctcttgttttacaggtgaatgaacaaaggcccagtggactgagcaactggctaaggcactcagactttcttagtggagctgaatagagaacacaggcccctttactgtgctgactcatctttgagatgatgatgcaattcaacaagaaaagattcaatgtgtacaaattggattggggcaattattcaagaacaaattgtataaagtgagctacacctcaagctctttgctttgcttcccatttaggggcatttcctatgagtccttatacaactctctgtggtggttataacctggtatcaaatcaaatcaaaatcagaatcagtgcagacaatcattgcatgagatttgctgtcttcatggaggttttgtgtagtgaaacattgggctgacatcgcctagggaatttcatgtgaaaattcctcccaaacatttttattctcagagttcctcttcttagcaccaccacggagtagggatctggagggtgaagtgaggttttttctctctttccccttctcctgtcttgctctctgcctcaccactcactggctcctacctgaacttccaggttagtcctccactcacacttggaatttcttatccttttgccctgcagaacacttaattgaacatattgtgttagttgagcatttctttggggtcccaagtttttccccaaggggtttatcagcaattattctgaacatatacggcaccttcaatttcctgtcttcattttttttcccatagataatgttattatcccaatttttactaatgttattatccccattttaagaagtctgaaggtcaattagagtaacttgccaaaagtcacactgctaacaccttgcacagcctaaattcaaatccatattggtctgacttctaaaattctggctttgtttaatgacattaactccctaactcattgtattaaactcttactatctgtgctaatttctcaaatattgtataaaaggagttgtcctctaaaaagaacaattgtaacagcttgacctttcaggtctcattcagaaggttcttacaaagacagctctctattatgaataatttacccttctcaaggctgaatttcctctgatgatacttgaccttctccaggcatgtaggccatccaaatgtagcccttaagtcagctggacactggggttcaaagatagttttgccttgtccattgctcagtgaagccattcctaagtatgctccccaaaacatttatcctattatcctcttaaacatgagattccacggctaaatacgtcagaaaactgagaaaacaaaaattaagttggtgtttcccagttgcattccattaaacactgttgtgtgagctgttcatagatctgacagtcaaagaaaaaaatgaaaaaacagtttgaggttaaacaattttggcaaaatataaatactctaattcccttttgggagatttatgataaacattagcatattaacgcttctggcatgtcctgctaaatagtttgacttggtgcttcgcagattttttaaccttaggatattttttttatcttgcaggaccagcccgcaacagcccactctagaaaagcttctggtttaagttctcagctcctgtatttatttttatttttatttttatttttatacggagtcttgctctgtcacccagactggagtgcagtggcatgatcttggctcactgcaagctttgcctcccaggttcatgccattttcctgcctcagcttcccgagtagctgggactacaggctcccgccaccacgccaggctaagtttttgtatttttagtagagacagggtttcaccgtgttagccaggatggtctcgatttcctgacctcgtgatccacctgcctccgcctcccaaagtgctgggattacaggtgtgagccaccgcacctgaccggcatctcctatatttttaagggagttgacaaagggtcctcttttgggaatctgggcctggtcctgccatctattatttgggtgactgtgaacaagtcactcctctctggggctcagttttcccatctgtaaaatgaagataatataccatttgtctctaactttccttccaattctagcataccatcacctaaacatatggaattgatggggctacacaccagaacatcatgacaaactgtgtgtttatattttcttaatctcatcctcttaattgaggcccagagaggaataacttactcacagtcactcagttagtttgatggcagaatcaggcttagattcccaaaagaaaatcatccaccaactcccttcaaaatatataagatgaaaatttaagccatatgtttgtttcctccagaaataaaataataatatttttcaagctatagaattcttatacatacacataatttgtccctatctgccagtacatcatagaaggtattccccagaatcacactatcatttacttgttcagaacgttgaggttttctctgattagccagttttcaggataatgggaaagtgcagagagtggttcaggtgaactgcagtgggacctcaggcaagcaactttccctctctgtgacttgtttttttaatccgtgaaaaagaaaataatgacagtgtgccctccattcctctaagataccttgtcagaactgtcagtcatagtcagaaaactctgctgctatatgcctgccctgtcctgaggtatcagcagaagtgtcgctggccccgcttgctttgcgtcagcttccaggtgagtgctgcataaatcctccatttggtagtatgaatgctagtattataagtacaaatataatgccctaatatcagagataatttactttgcactaatgcacttatcttgataataattcttcttaaaatccatagcaggaaagcatgatggttaatagctaggctctgacatccgataccaggtttgaacccagcactgttacttaccagctgtgcatccaggcaaagtgttactcgctgatcctcagatccttcatctataaagtgggaatcgtacgactcactgcaaagctggtacagcaatgcaatgcaataatgtttgtaaagctctttgtacattccccaggcatacaatatgtggtcggttatggcaattaaaaacattatctatttcagacataaaatgcaaggagattgagaagaaaattgtcaccataccaaagccaggaattggaatcctgtacacccattagaaaggaaaaccgtagttggtgttcttagctaatggtcctttggctgcctgcgatattagtgttggccagaggctcgttaatgttgtcattgtttattattgaacactgccacctagtggatgaattggtcacatgcaggtaaggaaatcacggaggttatgtcaggtcacctggtcacacatggaagaggctgttgtgtccatcttgtccacactgatttcagcttgttgacttgcagccatgcccagggagatactggggtgttcctgcttatgtagactcccctctatcttcgcgcagttgtcaaactgacacaaagacctgagaactgtattcttacactgcggctatgtgagcagagccaaagatcggcctcctctgacatgacctaaggcccctccctcaacactctaatccatcataccattttattttatgcaaaagcatatcgttgtctgaaaacattactttctttctgtttcccatccccttctcttgcccctaactagaacggaaggcagccaagtgtggggccatgtgagccttattcctttacgtatccctcgtacctaacactgggcctggcacagcgtaggagcacaaaaatatgtgtagcctatagcataaaaaatcaatgacaatgccaataatcactgctgttattgtttatggttcctactttttgccgggcacagagctaaggtctgtacatagatcacctcatttaatctctataatcagcctgcttagtgggggtaatgtcaccacccacataggatcagtaatttctagggcttagaattgatctttcaatttcaacaagcatggttcccctttgctcagtattataatgccataccttatttaatcctctcttttgaaatccttcttatagtttcacctattttacagatttgaaagctgagtctcatagaagtgaagcaatttgctgaaagtcactcagttcaggtttaaaacccaggtcttgtctaattccaaaggccctgctgttttcactgcaacatactgccctctattagatacatggataaaaaagggctttcttaattcggtcctggaaacccaggcctgagttttggttaagcctttgtaagaagcctttctcccaagctaaatctcatattggtttttcttgtagccaggtctttattggtttctagatgtctcctccacgttcacttcaaagacaaaaattagctacaatttattgaagattttattatgtgccaggcagggttcaaatgatctcatttaatccttataacagccctgtaaaataggttccattgatattattcctattttataaatgaggacactgagggacagagaagttaagtaatttccccatggttacctggattctaaaccagagcgctggtttgaacctaggcaggcagtttccttccaggatacactcctaagcaccagtggccatcctaggggactatatccaggacatttcctttgctgacatcaggtaagggaaggccctcagaaaacctcaggggcagccccactcagtaaagcacttcccagaatgtttaagctcagaaactgtgctgaagtcagaatacatagagatgccaggcatcctgcagctagccctcctccctcccggtttgcagtcccagcctacggttactcttcaattagtttccatctgtggcagcagcaattccctaggggtacatgggccaaaaagagagaccgactcagccaagaaccagaaatatcctcactgcagcaaacaagctagtgatggaaaagaggaaaattttcccttcaaggtctggacatttctcaaagacagcccactcagcttatataagccgcatgcaccactaaaggaacacaaccaaggccccatgaatctagaacaatcttgccaattacgtgttaattgaaagttatgtagaggccatccacatgcccttggggaaacttgacactgtacttattgaattgtctgttctggatcactgacctgggcaaaggggctcaggcaacactcaaaggacagtggcaaagtcattccacattccatgggtatcagttcagagtttccacccttttttgaacctttcctccaaataaataggcagtgatggtgtttagggacattctgggcttccttgtattcattagttcatgttttcatatatttatgtacttgtaaattgacaaatcttgtcttgaatatacatttgctaagtatcacctctgtttcaggttaatgccaggtgctgggaacatcaaagtgggttagatacagtggggtgctggtaagtgatggccaactggcttgctatgtgtcgggctaacatgaatgctggttgcattttcctttacattaatgaataagacaagattgaaactacgaagatctatgtcagtgtcgtctgttaatgacctgagctacttctttgctgaattgaagtgtcaataatagaagagttctttaattttttgtgttgttcacagatactatgacacgctttaaagtttaatctgcattattgacatttctccatcagtttcttgagtctagacaattaactaacaataaatcaagccttggtttatagcatttgccaatcttcatgtgcaaataagaccatcgtggccaatttcaagctaccaatattttgccactaagcatggagttgaggagagacgtacaacatgaatgtatatcatctcaaaagtatagattatagtacaatctagtaattaggaagaaatgagtcttaagcttttattattttcattttgaatatacaatatttacttatataatttgatattttataatggctatgcttaacaaccagttcaaaacaattcaggacgtttaacaagtggcgccagccagcgggtatttgtcaactccagcctaccactggttagacataggctcctacttgaagaagttcacagttgagttggggaaaagctctcatagtatgaactgctttgtaagaagtaagatcaagatgccatcggagcatttggaaggcagatccagtcaagagttgggcttggggaaagctttctgagacaaaaatatctaatctgagacctgaaggaaaatagatattaactatatgaagggtggaaagtgggttccagatggaggaaggccctgtgcaaaggactggagtgaaaccagatcacagaaacttttggaaatacacagtatttcattatggctggaataaagtgctgaaggtaaggtggtcacatcagataaaattggggggaggagagtacaaagccaggacatataaaccatatcaaaaatagtttgtcttaaagatggtgagtacttactgacagtttatataagtgagggcaccctgattggatttcttatcagatcattccgcctgtggtataggaaagagagaggctagacaaggctatacccaggatgccacagccatccaggagcgagatgcaggttgcctgcctggtggcagtggccacagggatggcaaagaacagaagaatcaagagtcatttaggaggttgtgcctgctggacaaagtgattgattatttgtgtgttttttggggtggaaggagtgctgagggaaacaaagtcaagaatgatactcagatttctgacaaaagcaaccaagtaaatgaatggaagtggagatggtggtaggggaacaggtaattaacctgaaggatgatgagttctcttttagatggattacatttatcgcagtgaatgtccaagtggagatatccacgaagcagttgaatttatgtctgaagctcagggcacatatctgggctggaaaatgaatttcggagttttgaatacatagatgctaaccaaagccacgtgtatggatgtaatcatccaggatgcatcagaatcactaaagtttctgggccatttactccaccagcaccatccaccctctttacatcctcccactgttttactcattactgacaccctataatgtaggtatacttattattcccattttgcagatgaggaaactgaggcatagagagaacaactatttcctcaaggctgcacagtaagtggcagtgcccagatttgaaaccagtgagtctggcaccagaacctacaccctgaactataatgttggtctgcttctgtgtcaaaatacagactaagaagggaagaccagccgggtgcggtggttcatgcctgtaatcccagcattttgggaggccgaggcgggcggatcatttgaggtcaagagttcgagaatagccaggtcaccatggcaaaaccccatctctactaaaaaaaattagccatgcgtggtggcgggcttctgtaatcccagctacttgggagactgaggcatgggaattgcttaaacctgggaggctggaggttaacagttagccaagatcatgtcactgcactccagtctaggggacagaggagactcagtctcaaaaaacaaaaaaaagaagaagaagaagggaagaccagaaggttagacccctcagaaatgaatatttaagtcacaggaagaggaatttacaaaggagatggtaaagggaggtgtggtggtgaggaacttgcggctcataagaaggtcaccttcttaaaaactccctcaccacaaattaggtaattgaggagttgccccgtaaaacttacagtcacaatgaatttactaacattcttttctaatcataaaagcaatgttttttttttcctgtaggaaaattagaaaatacagagaagaaaataaaaatcacagtattcagctatctagaaataattgtggtaactatttgttgtatatcccttcagacttttgatctatgcatagaaaaacagagatcccttcgaaacatttttcaaagtctattttaaaattatattttgttgtttccaaagctgcacattttaaaatcaggatttatcttataatcagtggtattccacaggttaatgataactttttgctcctagttgtacaaagaatgctgcatcttttcattgatagcatcatagatttggtgaaatgtggtaggacatatgttcatatctttaaaaattgaaaatgtgctaaaaggtacacagagaaagatctctttccctctcggcatattccagtgtttctccctggagacagatgatattttccagctacttgtctacccttccagatgcattttaatgcacacacaagaaaatataacatgtgtccccttctctttaaatacatggtaacgtactatccactctagggcatcttggcctttttaaaaacttacgctctatgttgggagtcttttttccaattgcaaattttaccttgaaagaatgcgccacaattcattaagtccctagtgatgtgcaaagttatttccaatctttttctatgagaaataatgctatgatgaataatcttgtatattttgcacatacagcagtatacctattaaatttcttgaaatgtaactgctgagtcaagtgataattcagttgttattttgaagatattgccaaattgatcttcttaaaagttccaatttatacttcttccaaaaatgtatgaaatactgttttcctacagcatttccaacatattaggttatcaaactttttatgtttgtggtacctataggtaaaaattacatctttaacatactttttttattttggaataattctagattttatagaaaagttgcaaagatagtatggaaaatccctgtatattccttactcagtttcccctcttggcaacatctcatatctccatggtacactcatcaaaactaagcaactaacattaatatattactattacctaaacttcaaattttatttggattttaacagtttttctactaatattcctggatcccatctaggaggcaatattgcattttagtcatcttgtctccttagtctcacctggtttctgacagtctctccgtcttcctttgctcttcatgaccttaagagttttgagaagtcctggtcagtggtttgtagaatgtctctcaatttgggtttgtcaaatatgtgtcttatgattagaatggggttagtttttggaaggaacacttcacaggtaaagttccctcctcatgtcatatcagatggtaggtgttatcaacatgacttatcactggtgatgttcaccttgtggatttaaggtagtgtttgccagatgtgttcatggtaaagttactctttttccctttgccacacacttatctctggatatgaatcactaagtcaagcccaaactcaagagggagatgttggctgggcacggtggctcatgcctgtaatctcagcactttgggaggctgaggcgggtggatcacctgaggtcaggagttcgagaccagcctgaccaacatgctgaaaccccgtctctactaaaaatacaaaaattagctgggcatggtggtgggtgcctgtaatcccagctactcaagaggctgaggcaggagaatcacttgaacacgggaggcagaggtcgaagtcagctgagatcatgccattgtactccagcctaggcaagagagtaagactccatctcaaaaaaacaaaaacaaaaacaaaatagggaaatcttagtgtaattataattagcatttatcttataggtaaggatatcttttcataagcttaaggaccatctatattttctgaactgttgacatttttctgttgaacttctaatcaatcttatttttgtcagttgttatgagaaataagccttttctctgtaatgcaaattaaaaactttcacccagcttaccatttcttattttttctgttgtgtttttgccatatagattttaaaaattttatgtaataaaatgtattagtttctcttatgagttatggtttatttatcacacttagagatatattacctatttcttgatgatctttaaaaatgttctgtggtatcctttttctgaggttatgttatgtctttgatctacctggagtttatttaggtataaaaatgagtaggatttgattctttttctttttcttgtggttacttggttgtcccagtagcaatttatggcctattttccattattttatcgatgtgcaatagataattttgccggaaaaatgtgtaggggcttcagccctggacaatttaaattcccatgttctttccatagagacagataaagcaaaacaacataaactctcatattttacattattgttcatatagattgacctcaatatctccaagcacaattttcattttgagccactgttggcacattgggctaccctttctttaaccttacttcagcagcagccgaagggcagcgtggccccaggtcatagctaagtggcagataagggtgcagatccttgagtcacactgggttagtggcattactttaaatctacagttagagctacaaaattggggttatgagaagaattccatggcttgtaattcctcacgtataactcaacccaaatttggagagaaattgccacttgattatatgagaggagatagtatttgaggctaggattctttaaggtggtacatgggcacattgacaacagaggtaagtggtataacctacttatatttttaaaacatctttgacaaggttctgtgtcaaaactcaatgagaaacacaagtttccatgttcttggagaggacagttctgtcagggtcagtcactgcattagcgaaggaaacaatgcatatagataataggcactcatctgagaagacaatatttgcaaagcctatagggtaagggatccttgttccccagagttccatcctaggcccatccttctttaaaatctgcagaaataatctggaggcagatgaacaaaatgataattttaaggttttccgtgttattgatttgttttttctagagagtaaagaactaagtagattaagttagaaaagagtaaactcttgtagatctatttggaatccgggcaagaaagtatcatttgagtttaaaggtaaataacagcaataatgcatattttaaaagaacaaaaaagtcaaaatagaaaataaaggactctgttctacagtaggtttagttcacactactactaatgaactaatagtactttctgtgtgctttatactgttctaagtcctttaacatacattaatttatatagcctttaaaaccagccatgaggcagggttcattattcctcccatttcacacattagaaaatggaggtccaaggagtatgagtaaccagttgaaggtcacataggcagtaagtggcagaggtgggtttggatagggcagtcccgtgctggggttggtggcctgaatcactgggcttgctgcctccctaggagggctctgtacaactcaggcaactgtcacattgatctatttcttcactggaagagctgagggtaagtcacattcatctttgtgttttcaagtttagcataatcctaggcacaaactatatgcttaataaattaataaattttgaccacttaaagtataatttaaaaaaatgtgtatggtgaaataaaaggaattttttttttttttttgagatggagtctggctgtgtcacccaggctggagtgcagtgtagcaatctcagctcactgcaagctccgcctacgggttcacgccattctcctgcctcaacttcctgagtagctgggactacaggtgccccccaccacacctggctaatttttttgtgtttttaatagacacggggtttcaccatgttagccaggatggtcttgatctcccgacctcgtgatccgcccacctctgcctcccaaagtgctgggactacaggcgtgaaccaccgtgccccgcctattttttaaatttcataagtttaaaaacttttgcaattgtgatacaacacatagaatgtaccatttaaatacaaagttcagtagtgttacataaactcacattattgttcaaccaatctccaggactttctcctcttgcaaactgaaactctatactcactaaacaactctccattgcaccgacccccagcccctggtgagcactactctagctttatttctaagagtgtgactactctttatacctcatataagtaaaatcatatagcatttttctttttgtcattggtttattttgctttgcatattttcaagatccatccatgttatagcatgagtaagaatttccttctttcttaagaataagtaatattccactgtgtgtatattccacattttgtttatctattcatcagtcagtggacatttgtgttgctttcaacttttggctattttgagtaatgctgctgtaaacatgggtatgcaaatatgtctttgagatcttgcttttaattttttttggctatatatctgaagtggaatggctggatcatatggtaactcaatttttaatattttgagaaactgtcatgctgttttccatagtggtttcaccactacagtgcagaagagttccaattttcccacatacttaccaacaatgattttcttatatttaaatgacagccatcctaatgggtgtgaggtaatactgtgattttgatttgcatctccctgatcattagtgatgttgaacctcttttcctatgcttgttgactatttgtatattttatttggcaaaatatctattcaggtcctttgttcatttttttaattggttttttgttgttcagttgtaggagttctttacatattctgcatattgatcccttatcagatatataatttgcaaatattttctcccattctataggttacattttcactgtattgtgtcctgtgatgcatggaagtttttaattttgaagtcatccaatttgtctacttttatttttgtttcctgtgcctggtatcatatccaagaaatcattgccaaattcaatgtcataaagcttctctcctaagcttttacctaaaagtttcattttttaaaaaatttattattattattattattattattattattattattattatttctgagacacagtcgtgctctgtctcccaggctacagtgaagtggtgcaatctcggctcactgcaacttctgcttcccgggttcaagctattctcctgcgtcagcctcccgggtagctgggactacaggcatgcaccactacgcccaactaatttttgtatttttagtagagatgggttttgccatgttggccaggctggtctcgaactcctggcctcaagtgatccactcacctcggcctcccaaagtgctgggattgcaggcagaagccaccatgcccggccaacagttttatagttttatgttttccatttaggtctttgattcattctgagttaatttttgtatatggtacaaaggtaagggggcaacttgtaattttttccccagctgattagccaattggcacaacacaatttactgaaaaagaaggtttctttctatcaatttgtaacattattttgttcatatatcaaattctaatgtatatgtatatatttctagatgttctattctattccattgagctatttgtctattctgttgccagtaccatatggatttatttaatgtaggctaattttatattctgagtaagcaggcaaatgccccctcactattattcttatttaaaattttcttggtgacttttgcatattcattcttcctgaaaattttactatgaatttttagactactcctcagccaccccatcaacaccttcctacccatcactcccataaaactaacaagcatagagattaaaagaacaggattgacgttttatagtatttggatatttctctctatatatgtttctcctgtagtatagcccatttcatataataacaacttcatctttctctttgctacaggccaacaaatcccaaacaaaacaaaaaaacaaatctggagtcatccttgagtgccttcattctttcatacccgatgtctaacacatcagaaaattttattagattcgtccttaaaaatggtcatcatttttcaccccccgacaaggtccaagctcccattatattatccttggattattgtaatagcctttactttaataacctctttttcttttttagaattgcgatcttgttctgtcaccccaagctggaatgcagtggggcaagcatagttcactgcagtcttgaactcctgggcttaaacaatcctcctacctcagtctcctgtgtaacagtctcttttaatattattattattattattatactttaagttccgggatacatgtgcagaacatgaaggtttattacgtaggtatacacgtgccattgtggtttgttgcacccatcaacccatcatctacattaggtatttctccgcatgctatccctcccctagctccccacccaccaataggccctggtgtgtgatgttcccctcactgtgtccatgtgttctcactgttcaactcccacttatgagtgagaacatgcagcgtttggttttctgtccctgtgttagtttgccgagaatgatggtctccagcttcatccatgtcccagcaaaggacataaactcatccttttttatggctgtgtagtattccatggtgtatatgtgccacattttctttatccagtctactgttgatgggcatttggattggttctaagtctttgatattgtgaatagtgctgcaataaacatacacgtacatgtgtctttatagtagaatgatttataatcctttgggtatatacccaggaatgggattgctgggccaaatggtatttctggttctagatccttgaggaattgccacactgtcttctacaatgtttgaactaatttacactcccaccaacagtgtaaaagcattcctatttctccacattctctccagcatctgttgtttcctgactttttaatgatcaccattctaactggcatgagatggtacctcattctggtttcggtttgcacttctctaatgaccagtgataatgagcattttttcatatgtttgttggccacttaaatgtcttcttttaagaagtgtctgttcatatgctttgcccactttttgatgggttttttttaattgtaaatttgttcaagttccttatagattctggatattagctctttgtcagatggatagactgcaaaaattttctctcattctgtaggttgcctgttaactctcatgatagtttcttttgctgtgcagaagctctttaggttaattagatcccatttgtcaattttggcttttttgccattagttttggtgttttagtcatgaagtctctgcccatgcttatatcctgaatggtattgcctaagttttcttctagggcttttatgattttacgtactacgtttaagtctttaatacatcctgagttaatttttgtataaggtgtaaggaaggggtccagtttcagttttctgcatatggctagacagttttcctaacatcatttattaaatagggaatcctttccccatttcttgtttttgtcaggtttgtcaaaaatcacatggttgtagatgtgtggtgttattcctgaggccttttttctgtcctattggtctatatatctgtttcagtaccagtaccatgctgttttggttactgtagccttgtagtatagtttgaagtcaggcagcatgatgcctccagctttgttctttttgcttaggattgtcttggttatatggactcttttttagttcctgtgtaatagcctcttaagtgataatcttgcattaacttcatccctgtaaagtctattttcattacagcagacaggaaaaatcttattaaaatgttagttcatgcatatcacccttctactccaaactttccaatagttctccatttcacctggaggaaaagctgatgtatttaagaatggcttcgtttctctcttttcccatttctacttactctacttcagtaacattggtctccttgctatttctctaataggacatatacgcttctacctgagtgcctttatacttgctgtttccttggcctgaaacacatttctctcagttaactgcatggcttgcttttttaccttcttaatgtttttgttcatttacatttctgagaacatctctggcccttctatctaatattgcttctctgtctcaatacttccttattcatcattttctgttttctttttctccatagaattcatcattttataaaatttcacacaattttcttgtttactttctgtttccttccactagaatataaactctgtaatagcaaagaaatttacttattttgctcactgctgtatcctcagtgcctacagtagtacctgccacatagtagatgctcaatagatgctcaataaataaaacttaaatgaaccaatgaaccaatattgaatcttcccaccttgaaacacacacacacacacacacacacacacacacacacacacgctagtccctctttatccacaggggatacgttccaagacccccagtaaatgcctgaaaccacagatagtactgaaccatatgtacaaataacaaatgtaatgttttacctcatacatacataccaatgataaagtttaatttacaaataaggcatagtcagagattaacaacaataactcataaaatagaacaattataacaatatactgtaataaaagttatgtgaatgtgatctctgtctctcaaaatatcttattgtaccctactcacctatttctcattgcaattgaccacagataactgaaactccagagagcaaaaccatggcagataaaaggagaaaatggtacgtgtgtgtatatatacaaacacatatgcaaacttgttttattttttaatatggcttggtggttttcatcttcgagatatccacaaaattgaatttaatttttaaatttaattccataatttataggtgagatagatttatatttattgttatggagagatgccaatgatatatttttatgaaaaaaagaaattcagaacagtatgtagaacatgacttcattgtgataaaaataaaaatgtgtgcatgtatctatgtttcagagtagactttccacatctcccaactagatgttgggcatatactgaagataaggtaacagaaggaaatcttgtaattcagggaagcagccagaagttttctgagcacaatgaagcagagatggtattcaaagagaaaaccaattagcaggataaatgcttcagattctttttaatacttgaacctctgtctcctttacaccatccctcccctccctgctagtctcatccagaagggaaatctgatcactgacaacccaccccagagattaagattaggaacagagctggaagaaacagcaacaaggaaaaggaaggagaggaaggaaggctcaagggagagaatggaggctcccatgcctgaactaaatgtgagttgaatccctgttccctgtggaactagatgggctgggaaagacttgaacattaaatagattaatctctcttgtttttttatgtattctaattttatggtaatgtggtctctgttatattgatttacagtatcttttgcatgtaatttgaggctatatgttgtcaatttttggaatgttttatacatgcataggagaattgctttctctaatgtgtagatacaagatttcatatacatacatgtttgttacatgacactagttaattgcattatttaaaaactctatatccttactagttttctgtgttgtaacctatcagtttctgaaaatggaggaggacctttaaacattttttttaacctagatactcaaattcaagaaacaatgaatcctaaaaagactaaataaaaagatatctacatctagaaaggactcagtgaaacttcagaacatttaaaatactgtatttcttactcatttttttttgtttgtttattgtatgtctcccactagaattttaagtcccataagagcaggcaggaaattctgcctattttgttcatagtacctggcacatagcaggcactctacaaatatttgctgaagtaatggattcagttcttcccctgcttcattcagggttcagttttcttcttactgaagttcatacttcaatccctcttttagggagagtcttgggtggtaaattttcttagtcctcacaactagaagtttctattttgtttttactcttcaatgagagtttagctgggtcaagtcctatataatgagttatttttttttcttcagcagtttgaatctattacttaaagaatttttttctggcttttattgttttcgagaattcggttgtgagtctgatattctttggaagataaccagtctcctatctcttggaatttttttgtttaattaaatattttttcctttgagataattgtgggttcataagcacttgaaagaaataatacacagagaacacttgtatccttttcccaacttatctcaatagtaacttcttgcaaaactataatatactatcacaaccaaatattgacattgatacaataaagacagagaacatttccatccccacaaggatccctatgctgcccttttacatctactttcctctcacttaaaccccctccttaagccttggcaactactaatctgttctccaatcctataattttgtctttgcaagaatgttatataaatggaattgagagatacaatatacaaactgagacaatgaatatgcaataataatagaactctgactcataacctctgtagcaacttgcccagaagtcaaaccctaacctctgcagcagttggcccaggtggtcagcatttggtcaatgatggagtttccttattttttgttcctacttccaatttaggacaaatcaaggaaaactaaattctccccaaagtaaccatataaaatacttcacttctaaccagttcttactttcattatttttttcttcctccttgctttgagcttatttgctcttcttttgctgggttcttcaggtaggaacttaaattactgatttgagatattttcttctttctaatctatacatttagtgctataaatttgcttttcatttgttgccaggtcccacaatttttgatatgttgtgtttttattttcattccatttcatatatttattttcctcaagacttcctttttgacccattcatgaagtatgtgatttacttctcaagtattaggagatttttctgttattgatttctaatgtaactccattttggccagagaacaccctccatatgattttaattctttaaaattagatgacgtttgatttatagtccaggttatggtctaggtcccacaggcacttgaaaagaatgtgcattctgctgttgttgagtgtagggttctataaatgtcaattagatcctgtcggttgatggtattattgcattcttccacatccttgatgttctctgtctagttgtcctatcaattgttaaaaaggggttgtcgaagtctccaactataattatagatttgtctatttctcctttcaattatatgagttttgcctaacatattttgcagctctgttgtgtggtacatatgcacttaggattgttatgtccttttggtgtgttgattcttttatcattatataatgtccttctctgtctctttaaatttatttgctttagagtctactttatctgatgttaatgtagccacttctgctttcttctgatcagtgtttgtatatctttttccatccttttactttaacttgtctatattcttatatttgaagtgagtttcttatagagagcatattgttagcttacgttttctcaattaactctgctaatttctgtcctttaattggtgtatgtggactatttagattcaattacatttttatatattaggttttaaatctctcattttatttttatttttgtcctttttggttcattttctttttcttaatttctaatgggttacttgaacattttttagaattccattttggtttatctatcgtgttttccagagcattttttttttttttttttttttgagacggagtcttgctctgtcccccaggctggagtgcagtggcacaatctcggctcactgcaagctccacctcccgggttcacaccattctcctgcctcagcctcccgagtagctgggactacaggcgtccgccaccacgcccggctaattttttgtatttttagtagagacggggtttcaccatgttagccaggatggtcttgatctcctgacctcgtgatctgcccgccttggcctcccaaagtgctgggattataggcgtgagccactgcacccggcccagagcgtttctttgtatacctttttaaacactgatttctctagatattacattatataaacaaaagttatcacactctcctgggggcgtcattttcccagttctagtaaactacagaaatcttacctccctttacactagtttattgtcccccatttataactattttaaacttctcttctacataaatttagaacctcatcagacattgtcataatttttgcttcaattgttaaatataatttagagaacacaacagaaaaaagaaaatctgttgtatttacccacatttttgtatattgccttttttcttccttcctcataaggtaagatttcttcttttataattttttttctctttagaggatttcttttaatcattcctttagggttgattggctgataacaaattgtcttcttttccaacatctgaaaatgtcttaattttccctttattctttctaaacatttttattataaattaataatttataactaaatgtatttatgtggtacaaagtaatattatgatttatgaacacaatatagaacaattaaatcaaattagttaacatatccatcccctcaaatacttgtcattttcataatgaggacatttgaaatttactctcttggcaattttgaaatttacaatacattattaactatattaaacatgcagtgcaatagatctcagaaaaagaccaccacccaacttatttctcttgtttactgagactttgtatgctctgactatcatcttctcattcctccaacctcccacggtctggtaaccatcattctactctctgcttctatgggtttgatcatcttagattccacatgtaagtgagaacatgtatttttctgtgcctgccttatttgacttagcataatgttctccagttccatctatgttgtcacaaatgatacttttcttctttttatagactaaatagtattccatgatgtatatatgccatattttctttatccattcatctgttgatggacacttagactgattccataacttggctattgtgaatagtgtggtaataaacatgggactgcagacatctctttgacaaactgattttaatgtctttgtgaatatccagaagtgggattgctgaatcatatggtagttctgtttttaacttttagaggaagcttcatactgttttccataaatttacgtttccaccagcagtgtacaagggttcctgtttctccacattctcaccaacacttatctttggcttttttttttaataaaagtaattctgacaggtgtgagaggatatttcttgtggctttaatttgcattttcccagtgattacaaatgttgagcatttttcatatatctgctgactatttgtattacatgccttcttttgaaaaatgtctattcaggtcccttgctccttgtaaaattctgttctttgttttctttctattgagttgtttcaatttcttatatatttgggatattaaccctttatcagatgtatagtttgcaaatattttctttttctttttttttttttttttttttgagacggagtctcactctgtcaaccaggctggagtgcagtggtgtgatctcggctcactgcaacctatgcctcccaggttcaagcaattcttctgcctcagcctcctgaatagctgggattataggcatgtgccaccatgcctggctagtttttgtgtttttagtagagacagggtttcaccatatgggccaggctggtctcgaactcctgatctcgtgatccacctgcctcggcctcccaaagtgctgagattacaggcgtgagccactgcacctggccttagtttgcaaatattttcttctcatccataggttgtctctttacatggttagttgtttcctttactgtgcagaagctttttaagtctaatataatccaatctgtttatttttgcttttgttatctgtgtttttggggtcaaattcaaaaaattattgcctaaaccaatgtcatgtagtttttctcctataatttcttctagcggctttgcactttctgttcttatgtttaagtctttaattcactttgagtcaacaccataaaggccatataggataagcccacggctaacattatactcaaaaataaaagatgaaaagtcttccctctaagatcttgaacaagacaaacatgtccactctcaccacttattattcaatgtagtattgaaagtcctttgtcagagcaattaggcaagagaaacaagaaaaggcatttaaatagaaaaagaagaagtaaaattgtcactgtttgctgatgacataattttatataaaaatcctaagactccttcaaaaaactgttaaactaattaaaaaatacactaaagttgtgggatacaaaatcacaaaaattggtatcatttctatacaaaaacaacaaactatacaaaaaagaaatcaagagaacaggaaaaggtagagcaagatggcataatagaaccctctgacaagtatcccccaacaagaacatcaaattgaataataattcatgtaagacaacaccttcacaagaactaaagaaatcaggtgagagatcatactacctgattttaccataataacaagaagaggcacattggagaggggaggaaggacagtcccacattgcctgtacactgctcccccaaacttgggcagtacagcacagtgcagagaaagaatctatcagtttgggagagagagagaaaagtgtgtgtgagactttgcattggaacttagtaccaacttgccacagaaaaatacaacatggaatagaaacctgcagcccttgattccaggccaatgtccacagagggtgtacttagacctatccctggctaaaatggaatctgctgctgcagctggaagaaactgagccctgaaacacttcaccattggctgactcaagtgtcctcaggtcctgaataaattgcagcggaaggcaaattggaaattcaaaatagctattttgaagatgctcaacaaatttcagtaaaacacagagaagcaattcagaaatttatcagagaaatttatcaaagatattgaagtattaataaaaaaacagaaatcctggagtaaaaaaatatggatgaattgaaaagtacagtagagggtctcaatagcagaactgattaagcagaagaaataatcagtgagcttgaagacaggctatttgaaaatacacagtcagagagggaaaagcaaaaagaatgcaaaaggacaaagaacacttatgagctatataagatagtatcaaaatagcaaatgtaagagtcattgcccttaaagtcggagtagaaaaagagaaatgggtggaaagcttatttaaagaaataataacaaaaaacttttcaaaagagaaatatataaataggtaggggaagcccaaagaccaccaagtagatacaactcaaacaagactatcttaaggcatataataaactctcaaatgtcaaaaacaaagggaggatcctgaaagcagcaagagaaaagaagaaaacaacagataaaggagctccaatatgtctggcagcaggttacacagcaaaaaccttatagtccagaagggagtgaaatgatatattcaaaatgatttagaaaagcccaacaactgagaatactatatctggcaaagctatccttaaaacatgagagagatgtagactttctcagacaaacaaaagtttaaagacctcattactaccagacctgacttataataaatactaaggtgggatcttcaatctgaaggaaaaagacacatgtgcaacaagacacatgtgcaacaagaaaacatctgaagaaataaaatccactgacaaaagtatatactgtaaccacccatatctttagtgtaagtaccaaaagataaaactactaaaaataataattacaatgatttgttaaaagataagcaatataaaaagatgtaaactgaaatatccaaaagacaaaatgtagggataagatgagttaaagagttttattttttgtttcttttattgtctttgcaattaaagtcaggttatcatcagtttaaaatagcttattatagctatacatttttttaagcctcatggtgactacaaagcaaaatctataatggataaactaaaaataaaaagcaagtatttaaaacatactaccagacaaaataaacccaaaagaagacagtaagagaggaataaaggaatagaggagttataaaacaatcagaaatcaacaaaatggcagtagtaagttcttactactatttataataaccttgaatatatatggactacattctctagctgaaagacatagagtcactgaatagataagaaacccaactatatgttgcctacaagaaactcatgtcacttataaagacatgcatagactaaaagtgaaaggatggaaaaagatacaccaagcaagtggaaaccaaagagggcaggagtagctatacttatatcagataaaatagactttaagtaaaaaataattttaagagacaaaatgctactatgtattgatgaaagattcaatacagccggaggatataacagttgtaaatatatatgcacccaacactagagtacctaattatataaagcaaatattaacagacctaaaggaagaaattgactgcaatacaataatagtaggagagttcaacacccaacttcagcaatgaacaaatcatctagaccaaaaatcaacaaagaaatattggaattaaacgacagtctagaccaaatagacttaacagatattataaaacataccactaaaaagctgtagaatacacattcttttcaacagcacatggaacattgtctaagatagaatgtattttaggccacaacacaagtcttcacaaatgttacaaaattgaaatcatatcaagtatcctttctgatcacagtgcaataacactagaacaataacaagaagaaatttggaaatggttcaaatatatagaaattaaacaacttgctcatgaaaaactaatgggtcaatgaagaaagtaagaaggaaatttaaaaatttcttggggcaaatgaaaatggaaacaaaatataccaaaacctatgggatacagtaaaaacagtttggaaagagaagtcattgtaataaatgcctacatcaaaatattaaaaagatctgaaataaacaacctaacattatacctcaaggaactagaaaaataagaacaatataaacccagaataagtagaaagaaagaaataataaagatcagagcagaaataaatgaaatagagacaaaaaatttacaaaagatcaacaaaacaaaaagatggttttgaaaagacagacaaaacgaataatcctttagttaggctaataaagacaaaactcaaataaataaaaacagaaatgaaaaagatgacattataactgatgccacagaaatacaaaggatcataagaaactactatgaacaactacacgtaaataaattggtaaacctagaagagagtaataaattcatggacatgtacaacttaccaaaattggatcatgaagaaatagaaaaactgaacagaccaataatgagcaatgagataggcacagtaataaaaagtctcccatcaaagaaaagtccaggaatggatggcttcactgttgaattctaccaaacatttaaagaagaacaaatatcaattctacttaaactcttccaaaaagctaaagtgaaccgaatagttccatattcattctacaaggccagcattactgataccaaaaccagacaaggacacaacaaaaaagaaaactacataccaatatctctgatgaacttagatgcaaaatcctcaacaaaatactagcaaaactaattcaacaacacattagaaagatcatttattatgatcaaataggattcattccagggatgcaaggatggttcaacatatgaaaatcaataagtatgatgcatcacattaacagaataaaaaacaaagactatgtgatcatttcagtagatgctgaaaaagccttcaataaaattcaacatctattcatgataagaacttttgacaaactgagtataaaggaacatacctcgatacaataaaggccttacatgacaaaaccagagctaacattatatggaataggcaaaagttgaaaggtttttctctaagatctagaacaacacaagaatacccacgtttaccactttatttgacatagtactgaatattctagccaaagcaagtaggcaagagaaagaaacaaagggcacccaaattttaaaaagtggaagtcatattgtccctgtttgcagatgacatgaccatatacatagaaaatcctaaagactccactaaaaaactattagaattaataactgagtatagtaaagttgcaggatacaaaatcaacacaaaaatcagtagcatttctatatgctaataatgaactatctgaaaaagaaatcaagaaagcaattctattacaatagctacagaaatgctagacataataaccaaggaggtgaaatatctctacaattaaaaccataaaacattaatgaaagaagctgaaaaagacaaataaatgaaaagacatcctgtgttcatggattggaagtattaatattgttaaaatgtccatattatccaaagtaatcttcaaattcagtgcaatttctgtcaaaataccaatgatattcttctcataaatagaaaaacaatcttaaaattcatgtggaagtgcaaaagaccctgaattaccaaataaattttgagcaaaagcaacaaagctgcaagcattacactacctgacttcaaaatatactataaagctatagtaaccaaaacagcatggtacttatagaaaaacagaccaatggaacaaaatagaaagcccagaaagaaatccatgcacttttaaccaactgttttttgccaaaggtggcaagaatgcacactgagaaaaaacagtcccaataaatggtggtggaaaaactagatagtcacatgaagaagaatgaaactaggtacttatttttcactataaacaaaaatgaactctaaataaattaagacaaatacaaggcttaaaactatgaaactattagtagaaaatataggggaaatgcttcatgaaattggagtaggcaaagatttttcgaataagactgcaaaagcacagaaacaaaaccaaaaatagacaaatgggataatatcaaactaaaaaacttctttacagataaggaaacaatcaaccgagtgaagagtaaaatatggaggggttgttgcaaactatgcatctgacaatggattattattcagaatatataagaaactcaatgattcaatagcaaaaaaagaaagaacaaaaactaaataataggattaaaaataggcaaaaaacatgaatagacatttctcaaaagaaggtatacgaatggccaacaggtatatgaaaaaatcttgaacatcgttaatcatcaagagaatgcaaatcaaagccacaatgagatgtcacctcaacccagttagaatgaatatcattaaaaagataaaaaaaacacaaatgcttgtgaagatacagacaaaagggaattcttgtacactcttcgtaggaatgtaaattagtatagccattatggaaagcagtatggagatttctcaaaaaattaaaaatagagctaccatatgatccaggaatgctattactgggtacatatacaaaggaaatgaaatcagtatgttgaagagacatctgcacttccatgtttattgcagcactattcataatagccaagataggaaatcaacctatgtacccatctacagataaatgtataaatctatgtggaatctaaaaaagttgatttcatagaagtagagagtagaatagtgattaccagaggctagggatgggaggcgggagaggagaaccaggaatggttggccaataggtacaacattacattaggcagaaataataagttctggtcatatattacatagtagggtgactttagcaaataacaatgtagtgtatatttcaagatagctagaaaagaagattttgaatgttgtcaccacaaagaaatgaaaaatgtttaaagtaatggatataatactttacaccaactcaattattataccatatacacaagcaatgaaacatcaacttgtactccctaaatatgtacaattattgtttcaattataaattctaaaattaattaatcaaagaagaaatcaagagaacaaccatattttacaataaaataaaatgaaatacttagggatacatttatctaaggtagtaaaagacctgcacactgaaaactacaaaatattgataaaataaactgtagaagacataaataaatgaaaatattttccatattcatggattggaaatattaatattattaaaatatttattcttgccaaagcaatctacagagtccatggaatccatatcaaaattccaatgttaaaatttttcatagaaatagaagaaacaattctaaaatttatatggaactacaaaaaatcccaaatagccaagacaatcatgagcaaaaagaacaaagagttattaaaccacctgatttcaaactattacttaaagttatagtaatcaaaacagcatggtactggcataaaacacacatacagacaaacagaatagatagcccagaaatgaacatattcatgtatagtcaattgatttttcacaaaggtgccaagaatacccaatgggaaaaggatagtctcttaaacaaatggtgttgggaaaactagacagctactttatttctaaaagatattttcactggatatcagattgtagttctctttcagcacttgaaaaaatgtagagccacttccttctggcttctgtaatacctgatgcaaaatccattgtcattcatacctctttgtatggaaggagtatgggttccttgttactgcttcccacatggccttcagtgactctatgttgcggggagggcttgtttctgttgggtggtagcgacagttctgactctccattaggcctcttatacccctaatagggaggacaaggggcaccttatcaccgccagggtgttgggggagtggaaacccagcatcatcctcatgtggtttacacagacacttcagggcagggggctctcattacaacatagttgggataaagtcctggcttcctacatggaattctctgatctcaccccagtgggatgttgagatatttcattacagacttataatttcattacagactcttataggtgaaagcataggctctccactcagccttggctggcatgggggctatggtagataatattatatgtaggatcaagaaaagctgtggcagctctgtattcagtgaacacctgaattctttattctggtgatgaaaaatcttttttatttttatgtttatttttttagatggagtcttgctctgtcacccaggctagagtgcaatgacatgatctcggctcactgcagcctccgcctcccaggttcaagtgattcttgtgcctcagtctcctgagtagctgggaccacatgtgtgcaccaccatgcccagctaatttttgcatttttagtagagacagggtttcaccatgttggccaggctggtctcaaactcgtaatctcaggtgatccacctgcctcagcctcccaaagtgctggggttacaggtgtgagtcaatggtcctagccttagaaaaaaatttttttgagacagggtctcgcactatcacccaggctagagtgcagtgacaccatgttggctcactgcagcctctgcctcctaggtttgagcaatcctcctacctcagcctcccgagtagctgggactacaggctgctctaccacacctgactaatttttgtatttttaatagagatggggttttgccatgttggccaggctggtctcaaactcctgagctcaagtgatccacctgcctcagcctcccaaagtgctgggattacaggtgtgagccactgcacccagctggtgatagaaaaatctaataaggagtacacagtataagcttcaggataccagtttgactctatacattgctactgtgtgatacacagaagcagaaatttactctttccaagcctcagctttcttatttgtaaaaatgatggctatagtaactaccttaaaggactgcctcctagctcacaacaggggctcaataaatgacacttgctatcatcatcataactgtcatcattgtcattgtaacattaactagaaatatccagcacagtttttttttttaaataaatgtaagtcacatataaactagattctggctccctacgttaggatactataatagttagtagctgttctctaaggatccagaattgctatttaagccaggagtcataaacaggccccagagctgtgtgtgacctgcagaaaacttcttctcattaaaaccactgtattttcccttggggtttggactcacttcaggaatagctaagcaggttgtggcttcttaaggtcaaggcagacagtcaaaaaacctcttctagccatttggctcttactcggctgtgtcccagctgggccagttgggcatgtgacagggcaatggtccatttcaacaactcagtgcagctccagcaggcttttcctacaccatatgttgctagagccaagcaacaacctggtgagatagtgaggatattttgcagggaactggggacaagggtgaaggctcagagaggtaataacttgcgtaacccagcaaataagtggctgagtcaggaggggactcagtcattcaacctatatttcgtgagtaacagttcagtttggcttcctccagaagccaactctgagtcaaggatctggttgagagtgttttttcatgagagacgatcccaggaaatattggtaggggagtagggaagtcagaaaggaacagaaggcccccagtgaataatgaattcttaagcagtttagtacagggggccactggagcttaagcctcctgtagaccatataactcagccttatcccactttagggtgaagaaagccactatagtatttatccaccaaccctgacagtccttggttgaggctgctcccaggagtgttaattccctggggcctatgactctctgcctccaagacccgctctgcccaacacttcagatgctgatgtttggcagccagtcaggcatgcatgtgaatggtgaggagtgaggctctgcacagggcatttactttaatgtatcatatactcagcactgtgccaactgcaagagatgcagtggtagtcaagacagacatagttcttgctcttatggattttattatttaatgggaaagaccaaaaagtatataggcaattacaatgcagggtgataagaggtgcaatgatggaagtatagaattcttgggaacctatataggaggagtccttgtcccaagactgaggtgggtgcagaagagactccctagaggcagtggtatgttagtgatttaagtcaccactgtctcacctgtcttacctttgagtttccacaattctgttccctttgtacaaaataatctccatcttcatctgggcgtctaataacattcttcaagacttacattatatgtcacttcttcagagagatttttctgaatcttcccagtgggttttactttcaagctatatgtttccatagtaatcagtattcatattaagattaaataggagcagtgcctgcctttttaaatgttgtatccccagtacttgcccagtttctgacacacaggcagtcattatttgtggaaagaaggaataaatgacctgtctatagaaaaagctacactctgtgttgaggctggggccacaaggaagtgtgtattgtaattgggggtgtaaccactgacaggctctgccttataagaactgattctctatggctgaacgtgcaggtttgaattcaggaatgatatgggaatttctaagttctctgaagcaaatagtaatactctgccaaaaaatggaaaagaaataaaggttacttttagtatccatctcccaccttcccacaagttcaactccatatttcctgcattgctactacatgccaggattgtcttttgatgacttagaagaaaattctatgcagcttccattctagtgagcaagatagtgagcttaagaatacataagagataaaacattcccaagaagatatgagtaagaccagaacaggggaaatgtcaggaatcatgagcaaaacacaaggtgggcaggcacacaggagagcaagatttcccctccctgacttcttagaggtagcaggaataatttattactgttgggtgtgccagaacttcataaggttttcaaaccagcaatataaaaccagcaatatagatatgccatgcttcaatttgttctgaggcagagttcaaatttcaacactctagtcatgataaaaaatgaaaacactcaatgacaatttttgtgagtggttgggcaggaataactggaatcctggaataaggataaacagtcactcagttatttttcaggaccaaggacagtaggatgtgtgtacaggtgtgctcagaagcatattctcatgcagttattaattaagctaggcctatgacagattcacagataaaatgctctcaggtcatcagagaggaaaaaagtatttctagttggcagacggggaagccttcacagaagacaatttgggctttgctttaaataactgggaaaaaattgagtttaagaggaagtcattatggggcatagcttaggcaaaatcagagtttgaaagtgtagggtataattagataattaggttcttctaagtcgtgtgatgtgggtgggctatagtttgcatggaagaaagtgtaaggaaatagaagtggaagagcaaggtggatttagggaaatggaacaacttcagcaccacactgagaagacgggattgttaccctgttggcactaggcagctcctgaagatccctaaataggagtatggtttgcccatagagaattctcatggctgtatggaagaatgatttcagtagggccagaaaaatgagttaggaggctagaagaacagtgacaaagagggcctggacttcagcagtggcaggagtaatggaaaggaagaaactactgataagtcactatggtacctgggtgaggacagagagaaacaagtgaaaggcaatcctgaggtttccaatatggggcccagtggatggtgtcattaacagcaaggaactcaggagggatcaattctccctcccactgtctcctctcctcactccatgtcccaccaggcctcacactcctggacctttccagatccccagtttctctctccctccaggcctgccctacttggtcaatgccaactcctctgccccactgtctttaggcagactggctttatgactttgggaagaatcacttaacctctttgaccttccatttccaccttttaaaattggaagactcaaacacgggattgcacccaactctaaagttctagattttttccagtttacttctaccagtatgaaatgtactcagttgttaaacattcagagtatccccatcttctcaccaggtactggcatttaaaaaaggcatagtgccttaccaagaaacccagcaacaattgtggggtttcatggagcagccatggagataggtctgaaaaagaaggggataacttggattcagaggggcccttctgattctcaaatccttttccagagccactctctactctgacccctggtaaaaaacacttgtgtctatcaacagcagccatggtatgaatgagggaatccaactgggctgcctgcacaaggcagtaagccctccaggtagacattctgtataagactgactgagcaagcacagcacccatggacatggcctttcagctgtgccttacacatccctgacaatttcaagtacccaacttgaacctactgaatcagaaactggggatggggcccagcacttccctttttaacaaaccctgcagttgatcttgatgcatgccaacatgtgagaccaatacattaaaacatggagtaataaaaggaaaaatactactgctaaataatgcatgaatatattcattattttaagctaacagtagactcagtaatataatgtggtaaaatttttagaatggatagaatttaatttttgcgaataaagtagatatttccacaaaacctagcaacatctctatagacaaaggaggaaagaaattacccagaagccttaggtaaaaaaattcaggtaattaaggcaaatataagtgctgggttttgatttacatcctctaaatgtgtaggttccaagacctactctttctctttttgaaagcaatgcaaagtttgatttaaatgaaatctaaactgaaaccccaaaggtaaaacagataattgagttgtactctagggaaacaaagaggggtcatatctctgcctcccactccttctcacaagtgtgcagagggctccaggcaaggctcattatagcagaaaataactttaagtccctcttcactttacataccccatacaaaggccacagggaaagtatcatattcctgggacaggcattttaattaagatgaaaagaaaatgtgttttgttgagattgtgtttttctctaaaaactgagagtgaagagaagtgaggtaaacctcatctaaaaaagttcctttcagggagcacaattcaggtgcacacagtgaaaatgcaggtgcttcaatcgtctttgcagctgggagactgaagcacctgcccaggaatgtgctcttagtaaatatccttaattgagtcggacaatctgggaagcctatgaaattgccagcccaggaagtgggagtgactcagtctgtgtctgttctgtttgggcagatgcaactaaataagggggctttattgcttcagagcttttcctgaaaagagaagcccacctgtatttgcatgcacatttgcagccttctagaaaaacagaaacctgatttgccagctgttcagtcttctcagaactctgtgagtcaagtctcctttggaaaacatccagttttacagaagtgttcagccagaaggggatttaggtaacttctagtccagtggtttttgaactatttttgttttagaaactaaactcttctttcaaaagaaattaaccagaaatagattaaaatgactttattccacttgccccttcagccttctcttttttcccccttatcactcactgatcctgagggattcagcaaaacctagtttaaaaaccactgattcggtgtttaaaaagactgaagcccaagaagcaaaaggccttttcaaaggtaacaggagtagaaagtgtcagagcgggaacccgggaggcggagcttgcagtgagcagagatcaagccactgcactccagcctgggagacagagcgagactccatatcaaaaaaaaaaaaaaaaaaaaaaaaagagtcaatctctggttttgagatctttcctgtgcaattcttcaggcctatataattgtttatttggctgtgcattcattgtttgagcaaatgtttatgaaacaccttttatgtccaagcactagctagctgctatggactcagtgataagcaaaagaagatgaggctcctgccatcacaaattctacagtagaataaagatattgattaaatggtcacacaaataaatgtaaaataaagaggatgatactaaggaaggtggtaaaaatgatgtctagcttatgatttgtggacagtgacagtgaatattgcattagaccagatctgaatcctcccacatttgccagccccatcattctcagccctggatgcatattacaatccactttggagttaaaaaacaaaatatcaatactcaaggcctatccccagagattctgatttacttagttgggatgagatctgggtattggtcttttcccaggctcctcaggtgattctcacatgccactaaggttggaaatcactgctgttagcaatccctctcaggggaccttatgtggcttcttctctatttgattgtatgacaccaggaataaacagaagcaaaatgattcatctcccagaagggaacagattcccaggaaatcctggtaaatatggcatagaacatgttactgaccacacttggtcagttgaatgggtgggaagcagtgcaatagaatagaaagggccccaaactcacagataaatcctcagatgtgctgctaacatgtccccttcccatgtgtcatatgaaggcattgggccagaccaatggtttacatactgcatgtaaaggccacagggaaagtcttgaaacttgaacttccatcagcttcacctagaagctttgttcaaatacagattgctgggctccaccctcagcctctgatggatgaggactgagatgggacctgaatacctgcattccaaaaaaaaattctcaggtgctactagtgctgctgatttagacaccaaggctgtgatgatggtgactttaacagacagagggattccaagaggaatctattctttaagataacaatcctgtttctatttacattttgacattctatttatcacaaacttttgcattacttttgattcttctaaatatggcattaagatattgtttatcataactgctgagctttttggcatccctttacattttgcacctaggatgagtgcctcattcacttgattctaatccctgctgttagttcaatcactgaactaaatgaccctctaagggctcttcaagtttgaacttctttaaacagagaggcagtagggatggtgacaaagagaaaaagctccggagccaagctcccttgttcctgctcctgtaaatgtgttctgccatttacaagctatgtagccttgtggaagttgctaagcctctctgggcctttgtttttccttatccatgaagtcaagataatattaggttggtgcaaaagtaattgcagtttttgcctagatcccttgcatgcacagttcacaatagagttcatgctcatattgtgaactctattatgatcagtaactattaggttggtgcaaaagtaattgtggatttgccatttttaatggcaaaaaccacaattacttttgcaccaacctaatacttactgatcacataggtttatagtaattgattgagataacacccatagagtacatagtgtgtggttttagcagtgagcaccatcagcaaatgtcccttggtttaatcatctcctgagggatttccctcctgactaggttcacactgatttcttcaacgcctaaggggaatctttatgtttcttcaaggcagcatattataaatcaagttacacagcctcttggttttcctgattttccaatttgtccctggtgggtttgcattttctttattccaaagagttagtgagagatgaagctggctgggcttctgggtcaggtggggacttggagaacttttctgtctggctaaaggtttgtaaattctccaatcagcactctgtaaaaacagaccaatcagcactctgtaaatagaccaataagctctctgtaaaatggaccaatcaccagggtgggtggggccaaataagggaataaaagctggccacccaagccagcagtggcaacctgctcaggtccccttccacgctgtggaagttttgttctttcgctcttcacaataaatcttgctgctgctcactctttgggtccgcactacctttatgagctgtaacactcactgtgaaggtctgtggcttcactcctgaagtcagcgagatgatgaacccaccaggaggaagaaacaactccagacacgccatctttaagagctgtaacactcactgcaaaggtctgtggcttcactcctgaagtcagcaagaccacaaacccaccagaaggaagaaactctggacacatctgaacgtcagaggaacaaactctggacacaccatctttaagaactgtaacactcactgtgaggctctgaggcttcattcttgaagtcagcgagaccaagaacccaccaattccagacatattttggtgaccatgaagggaccatcgcctatcgccaagtggtgagtaccatcggacccctttcgtttgctattctgtcctatttttccttagaatctgggggctaaataacaggcacttgttggccagttaaaagcaactagtgtggctaccagactaaagacgcgggtgccaggctttctgagaaagggctttctaacaacccccaactcttcggagttgggagcattggtttgcctggaaccagctgctgcttttcctgtacttctgggctgagccaagggtcaacagagaggaaagccattcagcttcagggtcctgacaacaagttggttgaccctgcggccatgagcggaactctcaaagtcatgtcgcccaagtgagactcatccatctatcttatctatcctgacccttgcctcctgggtcctaatgcctgtcaaacttcctcttgcctctcttctccgaggctagtcccgcttctaaaaaccactccctgtctctggtgcttttctattttctcctgtaagaatgatttctagtataaactccaggactctgttaccttctttaggcacctgggctcaccgatcagaaagacataatttttgcccaaagccctgttgtagaggggattatctggaattttaggatccctcttcagacaagcaggcctaacaaaagctactcctgaagctaggatatggggagcctcagaaattgtatccttctgttcatataagtgaggacaaaaggcatcactcttccaactctggagatcccttccatcccacagggtatggccctccacttcatttttggggcataacatctttataggaaatggataaagtcccaatactaacaggagaatgcttaggactctaacaggtttttgagaatgtgtcagtaagggccactaaatccgatttttctcggtcttctttgtggtctaggaggacaggcaagggtgcaggttttcgagaatgcatcagtaagggccactaaatccaaccttccttggtcctccttgtggtctaggaggaaaactagtgtttctgctgctgcgtcggtgggcgcaactcttctgatcaccagggtccagggaccattgcgggttctcgggcaagagatgtttctgctgctgcattggtaagcacaactcttctgatcagcagggtccagggatcattgcaggtttttgcgcagggggagaaacaaaccaaaactgcaggtggttttgtctttcagatgggaaacactcaggtatcaacaggctcacccttgaaatgcatcctaagccattgggaccaatttgacccacaaaccctgaaaaagaggcagctcatttttttctgcactatggcctggccccaatattctctctctgatggggaaaaatggccacctgagggaagtataaattactatacgatcctgcaggttgaccttttctgtacgagggaaggcaaatggagtgaaataccttatgtccaagctttcttttcattgaaggagaatacacaactatgcaaagcttgcaatttacatcccacaggaggacctctcagcttacctccatatcctagcctccctataactccccttcctattaatgataagcctcctctaatctcccccacccagaaggaaataagcaaagaaatttccaaaggaccaaaaaaacccccgggctataggttatgtccccttcaagctgtagggagaggggaatttggcccaacccaggtacgtgtcccttctctctctttaatttaaagcagatcaaggcagacttggggaagttttcagatgatcctgataggtatatagatatcctacagggtctagggcaaacctttgatctcacttggagagatgtcatgctattgttagatcaaaccctggcctttaatgaaaagaatgcggctttagctgcagcccaagagtttggagatacctggtatcttagtcaagtaaacaatagaatgacagctgaagaaagggacaaattctctaccagtcagcaagccatccccagtatggatccccactgggacctcgactcagatcatggggactggagttgcaaacatttgttgacctgtgttctagaaggactaaggagaattaggaaaaagcccatgaattattcaatgatgtccaccatagctcagggaaaggaagaaaatccttctgccttctaccttcctcgagtggctatgggaggccttaagaaaatatactcccctgtcccccaactcactcgagggtcaattgattctaaaagataaatttattacccaatcaacagatatcaggagaaagctccaaaagtgagccctgggccctgaacaaaatctggaggcattcttaaacctggcaaccttggtgttttataatagggaccaagaggaataggcccaaaaggaaaagcgagatcggagaaaggccacagccttagtcatggccctcagacaaacagaccttggtggttcagagaggacagaaaacagagcaggccaatcacccagtggggcttgttaccagtgtggtttgcaaggacaccttagaaaagactgtccaatgagaaacaagccaccccctcatccatgtctgctatgccgaggcaatcactagaagacacactgccccagagggcaaagcttctctgggccagaagcccccaaccagatgatgcaacaataggactgaggatgcccagggcaagcaccagctcatgtcatcacccttgctgagccctgggtacatttaaccattgaggaccaggaaattgacttcctcctggacactggcatggccttctcaatgttaatctcttgtcctggatgactgtcctcaaggtccattaccatccgaggaatcctgggacagcctataaccaggtatttctcccacttcctcagttgtaatgactttgctcttttcacatgcctttcttgttatgcctgaaagtcccatacccttattagggatatattagccaaagctggagctattatctacatgaatatggagaacgagttacccatttgttgtcccctgcttgaggagggaatcaaccctgaagtctaggcattggaagaaacaaactcaagctccagccttaagccttcccacaggatgaaacttttctttatacatcacagagagaacaggaatagctcttgtggtccttactcagactcgtgggacaaccccacaaccagtggcatacctaagtaaggaaattgatatagtagcaaaaggctggcctcactgtttatgggtaattgtggtggtggccgtcttagtgtcagaggctatacaaggaaaggatcttactgtctggactactcatgatgtaaatggcatactaggtgtcaaaggaagtttatggctatcagacagctgcctacttagataccaggcactactccttgagggaccagtgcttcaaacatgtatgtgtgaggccctcaaccctgccacttttctcccagaggatggggaaccaatcaagcatgactgccaacaaattatagtccagactcatgctgccggatatgatctcttagaagtccccttggctaatcctgaccttaacctatataccggtggaagttcatttgtggagaatgggatatgaagggcaggttatgccatagttagtgatgtaaacatacttgaaagtaaacctcttcccccagggaccagtgcccagttagcagaactagtggcacttacccgagctttagaactgggaaagggaaaaagaataaatgtgtatacagatagcaagtatgcttatctaatcctacatgcccatgctgcaatatggaaagaaagggagttcctaacctctgggggaacccccactaaataccacaaagaaatcatggagttattgcactccttgcaaaaacccaaggaggtggcagtcttatactgctgaagccatcaaaaggggaaggagaggggagaacagcagcataagcagctggcagaggcagcagaaaggaaagagagaaagagacaggaagtcagagagagagaggaagaaacagagacaaaaagaagaagacagagagaggaagagacagagaaacagaaagtcaaagaaggaaaggaagagacaaagagggagtcagaaagagagaaagagagagacagacaaagaagaagtcaaacagagagaaagagaaatagtaaataaaaaacagtgtaccctattcctttaaaagccagggtaaatttaaaacctataattgataattgagggtcttctctgtaaccctataacacttcaataccaccttgttgtcagtgtaaacaagggaacaagggcataacccgaaaacactgaggccactgacaacccatagccttcctaacaaaaatccttaacccagcaggtttcctaacagggggatctaaatcttaattaattaccatacaaaggtctgaccacatctaggaggaactcccttcaggataggacgatggatggttcctccctggaaattaagggaaaaagacgcaatgggtactcaataagtgataaggaaactcttgtagaagcagagttaggaaaattgcctaataattggtctgctcaaacgtgggagttgtttgcattcagccaaatcttaaagtacttacagaatcaggaaggagccatctataccaattctaagttaatatggactgaacgaggtcttattaatagcaaagaataattggaatcccaaacttacaaggttttcaacaaaagtaaagtttgctaaaaaagttaacggtgtaacatgtattatcctaacttctaatcttatggaaatcagaccctatctgtgcccctcaaagctcaagtccatcaatgcaggggcatacaacgaatacacctacttatagggttaggaatggctactgctacagaaaccagaatagcaggtttatctatttcattatcctactaccacactctcagaggatttctcagacagtttgcaagaaataacaaaatctatccagtaaggatagtaactacaatcccaaatagactctttggcagcagtgattctccaaaaccaccgaggcctagtcctcctcactgctgagaaaagaggactctgcaccttcttaggggaagagtgttgtttttacacaaccaaaaaaagaggactctgcatcttcttaggggaagagtgttgtttttacactaaccattcagggatagtatgagatgccgcccggtgtttacaggaaaaggtttccaaaatcagacaatgcctttcaaactcttataccatcctctggagttgggcaacatggcttctcccctttctaggtcctgtgacagccatcttgctattacttgcctttgggccctgtatttttaacctccttgtcaaatttgtttcctctagaattgaggccatcaagctacagatggtcttacaaatggaaccccaagtgagctcaactaacaactactgaggacccctggactgacccgctggtcctttcactgacctaaagagttcccatccggaggacactacaactgcagggccccttcttcacccctgttcagcaggaagtagctagagcagtcatcgcccaattcccaacagcagttggggtgtcctgtttagaggggggattgagaggtgaagccagctgggcttctgggtcaggtggggacttggataacttttctgtctagctaaaggtttgtaaacgcaccaatcagcactctgtaaaaatgcaccaatcagcactctgtgtctagctaaaggtttgtaaatgcaccaatcagcactctgtaaaatagaccaatcagctctctgtaaaatggaccaatcagcaggatgtgagtgggccaaataagggaataaaagctggccaccggagccagcagtggcaaactgctcaggtccccttccacactatggaagatttgttcttttgctcttcacaataaatcttgctgctgctcactctttgggtctgcactacctttatgagctgtaacactcactgcgaaggtctgtggcttcactcctgaagtcagcaagatgatgaacccaccagaaggaagaaacaactccggatgtgccatctttaagagctgtaacactgactgcgagggtctgcggcttcactcctgaagtcagcaagaccatgaacccacaactggacacatctgaacattagaggaaaaaactctggacacaccatctttaagaactgtaacactcactgtgagggtccgcggcttcattcttgaagtcagggagaccaagaatccactggaaggaaccaattccggacacaatagtccataaggttaatgtaatgaaatgctgaatcttaaactaaactctttagaaaagcaagaaaaacctttggatcgattcttcttatttattgaacatcaatgaaataaatgaacagtacctcccaaagaggccaaggatcactcccatttatgttgagggacaaaaatatttgtataaagaggaagcagagaatgacattcattggatcttgagagggaagccatggtttgtgtaaatgtagtgactagttgtcaaattttttaataaattagtgctcccaacttatggactttttgtcaggctctagtttctttagaaagccatgtgagatgaagggatagggggaggaaacacaggcttatgaaggtctatgcataaaacatttatgaataaatgttaatttattcataaaatattttaattcataaaatatttatgaaacaccttatgaaggtctattcataaatcttcaccctggtgtctatgctgtctttcctcatgcctgctactgatcactgtttgtcctaactcaataggactttccactgtttgccaacatactctgtgaacctactcccttctgcataggttgagatgtttatctatataaaatgggcttccatgcttcttcatatcaaaatcttattcatgctttgagatctagctcaagagtcacctcttctaagaggccttcctcaaccccaccccccactcctatgtccctgtggttgttacagaggagtcagcctcatttaaggcacacctcagatgtttgagggtttctattcccacacatcatctttgataagttctttacatcccactgaaggagctcaactctagtttctgttttgttgattgtcaaactttaatcacagcaaaataacagaaacttagcttttggccagagaacctgatcattctgctactcagttcttatgaaaagcatcagtgtgggaagtgatattcacatcgtccttagattgcaccgtttgggcctctttactgatctatgcttgaatggtgtgtaatctatctgaactaagaaatattataaaaatgatcaccataaaatccattgctgcattacttttagaaagctcttagaaaaaactggccatgtgcttttattacctgctggagaaattgttctcatgattgaagatcaagaaaaactacactatttataagcaactggtgagctttcatcatgttgatagcagtgaattctgttctgttttcctctttaccctggcttggaaaaagcttggagtgaacattgaatagaatgttttgatgtgcattttaatgctgatcccattcctggcttcacattattttcctaattttatttactttttagtctcacctctatttttttcccttttgcctatatacttctgtaagacactttaaatccttgtatgaatgaggtaggggatacatacttagataattcatatttctttgaaagcagataatctaaatcctctttgttttgaaattctaatacttaatctagaacttgacatgttgtatacagttttaaaaataataagacgaaggatgaggtggaaggaaagattaagtttgctggcagaggtatctacatcctacttttacatctagacaaatgatgggaaaactcaagttttttttaggacatgcaagctacaccaaaaattttagaaaaactgaaaacctaaagatatcacttcacatgttttcaattcattttaatattgcacagactttaaggttacatacagatatttggcatacatagacatggctacaaattcaacaactatcccaagtgtaaaattattgttaaagtggttatttcctaactttctgaggcacatttatacatatttatatatatacacacacacatacacacacacacacacacacacacacacacacacatatatatataggacctggagataatttaagcattttttatactcactatagccattctaacacagaggtgttgtgactattaaatgagatgagaatgcactttgtaaagttaagaatcttaatcaagagcaaagtgaggtgtgcgtactcataaatacacactttacaagggcattcatttatctgtcagaaggaatttccaatttttgtggttgacataaaagggctataaatatggtgcataaaagcacacatacacaaacacaaacccagcaatacataaaaacaaataacagttgttactgagtacatgaactacttagagtcagctagactagtgatccccaacgtttttggcaccaggggccggttttgtggaagacaatttttccacagactggggcagggtggaagggggaatggttcggggatggttcaagtgcattacatttattgtgcactttatttctatttttattgtattgtaacatgtagtgaaataattatacaactcaccataatgtagaatcagtgggagccctgagcttgttttccttcaactagatggtcccatgttgggggtgatgggagacagtgacagattttcaggcattagatcctcataaggtgtgtgcaacctaaatccctctcatgcagttttcatagagcttacacttgtatgagaatctaatgtctttgctgatctgaaaggaggtggagctcaggcagtaatgcaagtgatggggtacaactgtaaatacagatgaagcttcactttgcttgcccgccgctcacctactgccctcctgctgtgtggcccagttcttaacaggccacggatcggtagtaatctgtggcctgggagttggggaccctgatctagactcctctatgtgtctcacacttactccatatccagttggttcacacatctggccactcccaacctactctacagctgccaccctggactgagctgcttcatggccagactcccaccattgctctcatccctgctcaaacattcttcacacagaagccggggttatccttcagaaacctgactcaggccttggcacttctctactcaaaaccctccagtggctgcccacgtcactgagggaaaaagccaaaatccttgccacgctcccttcctgtgacctttctggatgcctttccgactactgccccttcttcagcccactccaaccacttggcctctttactgtattttatatgtcacaggcacactcatggcctttgattttgttcttctttgtgcctggaatgctcttatcccaaattttcacatcgtttattttctcatctactccatgtctttgcttataatgtcacctcagtaggaccttccctttcagtcctatttaaaattataaatgccccccccatccctacataggagctttccattttcttccattgcttaacttttgtctgtaaaaattatcaccctttaacatgtcatatatatcaccatatatatcacaaataaactatatataactatacaactaactatataacttgctgtctatgcacaaaattattgaaagtattatgtaaaattaccttcagactatgtctataaggaatatataaaacaaaatgacaatttgagttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcacagatagctcttattattttgaaatatgtcccatcaatacctaatttattgagagtttttagcatgaagggttgttgaattttgtcaaaggccttttctgcatctattgagataatcatgtggtttttgtctttggctctgtttatatgttggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatagtggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaattcatctggtcctggactctttttggttggtaagctattgattattgccacaatttcggatcctgttattggtctattcagagattcaacttcttcctggtttagtcttgggagaatgtatgtgttgaggaatttatccatttcttctagattttctagtttatttgcatagaggtgtttgtagtattctctgatggtagtttgtatttctgtgggatcagtggtgatatcccctttatcattttttattgcgtctattagattcttctctctttttttctttattagtcttgctagtggtttatcaattttgttgatcctttcaaaaaaccagctcctggattcattaattttttgaagggattttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgcagttgagcggttttgagtgagaatcttaatcctgagttctagtttgattgcactgtggtctgagagatacctgtttgcagacgacatgattgtatatctagaaaaccccattgtctcagcccaaaatctccttaagctgataagcaacttcagcaaagtctcaggatacaaaatcaacgtacaaaaatcacaagcattcttatacaccaacaacagacaaacagagagccaaatcaggagtgaactcccattcacaattgcttcaaagagaataaaatacctaggaatccaacttacaagggatgtgaaggacctcttgaaggagaactacaaaccactgctcaaggaaataaaagaggatacaaacaaatggaagaacattccatgctcatgggtaggaagaattgatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacgaaagccaaaattgacaaatgggatctaattaaactaaagagcttctgcacagcaaaagaaactaccatcagaatgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattagaaagtcaggaaaaaacaggtgctggagaggatgtggagaaataggaacacttttacactgttggtgggactgtaaactagttcaaccattgtggaagtcagtgtggcgtttcctcagggatctagaactggaaataccatttgacccagccatcccattactgggtatatacccaaatgactataaatcatgctgctataaagacacatgcacacgtatgtttattgtggcatttttcacaatagcaaagacttggaaccaacacaaatgtccaacaatgatagactggattaagaaaatgtggcacatatacaccatggaatactatgcagccataaaaaatgatgagttcatgtcctttgcagggacatggatgaaattggaaaacatcattctcagtaaactatcgcaagaacaaaaaaccaaacaccgcatattctcactcataggtgggaattgaacaatgagaacacatggacacaggaaggggaatatcacactggggactgttgtggggtagggggaggggggagggatatcattgggagatatacctaatgctagatgacgagttagtgggtgcagtgcaccagcatggcacatgtatacatatgtaactaacctgcacaatgtgcacatgtaccctaaaacttaaaagtataataaaaaataaaaattaaaaaataaaaaaaaatgaatttcatagactgggtcctatccccaagatatctcattatgtatttgcaaatattcccaaattaaaaaaaaatcccaaatcccaaacacttcttgttccaaggattttggataagggatacttaacctgtatatagcaggtaatttgttaattgtcttccaactagaagaactccaagagggcagggatttttgttgtttttgttcaccgatgtttcctagtacataaaacagtgcctgacacagagaaggtgcttaataaatgttcatcagatgaatgactgaaccacttccagaccctcctttccccaattttatagaccacattcgtctcatatcattgccctgttttaaaattctcattgaatttatatgactgtaaaaggaagttcaccttgcttagttggaacaatgtgaacctcctacatgaaccttctactgacatttgaattttcttcatcaatattcttttgctccattcaaactgatctcccttgctttgctttgtgcgtgctgtacactttcccacctccatatctatatttgccaatctgaaggtccaagttttactcatatttcaatgcctaaatcaaaagccatctccttcatggagccttctctgattcctccagcaggaaaccatctgtctctgccttctctgagtcttacggttggctgactctcataacacaacacagtattgcagagagcatagctatggttaagcataaatttgcatgccttcacagtgtgaccgtgagcatgtttcttaactcttgaatctttattctcttaatgtaaaataagaatgctaatatagttaatatattcttaatataatataatataaaataatgtaatatacattcttaatataagaatgctaatagtttacttgcagtatgattatgagattatttgagataatggaaatcccttattttctcaataaatgatatctattttcagtatcatcaccatcatctcttccttgaaatacgagtatattatttcctgttacattgtaagtttcttaaaaacataataaatgtcttaatttgtctctacacacacatagatactcagtaaatatgtgttaagagaatttgagaaccaagaccatcactttgtcccctaagttaaaacaaaaatacttgctaaaaagttggcccagcacagaggccaaggcaggtacattgcttggtcccaggagttcgagaccagcctgggaaacatggcaagatccatctctacaaaatttttttagaagttagctgggtgggcatgatggtatgcatctgtagtcctagctactcaggaggtaggagaattgtgtgaacccaggacttcgcggttatagtaagctatgactgcaccactgcactcctgcctaggtgacacagtaagactctgtctcaaaaaaaaaaagatgatagcagttttgggggggacaatcatcttctaacaagtaactctattcctttatgactttgttttacttctaagacgttgttagcatagaatttgaagcttactaacattaggttttcttattttatttccttgtatataaaaaggacttgtagttaaaaaatatccacctaagcttttctaaaataagtctgagaaaacataggggacacagtcacatatacagatacattgtggaatcaatatatgtagtgaggaaaatagaagcaagtctagggtgctatgggaacacaaaggcagtatattcaatccttctgtgttgggaaaatattttctagagaagatggcagctgagctaaactactagagatgagtgaaaactagtcaaaagaaggcaagagaatgggcattctatccaggcagaaaacatgtcataataaaaggcaagaagacttgaaatccaaaatagcatgatatatgctggatttcataagcatttaggcatgatcacagcttctattccagagcaaggagtaggaaaatgcaaagttggagagaaagttgttggccaagttacagaatatcctacatgtcatgctctagagctccattttgcaggtaaaggagaaacatgaagtattttaaatgggaaagaacatggtcagatttaagttttggatagattgctctggctgcagggtggaggctagatctgaggaatacaagaataaaggcaaacaaacaaaaatgcacatcagggctattgaaaaactccaagctaaagaaatggaatgcccaagccagagaagtaggataatacaagaggcgatggagtcaaaaactgtgggcaatagaatcagcaggatttggtgattgctttatgaatgggtttggagggaggaacctgggtttctatttggatgattgtgcagacagtgatgctaatcataggacatctttgaagagaaagagcagaacacaggctgggcatgtgggagggagatgacagttcagtttcagtcacactggaacgtctgtgcttagcatcttaaccttaggggagggagagattcgagctggagataacatttgttatcattagaaaacagagtggttcaaaccatgggagtgtgtaaactaactcaaggatgaagtttacgtagagaacagaattctggtgaacacagcatttaaagcagaggaggaggagcctacagaggaagcatattaggaatgcaaagagaaagagaagagaaaaatcaaatgaaaataaatttgttgaagctaagagggtagaaaatttcaggaaagagggattgatcaatggtatcaaatgcagctgcagtgtaaagtaagatacaagcaaaaaagtgtttcttagctttggcaaaaggcattgtaaattaggtttagagtgagaaggaaaacaagacagggttaagcctgccacttggaaaagatgatgtcatgtaaacaaatgacagtgaaagaaaagcttccaacattcctgttgcttgtctatcctaacaaaattaaggatcttcaagctggaaaggtaaagcaatgtctttaagcagcaattaaggctcaagataagttagaagatgataaagacaggaccatgtagttttgcatgtaggaaatcttccaggcccagatgaattatagtctacgacacacacatgcatgcgcgcgcacacacacacacacacacacacacacacacacacacttagaagcgttaagcatcatagataggaatgtcaaaaatgctaagaggctggaagctaataaaaagaaaggggacctcagaaaacttgtcaaatatataaagtactattatatggaatagaaagagtaaatttattttgtatgacttcgaaaggcagaacctaaataaaagtgtagaaattgcagaagcacagatttccactggaaacaactttctatcatccagtcatgacatagccaccatgaaaggcagtattttcctgtcttggaagtattcaagatgaggttgatggccatctgtcaggagggatagttggactcgatttggaagggtcaatatccagtattcatgccttcacctctctttaaaagatctcattttttatatatattttttaaaaacacttttccttattgagcttagaaaatcaaatatatttgtcatcactggattctattatttctaaggtcctttctgaataggaaatgttatgtatctagattctagaaaatatagtaaatgttgatgtaacgatgagaaacccagcttagttaactaaattatttgggacctggagaggactggaacagagttggtgttgtgttagtttcatttgtcatgggaccccttgcaggagaacaagggttatggactgaattaggcagtgctccatgctggctttggactaccagcttttaaaacaaatatttagtgatgtcctcctggtgccagacccaacactaggtaaagctactgtggtaaaaacatgtaaagacagacatcaggcaaactcagaacagaagatgatggtggttattattttaaaaaactccctcttggccagttaaaatgaattagaatgatcaaaagcattagcactgagttcttgctttgtatagttcagcctacaaatcaaatactgctctctgtttattactgcaagatcataattcacaaaggaatgttcagagaggtcagtatttatgactacccgaagtgtttcatttgcaaaaattataaatggaaaatctggcacttagttagaaatgtagatcttctggtacataaatttgccccattgatttttatgtatttcttaaactgtgcactgttgatttcaatattgttttggaacagattgaccataaatatttaaataactgctgttcaacaaagttactcaaaacagtagctgtttgaagatacaactgtgatctgctgaggtcaagaaaagcaaattaaaatagaaaagattcagaataaattgttacttggaactgttttatcaaccaaaacagaagaaagttaataagatcatccttgcaatttattagtaccaaaaatatgtttggagtggaatgtatgtatacaatatccaccaccaacatgaaggtgggaggaaaggaagattttagatttcacaatgacctgaatgaaaggattgagctacaaaacctggtgaagtgagatctaatgctggccaaatagttttactttgttttttgttttgttttgtttttttttaaaaagtctatctattactttgaaagaggatatgttaaaagcacagagtgctttgcatctgggatctactaccaaaaatatagcaaggtggctcttgtcttaacaactagtctaagaaatattctcctatgtgacctgaatacctactcttttcattgtagcatgtaagagatgttaaagccatcacttaaagatgatttaaaatatttcctagagaagcctttctcagcctccgaggctagatctgattcttctgtatgagagctatgggaatacaccgctcagatctcgtttcaaggaaaacatgctgtgagggatgactgagtatagcatgggtactagatctggccattccttatcaacagaggatttctctagaaggcagtctttgctctgggcctccctattaacctggcctagatgttctcagagctgcattcaactctgatgctctttctacccaatctttcttcgtccaccctctccttataaagatgttagagttgcatcactttctatagctttccccactcagattttctctctctttttttctccatagtcattccttctaataaatcctgtgacacattcaattccctcttggtatttgatcctggagaatcaaaactgacactccattaatgtaccctcagagttccttgtaccatttatttaaagcccacatattttgtaatgatatatttatatgattatttaataaataattttcatcctatcagaccactgactttcactggggtaggaaacatgttgacttcatccctaggtctacaaaaccacctagaaattcatatgtgatttataaatatgtattgagtgaatatatgcattaaaaaatagtgatagtactatactatcataaaagatttgggggttgcattaaagaagataaacaaaaaagtggtcacaatagactttagcaagaggaggagaccaggaggggtggagaaagaaaacaaaaagtgaaaataaatcaacagtgcttgaaaagttgcttgactgtatctttctgcttatagggttttgatagagattgacagagaaggtatattcaatactgcaaggatctcagagctcagatgataagaatctggtattactatacttgttttaacttctaatgagaacagtactgatgagcccagtcaatattaatcacattcttgaagttcaggcatttatattcttaactgaaaaatgaaaacattttccacatcaaaccaagcaaattccatgaataccaagggcttaggaaagtattttagttcgagaactgtataactaaattttccaggtctattatgatattctatatgctatattgtcattaattcttatagtcactgaaaaacttgtgagcttctttgacacacagaattggtagtgtatgttaacagaagtggagttgaaacaatacttttttgacttttgtttctgatcatggtggggtaactggtaccagactagctcttccactgcaaacaactagaaaactgttgttgtacaaaatgtaggaaagacatccctatttttgaatatcaaacaatgaacaacacagaactgtaaccacctagaaaaggaaaacaaacagacttaattgctctttcagtttgaaggcctttgatgaaccctggggtaagaaaggggcacccaaggaaaacatgacagtcttacttagctgaggagacagagatgatttcaggcagtttcatgcagccataatttggaggcagatactggagaggtgagagtggagaaagagtttgagaaatctgcaatagaagtcctattgagtctttggttgaatactaagatgcacatgtgcagtgtgagactccacaggcttggcaaagagtgactatcagtgagcctaaaatactggggaggtataaattaatcaactatgagaaccaccccaaactgagagagcttccatgtgagatgttgaagggagacccaagaaaggctataccttagcagcagggctaaaatagccacagggtgatagctaatctagattcattcaagcaaaccttgcaaacaggccttaaaaggagcatgattattaatgaataaattaactgctatcagaatgaagcccaatattttttaatgggagacatctagatactcaacaacataacattaacaatattcagcatcatataaaaatttctagatatgcaaagaagctatgattaagattaaaatcagtcaatagaagcaaactctaaaaatgataaggatgatggatgatatctttagtcaaggacttaaaaaatctattaagattatgttcaatgacaacaaataaaacataaaaatattgaggggagaaatgaaatctatgaaaaaaatacctaaaggaacttccggagttaaaaaatacagtgtttgagatgaaatttactggatgagcttcaacacaactcaaacacaaaataagttaaaaaaacaataaaattgaagatggggtataaaattattcaaactaaaacattaaaaagtggctaaaagataaatgaacagaacataagtgttgtgtaggaaactatcaagtcattgaacatactgcaattggagttctagaaagagagtaaagcgtgggcagaaaaaatatttatagaaatcatagctaaaattttctggccaggcgcggtgacactctcctgtaatcccagcacttgtgggaggtcgaggtgggtggattacgaggtcaggagattgagaccatcctggtcaacataatgaagccctgtctctgctaaaataaaaaaaaaaaaattgttgggtgtggtagcatgcaccttagtcccagccattcgggaggctgaggcaggggaatcgcttgaacgtaggaagtggaggttgcaatgagccaagatcatgccactgcactccagcctggtgacagagcaaggctccatccaaaaaaaaaaatccaaatttaataagaaaataaagccatagaactaagaaattcaataaaatttgcttaggataaatacaaagaaaatttttctaaggaacatcataataaaattgctgaaaaccaattacaaagataaaaatcttaaaaataggggaaaaaagtccattacatacaggaatacacattaagaattaccattgacgtcgcatcataaacagagcaaaccataagataatgggagaatctagagtgttgaaaaaaggaaaaacaaaacccagtctagatagaaccagtgaaaatattcttatatccctcaaaaatgaaggcaacataaagaacttttcaaaaaagaaaaaaagttgagtgaattcattgtcatgcataagattttagatgtgaattcatatctaaagaatgaggaataaaggaatgacaaaaattagaaatgataaagatgtcagtaaatataaaagataattttctcatttttaatttttttaaaaaagaataacaatgaattgtattatgccatatgtacatatattatatttagacacatatgtatacatatatcatgtgtagaaataataacaatcagaaagggaaagacatgctgttgtaaggttcttacattatacgtaagtggaataatatgctgcgacaagtgtattataaatcctagagcaaccactaaaacgaaaaccaaaacaaagaggtatagcaaggaattcagtagaggagatagtatgccaaaaataattaatatgaatgaagtcagaaaaagaagaagcaaggaacaaaaagcagatggataaatagagaaaatagcaagatggtaaatttaaaaatggaatgagctcaccaattaaaaagcgtagattgacagattggataaaaatgcaagacccaactaaatactgcctaaaaatatacactttaaatataaaacataggtaaaaagtaaaaggacagaaaaagacctatgatgtaaacaataatcataagagggatatcttagtatcatataaagcagatggcaggctaagctatattgccagggccaaaatgggacaattcatactaactgataggtaattttatgtgtcagtttgagtgggttaagggatacacagatagctggtgaaacattatttctgagtgtgtctgcaagggtgtttctagaagagattagcattggaatcagtagactgagtaaagaagatgaccctcaccaatgtgggctggcatcttccaatccattgagggcccagacagaaaaaaaaaaagtagaggaaggacaaatttgctctttcctggagatgggacatccatcttttgcccccaggcatcaaaactccaggttcttgcgtcttcatctgcagaatttacaccaatgccccacaggcccctccagttctcaggtcctgcacctggggctcggagttccatcattggctcccatcattcttggcctttgggcccagactgagttacactactggctttctttattctccaaattgcagatagcatatcatgggacttctcagcctccataattgcgtgagccaattctcataataaatcccctcctctatctatctatctatctatctatctatctatctatctatctatctatcacctactggttctgtttctctggagaacgctaatacactgataaaagggtcagtacatcagaaagacattaatatattaaatgcagattggccctataaaacagcttcaaaaatgtaaataaaaaactaactgaagcaaaaggagaaatagacaaatccacaataatatttggtaatttcaacattcctctctcagtaattgatagaacaagtagaatgaatatcagtaattacgcagaagatgcaaacacattattatccaatttcacttatttgacattgaaaaacacaacacacaacacctaaaaaaatacacatttttaaaaagtatatgtggaatattcaccaagagatcatatactgggctacaaagtgaggctcagagaatttaaaagaactaaaatcacacagagaacactctctggccacaaaagattaaattagaaattaataacaaaaatagagctggaatgtcctccaacattaaaaattaaacagcacatttctaaataacccagtggctcaaaaatgtcagaagagaaattcaacaatatttcaactaagcaatgatgacaaaacagtgcatcaaaatttattacttgcagataaaggcacacttagaagaaaatttatagctttaaatgcttatgttagaaaatataagttttaaaatcaatgatctaagcttctaccaccataagaatacggaaaaagaagaactgagcaaaccaaagtgaagaaaaggaaggaaataaagataagagccagaataaaaaatggaaccacgaataggccctttgaaaaaaacaataaaattgattaacctctagttggactaatgaaggaaaaagagaaagagaaaaaaaattgacgatatcagaaatgacagaagggatctcattataggtcttacagactttaagaagaaaataagtgggtattatcaaccattttatgctaatgaattttccagttcagaggaaatagacaatttctaagatacaatttaacaaaactgatatgtaaagaatctgaaaattcctataatctactagaggaatcacatttttaataataaaaaatcatccccaaaatgtggatccaaatggttgcaataataaattccttcaaatatttaagaaagaaataccaatcttatgtaaactcgctcaaaaaatggagaagaaagaaacaatccctaacatgttataggaggcaagcattaccccaacgctaaagtcacgcgaagacattacaaataaaaaaaaaaccccgaaataggagaaaatctttataaccttaagttaagcaaagatttcttagatatgacaccaaagcatgatctataaaaaagacattaataaactgaacttcatcaaaattaaaaacttctgctatgtaaaagataccgtgaagagaatgaaaagataaaccataggccatgagaaaatatttgtaaatcacatacctgataaaaggacttggatctagaatatataaaggactctcaaaactcaattataagaaagcaaacaatccaattgaaagatgggcaaaatatttgaacagacatttcaccaaagaagacacagaggaaactaaaactggaaacagatatggtaatccatgacaaaatgttagcatttagaagtaagcaaataagaacataaaaagataccctgcttccttagtcattatggaaatataaattcaaactgcagtaaaataccactatactcttagtagaatgaataaaaataaaaagactttctctaccaaatggtagtgagaatgctgaggaactggaactttcatacattgctggtgagaatgtaaaatggcacaatcactgtagaaaacaatttgacagtttcttaaaatgttcccctatcgtatgatcaaaccattctacacctaagtacctactccagagggaaaaaggatagatctccatataaagaattgtccatgaatgttcatagcaagtttatttatataataatagccccaaactggaaacaatccaaatatccatcaacagataaagtacggtatatccatacaatgggacacttctcagcaataaaaagatcgaactattgctacacacagtaacattgatgaatctcaaaacaatgatgctgagttaaagaagccaggaaaaatacatactctatgagtttatatatataaaattctagaaaatgcaaactaatctacagtggcagaaagagggctagggaaagggatggattacaaagaggcacaagaaactttttgagggtaatagatattttcattctcttaattagtgatagtttcatgtgtatatatctctctatatatgtcaaaacttatgtacttgtgcattttattatgtacaatttactgtaggccaactatacctcaacaaatttaaaaagtcattttaaatagataactatttaaataaatatttctcaaaaatatacaaatgaccaataagcacatgaataaatgttcaatatctttagccaccagggaaacaaaaattaaaaccatgagaagatactactacacactcactagaattctcaaaaagagtggcaattgcaaatgttggccattatgtggagcaactggaactctcatacactgctggtgagagtgtaactactttggaaaatagtttggaaatttcttataatactaaatatgcactaaccacatgacccagcagttctactcctagtatttactcagaggcaatcaaagcatgtgttctcaaaaagctttctaaaacacagttcccggtagcttttttcataatagaaactggaaaccacacaaatatctatcatcaagtaaaagaataaaaaaattttggtatattcacacaatagaatactatgcagtgataaaatgaaggaactactgacatgcaataacatggatgaatcacaagaacattttgctggaataagtcagacaaaaaggaacgcatacaatacaaatccatttatatcaagttctacaaggataagccaacatataatgatcaagtcagtgtggttatacaacattgcaaatgtactaaataccactgcattgttcatctgaaaatggttaattttatgttgtatggatttcacctcaattaaaaattagtgggccgggcgcggtggttcacacctctaatcccagcactttgtgaggcagaggccggcggatcatgaggtcaggagatcgagaccatcctggccaacatggtgacacctcgtctctactaaaaatacaaaaattagctgggagtggtggcatgtgcctgcaatcccagctactttggaggctgaggcaggagaatcgcttgaaccagggagtcagaggttgcagtgagccaacatcgcgccactgcacccctccagcctggcaacaaagcgagactcggtctcaaaaaaaaaaaaaaaaatttagtgtggatggctaaggagattcactctaaatggtcactaagtaatctttttgggatgattgaaatgttctgtatcttcactgtggtgatgatcaatgggagtatatatgtgttaaaactccttgaattatactctttaaaatgggtgcattttattgcatataaattatgtcccaacaaagttcatttaaaaatacattttctcaacttcactttcaattattggtgcttaagtgtctcttttgggcgatgagagataagagaagtccgtggttggggcttccaggacatctttttaacaagaggcaactctgctgtcacggactttgtggcttttgtctgtacttcaggcagatgagacccttgaagttgactttatcaacagctttccatgctctctgactgctggttgggtttagcctataggaattcccaagaggagataagagggaaggtgggagatatttacacacacgtactattttctgcaaggtcttcagttggctttacctcttaacagaagaccttggctcctctagaaacaaagaactcaataggacttctcatttttcggattcagtaacctcttctcccttcttgatcctgcaggaccaaggctaataataatttagcccctgattactgcactatgctttttaaattgaagagtaacaggtatacagaaagggcactgaatgctgatttttttcacccattttaccaccacctagatcaagaaatagaatgaatactcaaaaaacacctttggattcctacctcagtcattccccattttatcccaaagcaaacaccatcgtaacttccgatattttgtttttgaaatgtgtataaatgaagcaatacagtatattttcattcttgtaagctgtcctttgtataaatatctcacaatttacttggtcattctattttttatggactttgagttgttttcatttagggttatcatgaacagtactgctatgaacattcttatacatgtcttttggtgaatatatgtatgtgtttctcttggatatatacttagtagaacagttggatttactgtatgggtatgtgcagttttagtggatttacccattttccaaagtggttgtaataatttatactcgcactggtagcatatgagatttttagtatcacaatatccttaacaaccattgatatttttagtccttttaattctagccattctgatcagtatgtcgtggtattccattgtggctttaatgtgcatttcctgataatagaattgattacattttcaagtacttattctcttttttgaaatgcctgtcaagtctcttgcctattgttctattgagctgtcagagtctttcttatttgtagttccttataatctgatgttaagtctgttggtagtcacctgctttgctaacctatttttctacactgtgtcttgcctttttagtcttttaactcctttttttgatgaatagaaaaatttaactttaatgtagtctaatttatcaatatttccttctatgattattatcaccttttatgtcattttaaacgttttaacctacctaaggttgtcaatattttatcttatgttatagtctagaaagtttagtgttttattttacacattttaaacatttcatctgaaattgctttatgtgcctgtggtagggaccaagattatttctccccaaataatttcaaattttctccacaccatttattgaaaagaccacattttctccattgctctgcaatgccatcttttcaaaagattggcaatccatataaatgtgtttctggactttattatattccattgatttgtttgtttgtcctgtatccaatacccaatatcttaattattgatgctttataagatatcttaatagatggtgttctagactgaactgtgcccccctgcaaatttatatattaaaaccctaacctcccaatgtgacaatatttggataaagggtctttaaggaggtaaataaggttaaataaggttataaaagtgaggtcctgatgcaataggactggtatacttataagaaaaggaaaagacaccaagagtgggcacgcataaaggaaaggccatgtgaggtcagagcaagaaggaagctgtctgcaagccaagaagagaggcttcaccagaaacccatcccgccagcaccttaatctagcctctggaactttaagaaaatcaatctctattgttgaagctacccagtctctgatattctgttatggcagccccagctgactaatataagtggaaaattcctctactattcttccaattgtgttggctggctttttgtgctttacatttctatataaattaagaattagcttttcagtttccacaaaaacaatcctgaaatttttattagaattgcatgttgctgtatatcacctaggaaagaataaacaactttacaatattgagtctttccatctgtgaacatgatatattcctccagtcacttgtcttccttactttctgctaataaagttttttggtattgatgttttgaccctctgtacttagatttattcctaagtagttgatgttatgttgctcttataaatgatataaccccccaaatcattttaaatgttttttattatcatgtgaagatataagttcattttacatgttaattaggtatctaaacaccttgcaaaatcacctgttgattctaatagtttgcctataagtactttcatattttctatgaaaatatcccattaaaaagttcccttctacatgaagcttgctgagagattttttttcatgcttattgataatataatttttaaaaattcagttctagaactagcctttagctttttagtccatttacaattaatgtaactaccataggtttatttgttttattttgggctaggaatgtatttttaacttctgaaatttccctctattagcttgtaactgatgaattattttaccatttaaaaaatattgattgcaccagaaattgcaacatacatctattaattattaaagtctaatttatattagctatcttactacttccccgaaagtctaagagagcttaataactttaactcccttaatcccttccttctgttatttgtgttatttttgtcccctgttttaaactttacatgacgttattatttctgttcatttttctatcaacatacaacacttttcattatggttcactcacttctgtattttaaatgcatgtctctccttgcaataaattatctcatattttactcgtttaaaaacatctttatggccgtgcgcggtggctcacgcctgtaatcccagcactttgagaggccaaggcgggcggatcacgaggtcaggagatcgagaccatcctgactaacacggtaaaaccccgtctctactaaaaaatgcaaaaaattagctgggcatggtggcgggcccctgtagtcccagccactcgggaggctgaggcaggagaatggcgtgaacccgggaggcggagcttgcagtgagctgagatcacgccatggcactccagcctgggcaacagcgagactccacctcaaaaaaaaaaaatctttattttgcttttatcttaagggttattttattagatagagcattcaagagtggcagttggctcctttcagcattttaaagctgtgactattgtctttggggttccataatttcatttaaaattcagctgtccaactgtttttgttttcatagtagtatgtgtttctctctatttttaagattttggttttctttttagcagttctactatgatgtgtctaggcattgcttttttttttaatttatcttgactggagttaataacagttcttaaatctgtagttcaatggttttcataaattttagaaaaatctcagctggtatctcctcaaatattgatattgctcattacctctctgtcatacttcttagacctcaataaaaaatatgttactatgtcccttgtatctttaggcttttttcttattttctatcctttatacttaggcacatagaccaatggaaaagaataaagaaccagaaataaactcaaatacttacagtcaactgatcttccacaaagcaaacaaaaacataaagtggggaaaggacactcttttccacaaatggtgctgggataattgcctagccacatgtaggataatgaaactggattctcaactctcaccttattcaaaaatcgactcaagatggattaacaagctaaactgaagacctgaaactataaaaattctagaagataacattggaaagaaccctctagacattggcttaggcaaggatttaatgaccaagaactcaaagcaaatgcaataaaaacaaagataaatagctgggacctaattaaactaaagagctttttgtacagcaaaaggaacagtcagcagagtaaacagacaacctatagactgggagaaaatcttcacaatctatacatctgacaaaggactaatatccagaatctacaacgaactcaaacaaatcagtaagaaaaaaacaaacaatcccatcaaaaagtgggctaaggacatgaatagacaattctcaaaagaagatacacaaatggccaacaaatatatgaaaaaatgctcaacatcactaatgatcagagaaatgcaaatcaagaccgcaatgtgataccaccttactcctgtaagaatggcactggaacagaggtgtgtctatctcgtttggttacatgaataagttctttagtggtgatttgtgagattttggttcacctatcacccaagcagtacactctgcaccatatttatagtattttagctctcacccccctctccctctttcccccgagtccccaaagtccactgtatcattcttatgcctttgcatcctcatagcttagctctcacatatcagtgaaaacacagatgtttggtgttccattcttgagttacttcacttagaatatagtctccattctcatccagatcactgcaaatgctgttaattcattcttatttatggctgtgtagtattccatcttatgtatatataccacagtttctttatccacttgtttattgatgggcatttggattggttccacaattttgctattgtaaattgtgctgctataaacgtgcgtgtgcaagtatctttttcgaataatgacttcttttcctctgggtagatacccagttgtgggatttctggatcaaatggtagttctacttttagttctttaaagaatttccaaactctccttattgttttccatagtggctgtactagtttacattcccaccagcagtgtagaagtgttccctgttcactgcatccacgccaacatctactgttttctgattttttgaaaattatgagaccatgctatagtgacaaatgaaaaccttaggttaataaaataaatattaaatactcaaattaagaatgcaatcagtggacctaaaagctgctgtactataacagtagagaagattactgaccaggaagtcaggccaataaatgtttggtcctgggcctccttctattttcaatttctactttttctcttaataaccacccatgtgcatggctttaactaccatctatacctctcattctgttctcttcccaaaactcatggcctatttgatgtcactccatggagggatgatacacaactcaaagttaatcttactaacttctcccattagaacataagttgcattggaacagaggtgtgtctatcttgcttgctactgtatgaccagtactcataacttagtctagaacatagtaacagatatgaatgactatttgtggaatgaacccgagaagatactcatagctagattgtacttctttttgcttagatgacttctgactggaatggggttgggaaggttttagggggtttgggatggagacagatggtgggttgggaggtaatgattcatcctcattctttgctatctataagcctacatagcaagtcaagccttcatcacagggatgccactcatatttccctcattgacaccatacttaaacttatccaatttactagcaatcctatcaactctgcctccaaaataattgatccaatatctattcatttctttacatcttctctgctgttgcattaatccaagcctctgtcctttcttgtccactgtgatagcctcttattggtattcttgcctcctactcttatttccctatcatttatctccacacagcaaccaaataccttaaaaataacaaaaaaaattaagtccttgacctactttaaactgcaaaggtttcctattacactgaaaataaagctaagtttcttactatggtgtttaaggccatatatggcctagcgcctaccttccatactgactctggcttcatcattcttccccttgcaaactaagctctagccacactgctctgctttcttttatgctaacatagtaagctcattattgcttaaggtcccttttacttgcttttccctctgtctagaagatcctctcccctggtttttgtatggctgatgacctcatgtccttcaaatctttagcttcctggaccaccatatttaatggccactcaatctttcattatcacactatcctgtattatcttcttcacattttttatagctaactcaagttattttctagaatatttttccttttattgtctgttttattcattaccattttcccagcatctaaaataatagtgacccataataaaataatgacccatagtaggtccttattacttatctgtggaatatcgcagtgaatgacaatgaaaggaatatactctcaagctctcatgccactgctcttctaaatgtcatttctttggaatgagtccatgtttattttttctttacttaaagggaaataagtaaagtttaaaatccgtaattttttccctataccctgtctcttcttatagaactattacatatttcttgtaataataatgattgtatatgttcaattgatcttttattcctgtcaatgtgctagattatctcatttatttattacatcaaccctctaaattagatcctattataaagtgtactttatagataagatgtatgagttttggaatgtttccattagtttctcaagaccacaaagctaaccagtatttcattttactttctcaagtgaactttaggaaccaggtaatgataagatagactttggataactgatgactgaaacttttttaaaacaacccttttggtaatcagtgatggtggtagaaggagggaggtgtggggtggggggaggaagaggaagggagagagaacacttcatatcatgacagccagataaaactttggtagcaatctctgaactcagctcatttaacatcattcccagaaggaaggtgcattagttcgttctcacacagctattgtataaataactgcctgagactgggtaaattataaagaaaagtttaattgactcacagttctgcatggctggggaggtctcaggaaacttacaatcatggcagaaggcgaaggggaagcaaggcacatcttacatggtagcaggagagaaagagagagagtgaggggagaaggtgccacacttttcaaccattagatctcatgagaactctatcacgagaacagcaagggggaaggcctcccccatgatccaatcacctcccccgagttcccttcttcaacatgtgggggttacaatttgacatgagatttgggtggggacacacagccaaaccatatcagagggacaaaccaaagtcaggtcattctctctgaattcctttgtcttctgttagaacaacccactaataagtagactctcaaggctttgggttcaggaaaatcagaaagactgactttgcttgaccatttaatcttggggcttagcttgacatatttattctgttatccaagaaacaaaattacatgcaaagtagaaagtcatttacatctgccaaggagtttagtttgaaataggagagaatggaaagagaaaaatagttaagaaaaatcttaggaagataaacaacctcaaagaccaagagtctgtcttaatataactgcaaatgttttaatgaaaactgaagggaaaaaaaaacagtttggatgtctagataattgattaaaattttaattttctacctggttgtttggtactataaaaatataatcatgctaaatcacttcacaaagtgttgtaataaatgttgctttttctcaatggattttcttagaattttagtgttctgtattactattttgtgtataaagtacagtgattattttttaaaatttccaacttttattttaagttcagggatacatgtgcaggatgtgcaggtttgttacataggtaaacgtgtaccatggtggtttgctgcacacatcatcccatcacccaggaactaagcccagaatccattagctattttcttcctgatgctctccatcctcccaccctccaccttccaacagaccccagtgtgtgttgttcccccaatgtgtcattgtgttctcatcattgagctcccacttataagacataacatgcagtatttggttttctgttcctgtgctagtttgccaaggataatggcctccagctccatccatgtccctgaaaaggacatgatctcattcctttttatggctgcacagtattccatggtgtctatgtaccacattttctttatccagtctatcatcgatgggcacttaggttgactccatgtctttgctattgtgaataattctgtaatgaacatatacatgcatatatctttataatagaacaatttatattcatttgggtatatacccagtaatgggattgctgagtcaaatggtagttctgcttctaagactttgaggaattgccacactgtcttccacaatggttgaactagtttaccttcccaccaatagggtaaaagcattccttgttctccacaacctcaccagaatctcttgtatttttgactttttaataatagccattctgactgtgagatggtatttcattgtggttttgattaaatgcaattattttacgcatttggaggattaaccctgcccttaaaatccattgacccatagcattagaaagactttttgtgaaatttagtaatggcttaatttgtgtctagattagccagtgatggttgcaatggagaggaagtatgaaaaagaaaatcaacaaattctattaagctattgaaatgtgtcagaaattttgctaacccctccatgaattagctcatttaattccacgttaatcctatacagtcttattatgactcaagtttttagatgagcaaactgtatgccagagaggtgaagtaactttgcccacgttagcatacagtagagcacagggaacccaggcagtctaacgagagtttaaccactccagcatacagctcttgaaggaaactacagtagcttcagggaaaaaaaattatttttgcctaagatagttaaatcacagcaacaggggctgtggaaccaattgtctgaaagagtctataccacaggcttatttaggtaaccagtattcaaatcagaaagggctaaagacagagtgacttctggcattatgatgcaagaaaaacatagctacatgtgagtaaattgttaggcaaaaaaaagtaggatgggaacttatccttgaatctctgagacagacaaaggggtgtgtgtgtgtgtgtatgtacatatatgtatatgtatatataggtatgtaattataaatatatatatgtatcaatatatacataaatacatttatgtattcaggttatttgtttcctaacattcatttttgtgctaacattcattttgagaattttacattggggtgtatgtgtgtgtaaaagtatgtgttgagtgagcaagaaacttttgtgtatcatgggatatgtatctacgccatctgtagaatggcacagaatagtactgaaaaccaccaataccctaagagtggtgtgaggagggatgagtcagactgggagcagcatttcctaactgcccactcacaggcacattgccagaaggctttatttattctctaggttctagtcttcagattcataagaacagataatattaatttttataagaattagagtgattaactacaagactgtactctccagggactctgttttatttacccttgtttaccagcatctaatattctgcctggcataaagtcaagacctaataaatgtttgttgagggaatgagtaataaagttatataatgttttgtatttattagatcagttcctgttggcgaatcattgccctcctgggtcacggagaagctggcactcagattgtgttatgggatacttttagaaccaaggttctttgacccattagcaaacccacttcctggtatagtttttaggggtttatagagacataaattcagtaaacaagaagttattgagctctattatttgaacactatcagagggaactggggatggctcattgaacaagcaggccaaatccttgttctcatagagcttacattcttataagttaagcaacaaaataagtaaatgcgtaacatgaatgggtgataaaagctatgaaaaatcagggaaaggagaacgagtttgatggaggaatactatatagtgtcccctggggattgaattctccagggcctagaatcaatttaatgagaattttaagtgacattattaaattactttaaacacttcctttattaaattacattgataatttttcaaagatttcaactgcacccaaattataaagttcttgggaaactattttctactttatgtttagaattctgttcaatgagtggctggtgcgataaaaggatggcaacaatgatcaagaaaataaacttctagaggaaacaaggaacgaattataatagccaacatattttggatactttccctatgctggtcaaaactttatgttcattatcccagtttatcatcaaatgatttctgtgcaataggattattattatcttctttttatggcaaacaaggcacagtaagattctgtaagttgctcaacgtcacttagctagtaggtagaaaaatccaggattgaacccaggtggtctgatctagggccaaattatccccttgtaggattaagtaaactgcctccagaatccaagttttctaactgctaagatacactgcttctttaaaaagtataatgaagtaggagggcttaagtatttgagattattgattttttttaaacacaactgcaacccccaccatgaaaagatacagtattccacaaagacctttctattccttgaatactacattgaatttattccagcctttgtccagtcctctgtgcttgcaggtccctctgcctggaatgctccccactgggctcttcgcattgctgaccctttcccatcagtcaagcctcagctcaaatgcacctcttcagagatgccttccctgtctgcccaattcctggtagcccatcacccctcagtcactgtaatgatttaccctgtttttatgttcccagcccttatcactatgttaaaagttactgatgttccccatggctattttcccctactaatatgcaagtgccatgaggtgggtggcagtattcattgtaattggtccagagcctgatctctgcctgtacatcacagaggcttcaaaaacactgaagaaatgaatgctgtcccttgggtctgaagacccagatagatcccggggggctctacttctgtgcaggatcatgcatctgcccacattctgtgcagaattagagtacaagatgggaaaagagagatctgcaactggggcctgagaaatacttaccagtaagcacccaaattagccacaactgctcagaaacctaccacggagaccatctatgaaggctacttgcaggaggaccaatttgaaggcaacttctgcagttaagtatatgcaagttcatcatttcaattttatctgaatctgcttgttcatgtcttatttttagttcccaccttaatttggatctaatgcttgccatgattaatcaaccatttcctcccaccagaatgtaagatgagagcagagatccatctgtcctttacagtgctgtgtactcagtgtctagaagcatgctgaacacatagtaggtgctcaagtaatacttaataaagggaccaacaaatggcccaacactaaatttcctctgtagacaaaggcaagtggaagagcagaatgaaacatttattgagtcccttctaagccccaggcactgttttagatgttttacgtatcttatttcatttgttgaccctgttaagtggcaagctttgagagcctcacttataaaaagctaaaattcatggagtgaagatgcctttcttcttccatgccataaaatcaggtcttgctgggcaagtgggtttttaaatgaacattgggtatcactggaagcctcaaactctaatcagtttggtgaggtctatgctatgacctgataatgttgtttcaaataaataattattcaaataaataattttgtatgataccctagcatatctgaggatcaacagagaattgtaatgagagctttggccactgcctcacctataggatcacttccatttatcatctcagctctaatttatctgaatcaaagtttaaaacaatttccaaacagaagactagaaatactgcaaataaagtgaatttggaggaggctgttcccagcaggtacagaaagcttagcccaggtcagttagacagggacaaatgcaagctggcatagggtcatgcttgagattggactggagaaattgtaggagaaccagttcataataaatgactgtcccaaatcccccgccctgagctcaaaatactcaggcttggccctttacttagtgatgcttcaggggctcagtgtgagcaaacatgtaacatataccctggccctgaatgaccttgttaggtactccgtgtgaggaaggtagcacttacgagaacattcttgaaggtttaataacagcgaagtcttttcagctcattctgtgtgtaaatagggccaatttcaagaaaagatgagtttccttaaaaaaaaaaaaaaaactgtaaaataatagtgccattacacatacctccctcagccatttaaaaataccttgaggctggttctctcctgagggcttatcaagacacaagcctgccaagtgaaaggtagtcgattctttatagtgtatccttgaggtgttttcccctcttcacagagttactactcaggtcagcacattgttctaaggtattcccaggaatgtcagaaacagtcaaaccactttgcatgtaagtacagaggccaaaacaccactctggagtccacaggctggttcagtcctggtagtttacactaattctctgtgtggttttgggaagctcacccaagggttttgggttaaccgctctgcaagatggtgggcaggatctaaaaagggcttccatgtcacttccaactctggctgtctgactcgatgaggactgccaagggccagtgggtgccctcctctcctcacaggctgtagcagccatctagaaaatagctctgttcacaggcaagggagaaaattgacattgttcctttgcttctgagttcacctgtaagacccttccttcagcattctgcagctatgctctctccaactgagacttagagaattgggcattataaacagcaaatctaatccccttttctccaccatcattgttccctggtgctaagtccagagtttccataccctgaactagacatggaaggagggaggagactacgcaaagttcagtggtgccattttttttttaactttgtcatcctaggacaaagtttcttgaagtattacacttagagttttttccttagaaggcactggggtacttcctgaagacggtgattcttgggcttagctcaggatctactgattcagagctttaggggggctgtaagtccccagatcttcattttctttatttttattatttgctttttattcatttgtttaacccttttctaccatagcttcatggtgtctaacacctcagtgacaaagctttgttgatgacagtgtaatgcccaaccttgtttttactaacgctatttttagactctccctttcctttaatcacctagccttgcttccacctgaattgaccctcccttagctaagagagccagacagactccatcttggctctttcactggcagccccttcctcaaggatttaacttgtgcaagctgactcccagcacatccaagaatgcaattaactgataagatactgtggcgagctatatccgcagttcccaggaattcgtccgattgataacgcccaaatccccacgtctatcaccttgtaatagtcttaaagcccctgcacctggaactgtttactttcctgtaaccatttatccttttaactttttgcctactttacttctgtaaaattgttttaactagacccccccctcccctttctaaaccaaagtataaaagaaaatctagccccttcttcagggccgagagaactttgagcattagccgtctcttggctgccggctaaacaagcggactcaattcgtttccaagtgtggcgttttctataactcgctcaggtacaacaacagggtgggggattgctttgagatctcctaattaaaaatgccataggactacccagatttttggttactgagtacaaatcttcattttaagccaaatactgtagataattcttatttatggtagctaacatttggaaactactgtcctagaaaaaggtagacaaaaacttttagccttttgctgctactaaccatgatgattattcattcatccaacaaagatttatcattcactactatatgccaggtaaaataatgagcaaaaacacaaagtccctgttctcacggagccagcagtctagcaagagaaagaaatgataaacaaatacataatatgtcaagtagtaagaaaatctaggcagtgagatgaagggtgagtgatgggaggtgtgcttttcagacaaagtaggcaggaaggtttgtatgtaggatgattgtgcaaagacaaaagaagtaaggaaaagaaccatgtggctgagggaagagcattccagacggagggagccacaagtagaaaggccctggagaggggatgtacgtggtctgtttgaagaacagcaatgagtccagtgtggctggagtgaggtgagtgaagaggagttagaggagatcaggggctaataccttgtagcttgtttgcgttatttctaggctgcagaatactatacagtctggattgtggaacaatgatttgcagtgataatatattatacacctgttcttagtcttttgtccttatttatgctgtaactccctgttcctggctgaactcctgaagacaacctaaaataggtcttttgcttgagaattggggcaaagaataagaaagctttgggagggaggtgctatggactaaattgtgtccccctgcaaagtcatagtttgaagccccaacccccaatgtggctgcatttaataatagggccattaaggaggtaattatggttaaatgaggttattaggggtgggaccttaatctagcaggactggtggtgtttttgcaagaagagaaacgcagagaaaagaccacgtgaggactcagttgagaagacggtcgtcagcaagccaaggagagagaccctaggagaaaccagcctgctgggacctggatctgatactttcagcctccagaactgtgagaaaataaactactgttgtttaagccacccagactcgggcattttgatatggcagccttagcaaactaatacaggagggtaggaccaggaggtctttatttaattattcacctatttacttcctcagactttgctgcatgctcagtatgtgcaaggcactgtgctgcttctttgcatgcattattttatttaatctcacagcaatactgaagtaagctttatgaccatcaccttacagataaagaaacagaggcttacttaggggcagtcagttggccaggggacatgttggagcttttattcaaatgcaggactgtaacagtaaagcctgtgttttccctacatctcagaagcgggagaacagaggtgtggagccagcctacctgggtccaaatcccacctctcctgcttgctaactatgtgactttgggcaacttacttatctttctgggctttggtgtctgcatctgtaaaatggggacaataaatgctttcccttaactagactgtaattagcactaagtgagctaatacattaaaacattagaatagggctagccacctaaatgcttattaccaccctgaagtcacagggccctgcttgaaggaatttgaaatctttaggctgtacagagtatgaaaaccctcctcattctcatgttgagttttcatgtggaaagggcctcaggtttcttatttagtagttctaagaaatagatttcagtgcaatttaaagacttaggcatacttggcattgtccagaagtagaatggccaggtttgagagggagcaatctctctgttgctatctggtcaggaatgttgtgagggggttcagggcacctgtgaagggctggcatagatgaattcagaagtcttctcttgcatagaaattttataattctttctaatgggatgggaataggtgtgctacaagactggggcagctctgttttccttgcataatatattttctttctttcttttttgtttaaaaagtgaattgtgttgcctttagacagggcttgaactcacaaattcataacagccagtatcatgctttttttattttttaagcttctgcaggattttacatttggggttctgactcacatgcttaagcatcctgtcatctgggttgtaggacgatgaaaggattattaattaaggtagacatggcatcctaaccttggcttgtaagactgactgttggtcaactcccctgagagggctgccttgctgtttctataggaatatatgcagcagagcatatgcacaattctagatggaggctttgacacagcagctatatcttgctgaataaacatgatatgaaaacattcttagtggttctgtcctaagtctgcctttccttttcttccaaacatcatgcttttgcaagtggtctgcctggaagagcaaattcactcctatgcctggaatgtttactgctattccaaacagaacagaatgtgtttctgccactgcttattgagaataaaaaattctttgtctggatgtcaagacaataaacaggtgtccatgtttataaagcagttctattcagatacagtcacagatagacattcaggaatttgagggcatgcctagagccatttacaactctacataatgtaacagtaaggactgtttctagtgaccacttatctctgttttgtgtgtcccaccccttaaaatacattcatgtactgcataatgacattttggtcaataatcaaccacatatacgatggtgattccataagattttcaaattgtatttttactgaatcttttctatgtttagatatgtttaagtctggaaatacttaccattgtgttacaattgcccacagaattcaggactgtaacatgctgtacaggtttgtagcctaggagcaaaaggctataccatatagcctgggtatgtagtaggctctatgatctaggtttgtgtaagcacagactgtgtttccccagtgatgaaagtgcctaacatgcatttctcagaacatatttccatcattaagcgatgcatgactgagtgctaatctgctcttagctcttctaatgtattctcctcacagcagtcccaaaaatcttttcatgccgcaaatatgatatatatatatttttaaatgtacacccctcgataatttacagttgctctctgggttaagatgaaactttgtaatttatgttacagagacgtacagggtcacatcacttgatagcttcatctccactgtaccccatcttggtctctgtgctccagctacattggctttccctcagaatcttgctttcaccatgaccctctggggactgggccttgcaaatgtactctcctttgcctaaaatatcctctttctcatgcttcctagttaagtttgactcatccttcggatctcagctcaagtaacacttctttagggaagctctcctgatcttcgtgtgcataataaagcctcgttagatcttgtcctaatgtcatatcctctccactgctgcatttgtcacagtttacattaatttcttagattaatttatttgccttccataagagcaggaaccatatccatttttactacctgtgaacccatcacccagctgatatctgacacataatagagatgttctttatgtgtgtgtttgtattttttgaataaatgaataaataaatgaataattgctcttacaaggcagttgacagaatactgaatttgctcccaaaatttcccaaaaagtgacattctcgtgtatcaacaataagatccagagcaggctttcatacatatcttcgaagtcatacatttctttgcctcctgtttgctttttctactaactgtgcttttgcagacacttgtgaagataaaggccttggccctctcagcccatcttttctctcagctcaatctgccagtgaggaaacaatgactcagaaaactaatgagccagtccctctaatgatggcaatgatttcactgctggtgatttttctattagttttataaaattgagtgaaaatgaaggaattgccttggggcacaagaaccaaagacaaaaaatagatccagaaacacaaatcaaaagagcactgatcagtgtatgttacaggcaaacagtagtcaaggtgatgtaggttgaaagagtcaaagaatgaaaacaggagccggcattttcaactaaatatttcatatcactaatcctccctcactatttttacctgtaaaatgtggataataccatgcagacttaggataatcatcctcctgtgataacacagggagaatgcctggtgctcagttggtttttattaaacttgagtctgcgtcctccctctgctaagttccttatggattatactagaaactcctgcaaatgggttaccactcccagcttctgatttaatatgggaagatttaagatggggacatacttcccaaagcacatatcacttaatctgacaccaacaccaccaagtttcattatattgtcatttgactctgaggcatagcaggattagccaatttctcaagggacatcacatgtgaagaggactggaatctagatgaccctgaactgcaggcccagggttcttcctatcaccatgttgtatcaaaacacacaagcatagagagggatagggagagatttgttaaaggacacaaaattacagctggataggagggataagttccagtgttctataccactgtatgatgactatagttaacaataatgtcttagttacaaatatctgggaggagaatattaaacatttctaacacaaagagaggataagtgtttgagatgatgaatatgctaattaccctaatctggtcactgttcatggtaggtatcaaaacttcactacataccccatgaatatgtataattatttgtcaattttaaaaaaatttcttaaactccaccccccaaaatgtacacaggccaagaattgatttctgaggcctctactaatataaagagtattaataatagctaatttttattaagctcttaatttgcactgggtaatacactatatacttggtatgaatgatcacatttactcaccaaagcaattgtctgatatatgcaaaatttccccccctttttatagatgataaaattaaaggccaggaaataaaatgactttctgtgtattaggtagatgttttagccaatacctgaatataaactcttaaagcaaattcacagctaccttgaagcaaataagtgctcaacatagtttcactgaacacttaggtggatgacagtgaccttgattcttcccatggcagccacttttctgccagatatcagaagccttcaccaaaagtaacctcttttcagctgcagatctactgtcattttagagagattttctcccagagcccttcccttgtagtatatttctctatcctggccattgttgagttcttacctctgactgtacataagattcacttggggaagctagaaactgagattcctggggcccagttccaggggatttaattcaatagggctgtggtagagatagccctgtgtatttgccaaggtgattctcacgcatagccagggttaaaacctactgttagagttgtgtgcgtatgcatttttccctcctgctagactgtataccttaaagaatagatgagtgttttttatcttttaattacccatgtgctaagaacaatgcctgaaatgttgtaggcagtcttgtagggcagcaaagagcctggactctggagtcaggcagtatgggtgcataccctgatctatcacattttggctgggtggttttcaataggttactcagcctttctgtgtcttatctgctcacctgtaaaaaatgaaaatggggaaaatgaatagtacttatctcataatatttttgagagatagtaactgtgaagtacttagcacagggcctggtaagtaatgagcctacaataaatgctagctttgtaggtaagcaaaacatttaatggactatccttagttattgctgtggtgaatgcagtgggaaatatgaaagaagaatatgatgccccattcattgaatattcacaggcattatgctaggtgttttacaacactttttttcactctcataacaatactttgatatattttcattagagaaggaaatacaccagttgagtaatggaaggtcatccagcaggtaattacgagtgctgagattggaactcaggtttgtctagttttgaaacccatttcccctactttattactaagacttaatataaacattcactcatacattcgtgctttcaatccacaaatatttattatatgcttaatatgtgggagaaactgttctgcctactggagatatagaaatgtataaaacagagaaagcctttgctttcatgtcacttatattctatagtgggaaaggacaggcaaaaaacaagtaaatggatgtataacaggtcaggtaaaaataagggctgtgaaggaaaaataaatagggtaaaactagctgggggtgagaggagaggcagagagagagagaaatcgatcttgagagaaagggaatgagcatgtgtgtgtgtgtgtgtgtgtgtgagatattttacataggaaggccaggaaaggattctctggtgaagaaacatttgaatgatggatgtgataagacgcaattggattcctgatatttttaggaggtgaagcccaaaggatgtaccatagaattgtaagaatgatatgagagaaagaaggaaattgaggatggctccaatgtttttgtcgagtctctaggagaacagagttccctcttatttcctaggctggagaagaatactgcacaaacagggctttttttttaggagggaaatcaacaggtctgttttgagatctctactatgcatctgattggaaaggttggctaggaagttggatgtacaagtctgcattttaggtgagagattggagttggatatagaaattaaatcaatgatatataagcccataggagtggatgagatcacttacgagcaagtatatgttaaggagaagactgattcctgggcttcaatatttacagtttaggaagatgataaggaagcagcagggagtctgagactgcaagggagagggaaacagagagaaagagtgggttttgaggccaagacaagaaatcccttcaggaaggatggagcaatcatctgtcagtgttgctgagggctgcagtgggaagaggcctgcaaaggcatgactggactctgcaatgtggtggtcattgttgactctcacaagagcaattttggtggcatgatagaaagtgcaaatcagaggagaggtggtgacagtgagtgtggatgacactttcaaggcatttttctgaaaagaggagcaggtgatggggcagcgggtgaaggaagatacaggctcatgagatcagtgtttaaaatgagatgatttatagcatgtgtgtggactgcaaaacgtgatcctgtagagagaaaaaccttggtgctgacaaagtaggaacaagtgcaggagtgatgtgcttgagtaagagagaggggagatgacccagcttaaagtggaggcttggccttagatgaaagcagggataattcatgcattgtacataaaattcaaaaaatatgtttcagacataaagcaatatcaaacaatgtaaggtttttgtcttccttaattctcacaataactccttgagttgagcattactatttccatgttacagacaaatgccgtgtgcacttggaaaagactttaaatgtaggtgtgcatttataagatgagaatgatggatgagaaaatgagtagtcagggaaagctgtgggtggaggtgcatttgacgtgggctgtgaagagtgggttggttctaaatatgtgaaagggactgagaagagaatttcaaacacatgaaaaataagaatccataaatatgaaaaaggtacaaaatatagtagtaatgaacccattcttagcatgtaccctggaactagactgcatgggttctaatcctagcccttgcatttaacagctgtgtgaacttagactacttaacttgtctgtgactcggttttctcatggataaaatgaggataacagtgttgaccttatagaattgttagggataaacacacacacacacacacgcatccatacctacattgatatacacacggtgaaattgtgcctagcaaatagtatgcatcctatgttttacttattcttgtattattattatttataatataacaaagaattagaaaaatatgatgttatttttccctctgtgtgtgtgtgtgtagatttccagcaaacatgcttccgggtgtcactggaagatacttgctttaagatatgtcctcctcttgaaggagcattgttgatagaatatgggtcagtttgtttattcactctccccaccctcccattgagtccttcatttaagaaggatttcttgagcatctactcagagtcaagctctgcactaaaccgggatgccaagactgaagatgagtagggcagaattcctgtgcccaagtagcttctggccactcaggagacagacatgtaaatagactgtttcaatgtaatccaaaggctgttctcatactcagaaggaaatgtgcagtgtgatataaagattaagagtaccaatttcggattcagagagtttggacttgagtcttggctctaccacttcactagctgtggttctgaataggttgcgtctgagtcagtttcctcatctataacatggagacaatggcgtttaataagactgttgtgaggagtgaatgagatgggacaggcacagcccttagcacacagccagtggtccacagggttcatggtgctgaagctgcttcttatttcttctttccagtctccttgtggtttgtgtgactcataataacaacttcatttttggagttgttgaagacatcttcctagaaagacttgactcaagctgagttttcaagcatgggtagagaatagcagcatggaaatgagataaagacaatttcgggaaaggaagaagcacgtggcaagtcacagtacccttgtccctttaggaaaagaaagcgtccctactgatttcttagataacaataacaggccctccagtgcctggtgccaaattaggtccaccagaaagtaccaggcaaggttccttatacttcactgactctctcatttctgttttgcttcctttttttttttttttttttttttttttgagatggagtctcattctatcgcccaggctggagtgcagtagtgtgatctcggctcactgcaacctctgcctcccgggttcaagcaattctcctgcctcagcctcccaagtagctgggactacaggggcccaccaccacacccagcttgaatggcttctttacagctatgattggaattttgtttctccaattctgataccacttttgtagatgaatcctcccctaccaaggggaaggagttatgtgcttccttaatgaggtccacagagaaggaaagacagtccaatcctctttgcaaaaccctgattatggatctgcactatttggttgccctggcttctgtttgtatcttcttatttcaagttaaagaacattataataaaactagttccttaaagtatggttacagaaagctccccaagccacaatgatgaaaacaattttcatgcatgtaggagtgaatgcttttcagaatatttttcacatatggttttggaaatttatccatacaacagccttggtatttgtcatctttcattcaacaaaaatttactaagcacctataatgtgcctggtattgttctggttctggaggtacaacagttacatgtgggtcctgcttccagtacagcagggagacagagactaacaaaacagtcacattggtttgctcataatgacaaattagggtaagtgctttgaagtaagaaacccagttctttaaaagctgtgatcagctgagcatcaggatggcttctgagcttgagctgagagttgaaggttggaattaacaaggcaatggggcagaaggaaaagaaaagcagcccaaaagtctatggtggaagggagaattttgaggaaccaaagaaggcctgtgtgtctggggaccaggcaagatggagtatgtttgacctcaggcaggagagtcgggcggggctcagaatatgcaggccccgcttgccatggaaaccatagagaggttttaaatgtgagtgtttgtgttttagagtgtggggtggtaagataatcatatttttaaaaattattctgactgctacatggagaaccaaatctcctctaatgtatgaaaaagcaggcgtgagggctcagagtgagggaggggaagaaaaaggaaccaatagttgtgaaccacatattgttgatttaccctatatacaaatgtgttactatatataatgtgcttagataatgcctttgatacactaaatacaagtgaacgctggttattactattattattatcaccctgctatgtcattttgaatgtatttttttgcaactatcctgtggagtattgttacctatatttttaaatgaggaaactaagcctcagagaggttaaataagttctcaatatctctcatttgacatgtaacagagctaagattcaaaacctatggccttcctgcattaaaaaaaaaaaacacacgcgcacacaaaaaaagcaaacaaaacaaaacaaacaaacaaaaacaatgacaaggagaagttgggaagacaagccaagttttctaattaggatggttctatcccctaagaagcccagaaattgttgaagctcttaaattagttctagagtttctcttaaggagattgtttgggctatttgtatttatttgactttcacagagatattcacacactattcattctgcactttttcaaattaataaaatgtgaagttcacagccatattttttttctagcacagactacagggtgacacgattgccaacaatataaacacacacacacacacacacacacacaacctcagatgtatactgatcacttttttccccagacaaactttaagtaagtgtaaccagtttctggtggcaaagtgatgtgtttgaggaaaccactcattgcttaaggtaatgtgaaaaataaagcaaacttcaatatctaagaaaacacgtggggcatgggactcaaaaacagacggcacctatcatgtgtggagcattacaaagaactttattcagtggtaacagttcatctcaacatccttgttatagataaaactgggcatagagcaatcaagtgacctggcactgctttcttggtaccttggtacataacccatgtcttttccactatgtcccagagcctcctccacgatgttaatgtttggcaaatgccattttccttacccattgtctttattaggtttacaacaaatttaaatacatgcctttccaccctcccaccctgaaatctggtgatagtgggtgaagcagaaattgttttgacataagcaaaatgaggtttccattttaatgaaataaatcagtgaaatttaattttcacaaacaactttaaaagttcttgttgtagcaggtttttttctatatgatatagaatgtttcgtttaattaatacacaagacagcaactgagtagaccaagtgtttaaattttcaaagtctaagcaggcaggagaggacaggaggaccaatcagaaatacaaaagtcatctaggcagtttctctatggctttagatctttagtatttgaaaagttctcctggagattttagtccatgccattttttcattcctctcatcccctcaatatggataaggacttactaagtttttctccacgaggaagaaaagatttctcagtggaccatttccttttgccaccaataaatttttaaagggaaatgtccaactgtaaaaaaaaagtccatgagatatcaatgtctatgaaaaataccaccctcagtctcaattcaagggtgatcccaaatgtctactcccttccctgaaggtacggataaaaaattaccttatgatataatacaagcttccttcattataaacacacagcccccagtctcaggattctacctggaggatgaaaacaagagtgggttttcagaacaggctggtcgccagctcagttccaagagagtgtggctagacatgagttggagtcacaacacctcagcatcctcaacccttttcaatcaaatgccactagtaggacaatccttaagcctgaaaaatgtccagccagttgcttttcttgaaattgttctttttctaggatatgtcagatctaaaacacaggcacatcacatatagaaggtatacaaccagcttctgactatagaaatgtggaattctgcagtgcttagttgaaagggaattgccagaatgtttacaaggcacacatacacgtatgcatagcatgctaggttagaaggcagcagagaaggtccccagaaaaaaacaggaaatggggaaggtgtagaaggctcagcctaccctctctttaaagcattaacttaggacccccagaaaccacatttcatgtaagtgctgaaagtcagctgtgttcttactgctctgtaacccaagtacagactccaagtgaaccaatccaacaatcaacactccacagtgatgtactaagctaattctactttgctaattgctttcttgggcatgcaccaagttatcaaacagacagtgacaaaacagagagctcggacagatgtatgtggcagcacctactgatttttgttttcttgacactggttccaatgacttgtttgcatgttaaatgaaacaaggaaaattggcaaaatatttctgagttattttctaattagctgtgtcagctttgagattacctctgcaacattattctgttcttcagaaaacacttccctttccttgtacaagacagactgatttcagaagcagatctaagtctgttggatacaagcttttgccaggaatgacagtcacctagtagctacagaaagcagcatcagcagaacccgtgggaagtcagacaccagcccacttttcccacccacccagacactctccctctctggtctgtaccttctgtgtggcagctggaagaaaggatggtgttcggaggtctgaagatgtaaggcaggtaacgagagaagcatttcatcttccaaataaaaaataaaaatctaaataaaaaaacagtctcctgaatccataaggattctctcggccttttaagctggctacatcaccaatatgtttatgtaggttctttcccagatttgcaaagctggggtgcccgaggaataactggagatgggtcccattttgccatcagcgccaggaagcactgccttacatttctgcatgcagctcaaactcagaagcccccaagcaagccgggatatagcctcttcattggctgaagctcctctgaacaggatttgctgagtaagtcagtcctgcctgtaaacacacgctgaaatgctctgcctgaaacctctaccttttcccgtgtggtgagtttctcttttcgcaagagaaatccagcaggatat

SEQ ID NO: 2602 - DNA, 491967 bp, Homo sapiens; identical to SEQ ID NO: 2600

SEQ ID NO: 2603 - DNA, 466634 bp, Homo sapiens; identical to SEQ ID NO: 2601

SEQ ID NO: 2604 - DNA, 949 bp, Homo sapiens
catggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactga

SEQ ID NO: 2605 - DNA, 33621 bp, Homo sapiens; identical to SEQ ID NO: 767

SEQ ID NO: 2606 - DNA, 1748 bp, Homo sapiens; identical to SEQ ID NO: 768

SEQ ID NO: 2607 - DNA, 5459 bp, Homo sapiens; identical to SEQ ID NO: 769

SEQ ID NO: 2608 - DNA, 5459 bp, Homo sapiens; identical to SEQ ID NO: 769

SEQ ID NO: 2609 - DNA, 5459 bp, Homo sapiens; identical to SEQ ID NO: 769

SEQ ID NO: 2610 - DNA, 1748 bp, Homo sapiens; identical to SEQ ID NO: 768

SEQ ID NO: 2611 - DNA, 1748 bp, Homo sapiens; identical to SEQ ID NO: 768

SEQ ID NO: 2612 - DNA, 1748 bp, Homo sapiens; identical to SEQ ID NO: 768

SEQ ID NO: 2613 - DNA, 1748 bp, Homo sapiens; identical to SEQ ID NO: 768

SEQ ID NO: 2614 - DNA, 335094 bp, Homo sapiens
agcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtaagtgcccggccgggtgggggcggggggcgggggccgggggcgcagacgccagggcagcctgggcaggcctcggggcccgggaggccggaaccttggaggctgggcccagcccgggcctacggggagggggtgggggtcgcgttccggggaggggtgccgggtggggagctgggggtgggcagagaaggccctgccgggggtgcgttgctaccctttgggactcgccggcctgaagctcgggcccacgggggcctcctgggccacgggtgaggggggcagggcggcggggagggatgagggggcggcgttgaccgctccgggaggagcaggggtgccccttccgtgggcatgtggaagccagcccttcctccctcccggggcgtgagttggtgcccaggcactaggagggtatttcctctgacttcttcacctcccctcctccccgtcctccggagacttgcatcatcacttcctagattatatcccagtgccccatttgcttttaggaagctattcacacgtcacccgtttgtaaaaaccgagtccagaaccaggctggggtaaagttataagattgttgaggtctcaccttcatgtaaaacacgtttcaggagatatgtaaaatttccttgtcaaaaaggaagaaaaaaaccacacaaaacctgaagtcagcctggattggggaatatgagatccagtttcctcagttggctctcaaattctcctctttctcaatttaagtaaaaatgataaaaatgttgacagtgggtagcatatattgtttggccatcatgtgttaaggcgaaaaaaatgtgaggtgggaaatcagctcctcttcctccccccattactgtttaaattctcctggtaacactttaagcttcatggattgccacctaacaggtgcctccatcataccacatgactgtagttctgcagtaagaaagctggagactttgaaggctggcttttgtgatttgagtcccttttctcttttatcgttttgttttagttttattttttgagagattccgtatatttggagacatagaggcaggaaggaagattgtttctggtgaggacatcttgggaagaagtatggaagtagttttccctttgctatctcccatattgtaggaatggttaacagaaattaagagtaattttgggagtgcagagaaagattagaaagtggatcttaatgtagacttctgtggaagttgtcgtatctcaaggttatgacaaagaagtggattttcattttctcatttttctgcctttctcaaaaatttccctgtggaaggacattagtcaaaaataagttgtggcatataaaaagtcctaaaaatgtgaaaatatttctagtcttcccttcattttgatttgaaaataattggtttgcctgtgaagtgctttcatggactgtctaattcccacaagaatcttgcgaggtaggaaccattatctcattattagctggggaaactgaggctttgggtggataatttgccgcttcacacagggagtgtagggtggagctggtgagctctttagagtgcgtagtaccatcatgtttatggtatcagtctgctgccctggaaaaatcttgtgtcacaagcctcagattgtaactcattgtaagacatatgtcctaaagaaagtcgctgccagtggcagctaatgctcaggatgtatcaggtctctttcctggcaacacgtttatgtccttcggactgttaccatgaatggaatctttatcgaaagacttatatcaaggcttagaaactaaggaaatggaatagccttttacctttatttatttatttatttttgagtcggagccctgctctgttgcccaggctggagtgcagtggcgtgatctcgacttactgcagcctgcacctcccgggttcaagcagttctcctgcctcaacctcccaagtagctgagactgcaggtgcacaccactatgtccggctaatttttgtgttttttaggagagacgggattttgccatgttggctaaggtggtctcaaacttctgacctcaggtgatctgcctgccttggactcccaaagtgctgggattacaggcatgagccaccgcgcccggccagccttttacctttagccggtagggttctgataatgccaatagagtttggtggcagcagacaggaaaagttacactaatgttgtacttgacctataagcaaccagggcttctttttagatattttcagtctgatactttttatgaacttcagtttacctagcaggagtagtgaccacaaaactagtatttttatcgtgaaaagtgttctttttggtgcaatgttttaacctttcctaaggacgtttgtagacaattgtgtagtttgtattttataccaaagcatagcaacattgccgccttgtttccatcgtatcacaactgactttggacatgtttcccttactgtatgggccacattcatattttgttcactgagtaaacttagaatatatttaacagatatttgaatgcctgtgatataatggtgggcaaggaggtgctggccccatactctggggcagggggcacagggaagtaaactgacagttgcaatacgttgtacaggtgctctaggggaggggcacctaccctagctggggtggaggtagaggaaagtagcctggagaaagtgacactttagcctagacccacaggaagggtagaagtagagtatggaaacaaatattcctttcaggcagtgggactaacatgggtgaaggccgggatgtgagtgagagcactactcatttgaggaacaggtttgttgggtctgttgatagattgtgaagggggatcacaatctagagataagggggtctgttggtagattgtgaagggtgatcacaatctagagataaggctggggaattgagaggaattggtgatccagggccctcatagcattgtaatgctgaggactttggacttttatcctgagtgcagtgaggagctactcaagaactttgatcagggagtgatgtatatctttaatgtgaaagactattggtggttcttgagaatggcttgggtgtgtgggtatgactctgtgtgtctgtatgaatgtgatatacgtgtttccgtggaacgttgccaagtccagatttgccctgtggtggcgtgaaccagtgtaatgcctggggagaatagagcgaagtacatagaagtgaaagccattcaggaggtatcttttgccttttcccttcatgaaaatgaaggtgaatatgttttaaaaattttatgcagctttgcactccttggaagctctaggtctaaagtcagctagccagggcgcacacccagccctttgctgaggagcctctcagcagaatgttttggctccggcagactaacggcagttcctttaggattgctgctctttcgagtgacttaggctgcaggacttgctgcccagcattgcccagtcaggacactaatcagtgtggctcggttgaataggagagctttaactgcattctcttgtgagaatgcagttgaagaatgccaagaggagtgtacaattcaaatgcgttagtgcttgtaacacgtggttccagttctctccctcttggcttgtatggtataaattgtgtacaggtaattaagttattttatagaggccatctccactgggaaactttgctgccatggaaattgttgaatattaaccagttgatgataaagttgcaagttgtttgtattatatatgtatttttttgtatttttttttgggggggggtaggaagttttgctctcattactcaggctggagtgcaatggcgcaagcttggctcaccgcaacctctgcctcctgggttcaagtgattctcctgccccagcctcctgagtagctgggattacaggcacgtgccaccacacccagctaattttttatttttagtagagacgtgggagactgttatcgaactcccgacctcaggtgatcctcccgcctcggcttcccaaagtgctgggattaccggcgtgagccaccgcgcctggccggtatatattaacgtcatatttttaggattaaaacaaatttttcttggagacatggacttaaaactttaagtgaaatatgaacattttcttggctcattttaggcatttagtactcaggcaaaaaacgtatttgttgataattgttgtatctgaaatgaaatagtcaattagtacactttctttagatgaaatatacacatacacgaaaacacttttaaactatacagatataagtggtattagttgaagctgtattttaaattatttagacatttaaaaagtgctgaggtgtgtagattcttcacaaatgtgaagacctagaatattacagaaaagataggaagaaaaataagtataagaatatagtatgtgtattataggataatagggtaattaggatggaagatggaattgttttctaattctatttaagtacagaaatataattactattgatattttgcttttacaattggagataatctcgtgatgacatatggaaaccttgggaattactattttgtaaataagcttaaagcgtactagacataaatgttcagtctggtatttagagaataatggaatagttaaatatggggcttattaggtaaattattcattgttttgattttaaaaaagaagctcttctaacaagtcatgacaaagcaaatatcatatgggttcattttctttagggaaatagattttgttagtatttcatttttataatcattgctgttgaagcattttgcctacaaactaaattggctggataaaagatgtactttaagatagggatgggtagagataaggataggggtaatctcctaaaataaatttcatttctgaaatcggtaataatagaaagttgattgaaaacataacatgatttgttttattccactttatttttggcaatcataagatactgactagtttagaatcaatgtatatattttttccctctgagcccaggcttagtgaattgctgtcaaacatcacctttgttactgtcactgtgtagatcatctagctagtgtgcttggctcctcatagtgtgtggacttcacactcattttgcctcttcagtctcagtctcccaattgtaacatgttgccacactttaaccagcttaacttgggctttcaagatcatgtgaacacagtatgaattactaatcagtagaatgttcgttccattgatgtcactacttatcccttgattataaaacccccttaaacattctattaaaaaacaaaatgcttgcttgtggagttttactttgcatctttgagtattgtgtgcatctgaagataaaacatgatttaaattaagtattcactgtcggttcatttatctgcttgccctattttcctcattacatttgggggattcagaaaataggaaactcgtccctttgatgtgatggaacacagggaaataatttttttttttaatttaaagaaacatagtcttctttctattggtttgaggcaatagctttttagagttaggtccagttagcatatggctcttttggttttatcatcttctcttctccatttaccgtctcccactcttccaaaatagaagagaattctaaactttaaatcatactgaaaagttttgactaaaaatctctttataatccttaatggtatcaaaattaacattagttttcacaaattaacctttccttgctctaaaaatcagagaactaagaaggctttgaaaagaataaagtccttaaaaagaaaccaagaacagtatataaaagattatttatttagaacagaatacttagagggtgagaactaatatcatttggattttttattaggtcatagggaggttctgtccatgcaaagtgatgtagtattttgaattcttgcaataatcacagattaaaattgaggttaaatattgttgttttctttttcacccaggcctgggactggcaggctgcatggctttgtggctgaggctggaagcagagcctatcaaagtcccctctcttgcaaaaaaaaaagaaattcttttctgtttttgaagaaaggttaaggttgatatctcagcaaagctacttgaaggaagtgattggtcttgacccagcacttgtaatgcagtacttacaaaatcatccagattctggctttttggatttcgtgggactttgtgtcagagtggttttcaaaagagggccttcattccaactgtgtggatgacactgatgttactcaatttttctagggtttctgaggaacagcgatcctgctctgggctgggtccctgtgtaacaagattacattgctgagtgagatatttaaacataagacatttcctgtaagtgtcatatgcagaaaaggaggttaaggaactttatttacagtgtcttggctggatgctgtggctggcggctgtaaacccagcactttgcgaggccaaggcgtgaggatcacttgaggtcaggagtttgagaccagcctgaacaacatggtgaaactccgtctgtaccaaaaataaaaaaattaactgaggtggtggcatgctcctgtagtctcagctacttgggaggctgaggcagtagattcgcttgaatccaggaggcagagattgtagtgagctgagattgtgccactgtactccagtctgggcaacacagtgagactccatctcaaaaaaaaaaaaaaagtgtctaataatcagaatctaaaactgtatcctagaatggcactgcccagtatggtggccattagctgtaagtaataatttaaattcagattaaagttaaaaatgtggtttctcagtcacagtagctacttttaagtactcactagctcagtaactagtgattaccctattgaggaacacagatatacaacattttcatccttcaagaaagttatgttggacagtgctgttctagaatgttgactgatgggcagccagaattttcaagcctgttttcttgtgggctctctagatccctttttttcttacattctgaacatgagggacttagctaatttagctctaaatttctttccggccctaacatagtttatttccactgggagaagcaatgctattgttaatccagattactgggatgtgttcctttggtcaggaatgggaattaacatttcagtaatgggaattataatgtagtctgtaatttgaaccttttttgaagtgttacttttgagtcagacattttagctcttttagcactgttaaactggcaacctcagcggcttgtacagggaggtattggtctaacaatcagtttctttttggttcaaagaatttttgaagctactcacctttttgaaagttgataggttgtagataggctctagttagcttttatgacttttgtggaggaaaaatatttgttttcacaaatgtaaatctcatggcagctttttatatgtgattagggataagtgcattggattttctggtaaattcaggttaccatatatagagaaaggtggggtatattggaatttccagcagtagtggacaaaaccaaactgatctgtgatgcacccaggctaatagaaataagtgaatgaaaatgcatgtcatccatgaggctgagggacagagctgcaacagtgccaggcacctgaagttttggctacagctattaactcgagggatgatgtactagctaactacatctgttcatttagctgtaccagatgtcccatatcataggcaagttcgaatttattagggcagaagaatgtcctgggagaggtcattgatgccacttgctaccgctctggccttggatggaagaggagggccaagccacaccagagcattttgtttccaggttgtggataagctctagttagctttattgatactttagtcattacctggcagagtgaggttggtgatgtacttaggacctttttgggagtgtcttttctcatttatttctgctgaagtagagtggtgtggaggaacagctgttgatgtatctgcttcttggactcttacacactgataagttgaagtgcagttgcataaaataatcacactcacagccacacttcctggaaggagaaacattctgaccgttcaagaatatcacaaacactcttcctgtagtcagcttctttgtccaggcacttggttttattcatttattttttacaagaaagtaaaaaaaaatttctgtggcttatggtacctaactggaagagtggaggcaggaagttgaggaacacagagtgggtggtgggctttgctgtcagttctgtgctttgaaagcttttatctatttcagatcataattttttaatggcagccctttctaggatgctttcggcagaaaaatgtactggcaaaatcgtctcctgaaaagatttacgatgagacacataaagtacattgagtagtatagttattcttaaactagtcataagagtattaactagcaataaataataaaaaataaaccagaggtaggagaaggtatggtgatttcaatgtgagttgcttttggatttatgatttcttggtttctgtgcctaaggaggcatggatggtattattttcttttcttttttttttgagacggagtctcgctgtgtcgcccaggctggagtgcagtggcgccatcttggctcactgcaacctctgcctcccggattcaagccgatttcttctgcctcagcctcccgagtagctgggactacaggtgcctgccaccacacccggctaattttttgtatttttagtagagacggggtttcaccgtgttagccaggatggtctcaatctccttacctcgtgatccgcccgcctcggcctcccaaagtgctgggattacaggcatgagccactatgcccggcctggatggtattattctttttcttcagttgctgctgaaatctaaaaaaaccaggtttttcaagtccttatgtgttcgtgtgtgaaactttgcttgtacatacaaaatttttacattgtttaactttactgcatgcagtttagtttgccttttccttttaatataacttaaaggtattctcttacgaagtggagaactgttctgtggactgatcagcagtgggtttgagcctgtaaatcgccactgcactccagcctgggtaacataatgaggctttgttgctttaaaaaaaaaaaaagtggaggatgccagacttggtggctcatgcctgtaatcccagcactttgggtggctgaggtgggcagatcacctgaggtcaggagttcgagaccagcctggacaacatggtaaaaccccatctctactgaaaatacagaaattagctgggcttaatggcctgcgcctgtaatcccagctactcgggaagctgaagcaggcgaatcacttgaatcaggaggtggaggttgcagtgagccaagattgcactactgcactccagcctgggcaatagagtgagactccggctcgaaaaatgaaatgaaataaaataaaataaatggagaagtgtttttgtatattgacccacaaaaatacttgcatgtagaaacttttaattttttttattgatttgggaggacatgttcatgtagtctctgaggcctgagttccctgtttctgtggatcagtcactgttaactagctcaccctgttcccccaacctcacccatgctgtagcacttccaatatgtgcttaaaaccgtgcattttatttgtaaggctgatgatcttcttcagggaatattgagcaggatctattaaggaacagttgctttgacttaaatgaaaaagtctttgcaactgacagataaaatcttgagtgaaaatgtgtggagtactgcactcttgtatagtaggatctctttaggggatctcaaaaatcctgatctgtggaagtgtatgtccctacaaactgcattttcttacccttggttttaaactttctaggattatatattctaatatgatagttgaaagccaccaaatttacctaaatagttttcattctaaataaattagatttttacattgtgtgtgtttttggttggagttagggacaggaagagtagactgttggttttgtgtttaaagttgcggtgcagaaaagtcattggacagagatctgtgtaatttggaggtgagttggaagggaaaggacacagaaggtggtcaaaggggaagactggggcaagggggatgaggatggggacacacagaggaaagtagaatggtgggattataattgggaatgaagttgctttgtggccaccatcgtttagtcaaactgtgagaggtggtctcatctgtaaggctagagtaattaatgtgaaaaggtggtggttagggtgaatgagatgttctgtcttttcttgaagtgtggtatgtgagtcccctgggaccttacaggaaagtgctaatgatcacaggatgacagctgagatacagattccaaactaaagtttagtggaaatagcagcagctttcagcaaaattggtgttccatcattttagaaacccacgggctcttctgctaagaccatagataccttcttagccagttaaagaaaaatgcttcatggtttctctttgcagcaggccatggagactcaacctacctttcttttattgatattgccacaacctattaattccattccttgggattgatttttcttctctcctctttcccccatgcctggtggggaattcaacagtcttgcccatcgtctgtttaacttgctcttcttagaaaaacaactcacacaagcccttcttttttaaaagattttacagtgaatacatatggggaagttacattagatcttaaagaatttaacagtagtatttcctggggaatgggaccttttcttatttgctgagaggctgatgaagggccccctttctcgtctatcccaaactcctccaaaactccgaagatgaagggcatactgatctcttatctccagaaaaccagctgaaccaagtggctaggcatgggttttggaatcaaagatctggattggaatcaaagacgtgagtttacctctgtgtctctttatctttaaaaaaatagtatcttagagttggctttgagatttaatgagctctgatgcctctcaagcccttgccacagagcctggtcatggtaattacatttattaaaggccagcttcccaacttgaaagaaggagcactgatggcagattagtaaatacagaactatcttacctcatatgggaaatttgcatttatagtgatctccagactgatgccaccttattaattggtgaagtttctgaccagcttttggcccctttggccattttccagagccagtcctttttccagcaagtgttaagcactctattgtgtgtcttgagctatgctaggcaagagataccttggtctggcttctgccctgagaaagctcacggtctagaaggggagatggatcaataaactgacaaaacagtgttcgagaagtgctctgggagatcactgagtattgtgagaactctaatgggcagcttacctagatgggaactgagggcggccaggagagcttctcatgagttaggtttgagctagatatgaaagacgagcagaagttaaccacatgaagatggtaaggaggggatttctgggcagagggaacagcatgtacagagaggcacagaggaatgggaaagtgtgctgaattaagagaggtgcaaacacaagtccatatgttagctgcagtgtatggcaggaggcaagacaaacctggggagatgagcaggggccagttatgaagatacttcattgctgcactgttgaacttaaggatcaggaagcaactgggaagcatttaaagattttaagcatggataacagatgatatttataatatgtttcaaaaaagttaatgtggaggatgcattggagtgtataggcagagagaccagttagagcaattaaacctttttggaccatggatccctttggcaatctggtgaagtcgtggaccccttctgagaataatgcataaaacaaaacacttgtaattacaaaggaaaccggttagcctgtggaccatgggagcctgtggaccctagataaagtaaccctgggagaaggcagcagtagggggctgaaaataattgtaggctggcagtggggagtgaagagggggcttaagtttaagagcagcgacagattggatggtggggagtggtggtaaaggagaagagaggcagcagggtctgacatggactgcaggatggaagatgatgtcaggtcacttgcggtgggtgtagaagttctttcacttacaaactctagatatgaaaggtcatttgtgaattcatctattcctaaatccaaagtgaaattggagaagcaactagtagtgccctctgtcagtggtatgcattgttttgtacagtaggaaaaagttcatgctttggaagttcttaagttgaagtgattcagtgaatttgtactagaagatggtaatgggtggtgagagagatgattagttttagacaggttaagtttacttactggtgaattatagacagcttataagacagtttcttgctttgctttgcttttctcttcccttccctccccctctcccctctctcctcgacagggtctcgctctgttgcccaggaggctagagtgcagtgacaggatcatagttcactgtagcctcgaactcctgggcttaagtgatccttctgcctgagcctctgaagtagctaggactacaggtgcatgccaccacacctgccaaattttaaagtttttcttttttttttgtagagatgggggtctgtctctgtttctcaagctggttttgaacctctggcctcaagtgatcctcccgtcttggcctcccaaaacattgggacgggcgtgatcccactactgatgagcacaggagttttgacctgctccatttctaacctgggccagttcactcctcctttggtaacctgatggtcctttgttcatggcaggtcaccatattgatgctgaatttagtgtggacacctgatcagcataatgcagtactgcccagaactcctgggctcaagcagtccacctcagcctcccaagtagctgtgactacaggcatgctaccattgtatctttttttatgtgaattttttattgaaatataaataatgaaaaatacatgaatcttcagtgtatagctaaatgaattttcacaaagtgaatatgcctgtgtaaccagaaatagctaacaagaaatagcatttccggcccccaagaatccctcttcctgtcctcttccagtaactgctcccttcctctctcaggggtaatcactatcccaacttgtaccatcacagattacttacaatttttttcttcttagatgtttttctactttttaattgaagtatgacttagtttactgcaaacatttcaagtgtgtactttggtagattaaaaaaaatagacttcatggccgggcacggtggctcacacctgtcatcccagtactttgggaggccgaggcaggcagatcacttgaggtcaggagttagagactagcctggccaacatagtgaaacctcgtctctactaaaaaatacaaaaattagctgggcgtggtggcgagcgtctgtagtcccagctacccgggaggctgaggcaggagaatcacttgaacctgggaggtggaggctgcagtgagccaagattgcgccactgcacttccagcctgggcgacagagtgacactgtctcaaaaaaaaaaaaaaaaaaaggacttcatttttgaaaaggagtttcaggtttacaacaaaatttactagaaggtaaaaagagagagttcccatataccctttaactgtctacacacacagcctcccctactatcgacatctcacattagtgtggaacattttatagaattgatgaacctacagtgacacatcattatcactcaaagcccatagtttgcagtgggattcactcttggtggtggtatattcagtggattttgacaatgtgtaatgaatctaccattataatgtcatatagaacatttcactgccgtaaaaaccctctctgctctgcctgttcatctctcccttctcttcaacctttggcaacaacttttcattgtctccctaattttggcttttccaaaatttcatattgttggaatcatacagtatgtagccttttcagattgacttcttttatatagtaataagcatttaagttccttccatgtcttttcatggcttgctagctcatttttagtgctgaataatattccagtgtctgaattatactacagtttatccacttacctactggaagacatcttgattgcttccaagttttggcaattatgaataaggctgctaggaacatctgtgtgcaggtttttgtgtggacataagttttcagctcatttggttacataccaaggaacacaactgctggatcatatgataagagtatgtttagttttgtaagaaactgcgaaactctaacaaatgattgtaccattttgcattcctatcagcagtgaatgagagttcctgttgctccatatccttgtcagcatttggtggtgttgaatgctgacactatatgatacatatgcatatatcattatgtatatataatgatatatgctcatatgcatatatcattatgcatatataatgatatatgctcatatatgcatatatcatgcatatataatgatatatgctcatatgcatatatcattatgatatatgtgtgtatgcatgtatgtttcaaaaaaaaaaactagatactaccagttttcaaaaatgattatatcggtttacattcataccaccagtatatgagagttccggttagtccacattttgtcaatagttgctgttgatggtcactttcattttggttgtataaagttattgcatttttcttttaatttatatttctctgatgactaacaaaatagagcatcttttttcattggccatttggctaaactttgttgtgaggtgcctgtttaagcattttgcttacgtttctattaggtcatctgcttttttctcattcatttgtaagaggtttttgttttgttgttggagatagagtctcaccactctctcccaggctggggtgcggtgacagagtcatggctcattgcagcctcagcctatgggctcaagtgatcttcctgcctcagcctcccatgtagctgggaccccaggtgtgtgccaccacactcagctaacttaaattttttgtagagacagggtttcaccatgttgcccaggctggtcttgaactcctgggctccagtgatcctcctgccccagcctcccaaagtgctgggattacaggcgtgagccaccatgcctggcctgtaagagtttttttttttttttttttaaatgtattctggatgagtccttttttagatagcatgtacatgtactgtatggttttgtattattttaaatccttttttaaaaaaattataaaatgagtgtatttgtgtggtaaaaaatttaaacacataaatgggtatattatgaaaaggatgtctccctcctagttttagtcccttactgggagaccatagccttagtcccacttagtcatggttatgttcttttgagtatgtttcctatgcatgtactgcatttgttcttttttttaacacaaatagcatacgacacactattccggaaccacctcagttttttcagttaacgtatcttggaattctttccaaatgagcatatacatttctagcatcctgtataataaatggcagaacagtattccagttaggtgcatgtaccagattttatgtaatcagtttatctagttccttcttgatgagtattattatgctacaaaagtagcatgaaatatgttgaattttagggcttatggacaatctaagtgtgaaaatgccttaggtgtctgaattaggagagaggatgagctagggctttatcatttagggtgacatgagtgtgtattgtcataactgaagccaagggagcaggtagagtcacataagaagtattgttagatcagtgattctctgtgggatagaaatggagttgtcagaatcacttcgggagtcttttctaaaaaacacattactcatgctttccctagccccagtttagtgggtccacgataaggtttggatagttcatccttgaccttttttctttcatctcttgaaaaagtgtcactttcttttgagacccagtggtatagagtgaaaagataactaaggatggaaccctgaggaacacaggtagaaaaagatgagtttggaaaggagttggatacactgagataggaggtaaatcaggtgagtataaggttagtgaaaccaaaggaggtgatatttcaatgaagaaatggcagtaggttcatgctgcaaagaatggtcaagttaagatgataattgagacatctctgctccttgaaggtcctagaagaacttgagtaatgcttttaaagtcatgttagtgcctctcagcagtattctggcccagcatggtaccagggtatgttttgtgaaaaattgttgtaattacatcctatgtgtaccagaaatgaacatctttcattaatcattcatgaatctaaccatcatgaattgaaacttctcttgaatctatattttcacttctattaacacttccaataatatatatgtttttagggtaattttttaaaaaactcttgaacttcaacttcttagtcttctaggttctggcagacaagattgcgttcacctcatttgtcttgatatttgacttaattttatagacctaaccatctctctcagcttttgtttttctaggaagaagtcccttttatttagtctggacttcgattcctataaatatttagatgtcttttctgaagtctttccaattgtatgttatgtctttttgaagtgcatctgtgttgctgaaaagatactaatactcagattccatgtctctccccctcccccgtataggttgagatgtcatagaaagaaggcgttcatgtgggagataatgaaatatatttcttaagaaaagctcagtatatatataggaaaaattaggtgaagtatgaggtaagatgaggggacagacttcttggctgatactggtttatgctattttattcatgacatgtgctgtatgtgtcaatatgacacaagaagaaaggacatattggaattattagaggagacagtgtgaggattaaggtcaagtagtttttttcagatattctaaaaatcttattttgctgtgtgtgattttctgtaaacattcttcagcgtattttgctatatgtaactgctctgttgttattttagggaattttaagcatttcagcattggaactgtgtaatcagagacaatgggtccttttaatgtatagatagtcctttttttttttttttgagatagaattttgctcttgttgcccaggctggagtgcaatggtgcaatcttggctcactgcaacctctgcctcccaggttgaagcgattctcctgcgtcagcctcccgagcagctgggattacaggcatgcgccaccacacccggctaacttttttgtatttttaatagagacagggtttctccatgttgtcaggctggtctcgaactcccgacctcagttgatccgcccacctcagcctcccaaagtgctgggattacaggcatgagccattacgcccggccgatagactcttattaaagaacaacatatatagagaacagcgtgtataccaatatgctaaatatacacaaaaatacactttgtttaaaattatattgatacaatttaaatagtgtcataaatattacggcaacttgatgttactttattttagaatatccctggaggccttcgaggttgaagctgttttgatttcacacccttctgttttaaaacatagggactgacagggagacccagggctgcaatctgggtggtgctacatttgtagacaaggacaacttgctgtattttaacccagaaacattagaaagtttgttcttgaacttctggctcagatttagatgcatctttgaagtgctgatatttggcttatctgaagctttgggattatcattttctagttatgaagggaatgaaagtgttcataacatttttgcaggtggaaggtaaagttgttgttttgttcctcaaatttttttttgcttaatttaaaaaatattgagatataattcacctaccataaatttcatccttttggagtgtataactgtgtgtggtttttagtctcttcacaaagttatgcaaccatcactactgtcttaattccagacaatttcatcactttgtaattcaagacaatttcatcacttcataaagaaatctcatatccaatagcagtcacttctcccctcagctcctgctaaacatgaatctactttctggttctatggatttgccagttctggacatttcacataagtggaatcataccatatatgaccttttgtgtccggcttctttgacttagcataacgttttcaaggttcttccatgttgtagtgtacttcatgtctttttgtggctgtataatactccatgtggatataccacattttgtttatctgttcatcagctgatggataatgagttgtttcaggtttttggctattatgaataatactgctgtgaacatttgtttacaagtttttgtgtgaacacctgttttcacttctcttatttgaatacctaggaggggaatttcgggatgatatggtaactctgtttaacttttgagtaaactaccaccctgttttccagagcaactacattattttacattcccaccagcaatgtatgaagactccagtttcttcacatctttgccaatacttgtcattgctgctctttttgattatagccaaccctgtggcatctccattgtgttttgatttgcatttccttaatgactgatgatgttgagtatcattaaatatgcccattgaccatttgtgtatctactttggaacaatgtctgtttaaatattttgcatgttttaaaattgagttgtatgcctttttacttgtaagttgtaaaatttcttttttttttttgagacagagtcttactctgtcgcccaggctggagtgcagtggcgcgatctcagctcactgcaacctccgcctcccaggttcaagcgattctcctgcctcagcttcccgggtagctgggactacagacgcgtgccaccatgcctagctaattttttgtatttttagtagagacggggtttcaccgtgttagctgggatggtctcgatctcctgacctcaagtgatctgcctgccttggcctcccaaaatgctgggataacaggcgtgagccaccgtgcccggccagttatttttttattttttattttttgttgttgttgttttgtttttttttttgagatggagtctcgctctgtcgccaggctggagtgcagtggcgcgatctcagctctctgcaagctctgcctcccgggttcaagtgattctcctgcctcagcctcccgagtagctgggactacaggcgtgtgccattacacctgggtaatttttgtatttttagtagagacggggtgtcaccatgctggccaggatgacctcgatctcttgacctcgtgatccacctgcctccgcctcccaaagtgctgggattacaggcttgagccaccgcacccggccataagttgtaaaatttatgtattctggttactagttatttatcagatacaggatttgcaaatttttttcccattttgtaggtggtggtttcacgttttttggggatgtgtcctttagagcacaaaagttttaattttgatgaattcttatttatctttttgttgtttttgcttgtgcttttggtatatctgagaaaactttacctaattcaaggtcacaaatatttacactatgttttctctaatagttttacagttttagctcttattttacatttaagttggttatctatttttttttttgagatggagtttcgctcttgttgcccaagctggagtgcagtggcgcgatctcggctcagtgcaacctctgccttctgggttcaagcgattctcctgcctcagcccccaaaatagctgggcctacagggacccaccaccttgcctggctaattttttgtatttttggtagagatggggtttcaccatgttgctcaggctggtcttgaactcttgagctcaagcaatccgcctgcttcaggctcccaaagtgctgggattacagacatgcgccaccgcgcctggccaattttatttcattaatttctgtctttatgccaatgtcacactgtcttgagtacttcctttgtaataggttttgaaaccaggaattgtgtgacttctacaatttcattcttctttatcaagcatgttttggctgttttgggtcctttgaaattacatatgaatttcatcagcttgtcagcttgtcagcttgatcagcttgtcagcttctgcaaaaaagccagcttggagtttggtaggggttgcattgcatctccagatgaatttggggaatgtctccatattaacaatatttagtcttcctatccttgaacatgggatatattttcatttatctgtcttcagttctttcaacaacattttgtagttttcactgtacaatgatctggtcttttgctttccaaaaccagaaactcttttttaagttgaaggtttcttaagacttttggggaggcagttctgctaaacaaacagaaaagagaacatttggttagaaaaaacagagataacaggaagattaattattttaataataaagcaaggaaccaatttattaaaattttttagaatatgctttgtaaccataatgcttgaatctgttatacatttgtctcagactggaagttcccctttgtgacttcaagatacttgagaaacaatcagtaatcagttaatgggttgctgggttatagaaaaatcaacacagaggaaatttagagatcttgagtaaatatttcactttagttatgaaagagggtaatgaatgaaagagggtattttaagaagggtttccgaataagtttcagttctttgagtaataactttatggaaagagagactatttctctagtgtctgattttctcctcccccataacattttatcatgagaaatcaagaattgtacatccatttatttactacctagattctgtaatattttgctttatttgctttccatccttctatccatctattaatcttattttttattttccaagtaaattgtagactcaatacatttacccttctgtacttcagcatgcatatcattaactagagtttaacatttgtttttaagtttttgttttgttttgttttgtttttgagatggagcctggctctgttgcccaggctggagtgcggtggcgcgaacttggctcactgcaagctctgcctcccgggttcacgccattcccctgcctcagcctcccgagtagctggggctacagggcctgccaccatgcccggctaatttttttgtatttttattagagacggggtttcactgtgttagccaggatggtctcgatctcctcaccttgtgatccaccagcctcggccccccaaagcgctgggattacaggcgtgagccaccgtgcccagcctgtttttaagttttgaagtacaatttatatacagtgaaaaatacatctctcaagcatagtattcagtgagttttgacaaatgcacatacctgtatgtcttagtttgggctactataacaaaatacttgggtaatttataaacagtgtaaatttattgctcatagttctggagggcaaggtcaaggtactggcagattcagtgtccgatgagggcccattccttataggcggcaccttgttgctgtgtccttatgtggcggaagggtctaaggtgctcccttcatcctcttttataaaggtactaattccattgatgagggcgatgccttaataacttagttacctcccagaagccccacttctttatactatcacattcggtattcggttccaacaaatgaattttggggaggacaccgacattgagactgtggtactctgtaacccaaacctttaccaggagatatactatgtaatgctactctcgctccagaaaggttcctcatgtcccttcctagtcaggctggtcccttctgctgtttctcgtaccctatcaggcagccatggtcctgatttttttccccatcatagattagttttgcctgttttgaaagtcgtataaatggagtcatatgctgtgtacattatatactctttgacacagtgtaatgtttttgatatttatcagtgttgtatgaataagtttgttcatctttattattgcatactttatatagtattatttcattgtataactatacaaccagtttctctattctcctgtttatatataccctaatttgctttttaaataataataatagtactataaaaatcacttatcagcaaacacccttacttgacatcaagaaaaggactagaatagattggaatttacttagataactttatattccatccttgctcttttagttgccttaattttatttttagagtttgggagataccctggccctatgagcatcccaatgttaaataatctcattcattatgttgtgatttctgctacaggatgatcttttaaatcttaatttctttctgggtgtggtggctcacgcctgtaatcccagcacattgggaggccgaggtgggtgggtcacttgaggtctggagtttgataccagcctggccaacatagcaaaaccccgtgtctactaaaaatacaaaaattagccaggcgtggtggtgtgtgcctgtaatcccagctgctcaggaggttgaggcacaagaattgcttgaacccaggaggcggaggttccagtgagctgagattgtgccactgcactccagcctgagcaacagagtgaaactgtttcacaaaaaaaaaaaaaaaaaatcttaatttcttaagcccactgtgccttgactattcaggtgattttgtttctttaagtgttcctggctgagtgtggtagctcatgcctgtaatcccagcactttgggaggctgaggcaggtggatcacgaggtaaggagattgagaccatcctggctaacacggtgaaaccccatctctactaaaaaatacaaaaaaattagctgggtgtggtggcgggcacctgtagtcccagctacttgggaggctgaggcgggagaatggcttgaacccgggaggcggagcttgcagagaaccgagatcgtgccactgcactccagcctgggtgacagagtgagactccgtctcaaaaaaaaaaaaaaatgtgttcctgtctttgcttgttatacagttttgtaaaatcctatctgtttctgtttctctgaagctgaaatcagatctgagagctaataggagaattttgttttgagaactatgcggtccacattattcctgtttagagaccagtgtttgcttaatggcttgggcctgtttttgcaattactcagcattttcctcactaaaaaacctttaatatactcaacaatcattggtaaatgagacctctttttcttttctagctgagacattgcatattcttttaacatttccaacactgatagttttctgtccttgtgtatccttgtagtttctaaaaaaaaaaaaagctaatttgaacatattctcaaagttaataaatactaacaaatgctgaatacaataagattattttttttctattgttttctttttttggggggacagagtctcactttgttgcccaggctggagtgcaatggtgtgatcttggctcactgtcacctccaccccttgggctcaattgatcctcccacctcagcttcctgagcagctgggaccacaagaccaccacgcctggctttttttctttttttcttttcttttttttgtgaagacagggttttgccagttgcccaggctggtcttgaactcttgggctccagtgatctgcccgcctcgacctcctaaagtgttgggattataggcgtgagccactgcacctggccaagattgattgattctttgtctgtctgtctttctgtctttccttgtctttctttccttctctgtctttcttgtctttctttcttgtcttgccctgtcgcccaggctggagtgcagtggcgcaatcttggctcactgcaagctccacctcccaggttcatgccattctcctgcctcaggctcccgagtagctgggactacaggcgcccgccaccacacccggctaattttttgtattcttagtagcgatggggtttcaccatgttagccaggatggtcttgacctcctgacctcatgatctgcccgccttggcctcccaaagggctgagataacaggcgtgagccactgcgcccggccagtttttttcttttctaagtgaaacagtgtttaggctattggtgtggtgaaaggcctgaaaactggagctgtggtctgctggctgaggttctgcttacttgttgcttctgaacaaaccactttaacacttagggtcttaaaaagcaattatcggctgggcgcggtggcttactcctgtaatcccagcactttgggaggccgacgtgggcggatcacgaagtcaggagatcgagaccagcctggctaacacggtgaaactccgtctctactaaaaaaaaaaaaaaatacaaaaaattagccaggcgttgtggcgggcgcctatagtcccagctacatgggaggctgaggcaagagaatggcatgaacccagaaggtggagcttgcagtgagccgagatcacgctactgcactccagcctgggcgacagagcaagactccgtctcaaaaaaaaaaaaaaaagcaattatcatctctcacagttgatgggctcagttggagactggcatagcatcacttctaccatattccgtggtcaaagcagttatggagcctgcccagattcaagagaaggagaactggactccatttctcaatgagaggagtagcacagagcttggggccatctttaatcttctactgatggtgtgactggcaagtggcaatcttgggaggcagacgtaactgaattacagacagcagtcatttttaggtgttataatgtgttatatacaccctccttatcactcacattttttttttgttttttaattttcttctgggttaaaatttaccatgcctaggcacagctccaaagtaaacctgtttcgttgtctttgttggcagaagggtaaacataaatgaaatttggttaggggaaaggtttttaatgatacagataagaaaataaactgtagaaaaatgtcagatttcctagccccttttcctcaaaggaagcatgtatagcttaatcttccaagaactaacttgttttattgctttttcgtactgtgagctgtggtaacttgcagcatttaggaaaatggtttttgaagcaggttgcatgtatcatcagtagagcagcgtatgccagtctctactccctcagagacttgctaggctggacttgtcccttccttgtactcagcgtccttggaacatactctcttagataaaatgtttgtaaagtgctttgggaaataatgatgaaatgggttgaaaccagcattgttcataattttcctaacttctgagcttaaagtgagccttagcttatccttcatgatgtttaccttttagaggtctaaagactaatggtacagtttttcttttcctggttagatttttaaaatgaaacattatttttggaattttagaacttgcactgccctgcatcctggaatttgtgaagtgaagtgttctctcatctctacctcagctcttagaattgctctgtgacccaggccctgattaaatacctgtacagcttttcctgatcccataggacactcatgttggcttttgcctgttcctgttatagccctgattcatcatttgtatatgtctgagttcattttaagctgtttgagggttgaggccatctcagtcatctttagttccaccacagtgccttacattatgctttgcttaaatgtattcaatgaaatatacttctaggtgcacaatattccactaagaacccaagccttagcagaaactagcaagtgctattaaaaagtgtggaaaattgagccaggtgcagctgtttggaaggcttagttaggcaagaggatcccttgagcacaggagtttaagtccaacctggagaacatagcaagacccttgtccctttaaaataaaagggaaaattatagtattaaagttatgaagaaagccatcgagcacctaataatggcagctgatatttctgtagcactatgtagtatacagaccctttcacataagttgaattgcacgctttgactactcttggacgttgcagatatttactccttaacagtaaagagtctggaacttgccgaagctcactcatctagaaagaggtggagctggaactcaaatctagtttgttagtatctgaggcaatcctataatttatacttgtgatttttttttttttgtttttttttttggaatggagtctcgctctgtcgcccaggctgaagtacagtggcgtgatctcggctcactgcaacctccgccgcccaggttcaagcaattctcctgccttagcctcccgagtagctgggactacaggcgcatgccaccatgcctggctaattttttgtagttttaatagagatggggtttcaccatgttagccaggatggtcttaatttcctgacctcgtgatctgcctgcctcagcctcccaaagtgctgggattacaggcttgagccactgtgcctggcgtatacttgtgatttttattcaggtaggttttgcatttgaagttacaaaatagattgaaagatgatagttgaattattggctttactaaaagaatgtttatttctggtgatatattaaccagagatttaatttgcaccagtttgatttatatcacccgttggcaatatactacatgtgaaagttactttttatgttttttatattttgagaattattttaaaatattagctcatgtaaggttatttgctcaagttaacaagtgcccccaaaaacctcatcaatcggccgggtgtggttgctcccgcctgtaatcccagcactatgggaggctgaggggggcggatcacgaggtcaggagatcgagaccatcctggccagcatggtgaaaccctgtctctactaaaaatacaaaaattagctgggtgtggtggcatttgcctgtaatcccagctacttgggaggctgagacatgagaatcgcttgaacccaggaggtagaggttgcagtgagccgagatcgcgccactgcactccagcttggcgacagagtgagactctgcagaatattagacaatcagagtactattgatacacagaaagtgttatgggtgattattttctctattctccataatatgatacataattggtaccattctagatacataggaaagaagttaatctgttacatgtaaaggatgccttgggaataggtcagtaaactgcctagagccagatctggccagtgaattcagaatttttttataagaatgatgttacgtttttaaagccttggaaaagtatttttgtgtgaaaattacatgaaattcaattcagtatgttcataaataaagttttattggaacacggtcatgctcatttacttatcattggtggttaattttgtgctacagtgacagaattgagtagttgtgacagagatgtagtggcctaaaagcgtaaaatacttacagaaaggtttgttaatttttctgccctagggcattagtgcctaattctgccttgtggaacctcaactgagaaagggctaagattaccagtgatgatcccttttagattgctgcagtcttctttatatttagtaggaaagtacagatatcattactgttttgagaactttatcctttctttactctttgtcacttggctttgacagttgcaacctggattgggcactcaagttttattttgttctaacatgctgagtttgactagtccattgtatttggcactttgaaaagtactttttaaaaatagcttacattgagatttgcttttgagaagctactaattggcagttccaaactggacagattgaggccaggtaaagcctgtaggtgcctgtcaggcagcggtgaagttaaaaatcacctgctgtcaacaccagggaattctgtaatcattttcatttttgaataaatggagaatcattagattcctggagctgcagcactgaatggggaaaatggttattctgcctatgtgcactatttcctttgtctctgtagcctcatcataagttactctttgctaacctctttctggctttggttaaaaattatttttctggtaagtttttaattaggaaatgcagaaatagagctgcttgagttgtcgtaacttaaactagccatgaaacttacaaactggagagagagctgtctcgcttagaatgtaactgagtttattgttgaagttatgtttaaaaagaaaaaacttgggagggttgtgtttgcgtctttatgtttttttcttcctcaaaatttttttttaacaatgtttggtgtctcgatgctggtagtctggtattataatgatgctgaagacaattatagacaggcataagagaattgttgagagagctgtcagcttctcctttaaacttctattttgtatggaactttttaaactttgatctagtttgacaagtgaagttctttaaacatcatgtttttctgtggaaggggaatttgaaataaaaaatcaactctaagatttgacagaagtcttaaggcttataagccaatagtgtcttctattattctggtaattatgataaactgctttgcaagttgagatgaattagtttggattctatattcctgctgctcatcaacgggggctgcagggggccagaaggttggagtgaagatggaggagaatgggagagacgggggaggaccatagacacactgcattctcaagcgagagctccccttttagagttgcattgttctattcaatttttctttttgactttttcccctctcttcttctttgggctatggggaggtaagtaattcataaacacctgtcttccccagatgaattgcgtcatataatagtttgtgcttgtgccattagtatttttattatttttcttcttattatttttgagacggagttttgcttttattgcccaggctggagtgcagtggcgtgatcttggctcactgcaacctctgcctcctgggttcaagtgattctcctgcgtcagcctcctgagtagctgggattacaggcacccaccactatgcctggctaattttttgtatttttagtagagacggggtttcaccatattgaccaggctggtctggaactcctgacgtcaggtgatccacctgcctcagcctcccaaagtgctgggattacaggcgtgagccacagcgcctggccttgatttttgtttaaaacttcactccttttaaaatgatatagagttgtgataatagatggaaaatgtcctaaagggcagcagatggacttcctagaacttgatttaagagcccttttgggaaggaatgttacggtcctgagtaagggatgagtgaggctctgtgggttctgccaccatctcccatcctttcctttagtttcacctaaatgtgattgctttctctgctgtactccttcctctgtgcttccttctgtctatccttgctgctgccaccactgcttgctgcgggtacctataaaatggctatgtggtatctcaacagcaagttgagcagtggaccattagtgagaacattccattcatcctgggcacagccctagtaggtttattactatagtaggaggtctgtcttgtagcccttgagtatcttatctgaattggaagctagagaagaataaaacgtagatgactgaaacataaccagaagcaggatggttttatttcagttgaagctctttagagccagtcaggagaggcattttggaagagatgaggtttttctatctgaggagggttagaatgggattaatagacctttaaaaactggaattgggagtgagaatcagttagtcaacaaatattctgctgtttactttgtgccagaaatgactctaggcactgggcatacggagaataagtcactgccctcatgtatcctgcatgaggatgacacgtctaatgggtaatagtcatgtcagtcagtgacagaccacaaatacgaaggtggtcctataagattatactactgtatttctactgtaccattgctatgtttagatacacaaataccactgtgtcacagtggccaacagaattcagtacagtaacgtgctggtttgtagcctagcagtgataggccataccacatagcctagttgtgtagtaggatatatcatcaaggtttttctaagtacactgtatggtgtttgcacaacaatgaaattacctaatgacatgtttttcagaacatattcccattgttaagcgatgcatgactatagttaacggaggcagcgatgggtcttgctatgttgccaaggctggtctctgactcctggcttgaaagcagtccttctgcctcagcctcctgagtagctgggattacaggtgtgagccactgcacctggccctttgactctttatacccactctgtttcccaccccattagtcaccaaattgattttcttggttttatctgtcttgtctctccctccttgccatcactgtcaccctaattcagtgagcctctgcttcctgcttggcctcttgcctcttttttttttttttcttttttgagacagtgtctcgcactgtcacccaggctggagtgcagcggtgtgacaggcacatgccaccatgcctgactaattttatcgttttcttttttttttttcaggtagagatggggtttcaccttgttgtccaggctggtctcgaactcctgacctcaggtgatccacctgccttggcctccttacgtgctgggattacaggtgtgagtcaccacgcccagccattgatctgttgcctcttactagagcttcttgttggattccagttttttcccactctattttattcatttgtggcctttggaaaatagatctgttcatttcatttacccaccaaaaaaggataagttcttactctttgaaataaaaatcaaactccttagtctgcctcctgaaataaaaatcaaattccttagtctgcctccaaactatcttgtttagcccagtctcccaccctttcccacatatactgtatttgagctacgtaaaactaattgttgttccctacttacagtattctctgaagatctcaaagtgttgttgcacagttatgaatggatttcataatgaccctgaatcctaaaatagaattatttttaaaatttttgttcaagaatgaaaggcagtatatgtatagaagtaaagatttctgtccaagagagttaaaattggaaaaaaataccttatatctaaggggacagattttcagccattaggaaaaattggctacttagagaagatactcaggtgcacagaaatttgaccagctattatagtgtaagttgcacattgcctgtttgagctccctcagtagctcaatttctgttgttgtttttgttaattaaagattgattctttaaaggcacagaaacaatagctgatacattgcagtaaagtgttcatcttaggcatataaaaataattttgatctaacttctaaagaattgttgttagccattctaattataatgtaggaatatcacagagcctactgtgaccagtgcttttgggcttagtttatattctagctgtaacaaaacccaaactaggctgtgcgactgtagcaagttatgtgacttaccaggaaatcagtttatttatctcataaagggagttggactaggtaagtggttctccatgggggtgaggaggatggatttgtcttccaagggagcatgtgacaatgtctggagatatttttgcttgtcactacttggtgggaagtggtgctaatggcatctattcagtagaggccaaggatactgctaaacatcctacagtgtacaggacatcctccacaacaaagaattacctggcagtgactcagtttttttgtctattcaaatctaacctgtacttgtttgcttgaagatttttctttttctgcctggctccataagtctacctaatcaaaaccatgcttctgtcctactttatccattgtggtgtctctatcacctcatgcacatatcttgccgtttccaaactccatgccttcttatttcttctctttttggaatgtatttctgccacctcttatatttacaacttctccagacataatttttgtgttcccttagcattttgtgttaatttagactaatcatagttctttagtttcacacattcttatgtgtatttcctttttcttttctttttttttttttttaaagacagagtcttgttctgttgcccaggctgcagtgcagtggcatgatctcggctcactgcaatctccacctcctgggttcaagcagttctcatgcctcagcctcccaagaagctgagatcacaggcgtgagccaccatgcccagcctttatgtatatttcttaaattttaagtttctcaaagggtgtccattccctgctgctaatattttcttcactatagatgtctttgtgagaaggtttggtacttttcaaaacctgttggtcttagaaagaagaaggtaagaattgtgaaaagctgattgcgactggtgcccttgtaggtcaataatgtctattttgatgtggcctgaatatttcacttcattttatatggtcggatgctccatgttaggattaaggggtaattaatagtaatgtatgtggaattcagtgtgagttgattcattcatctgattctgtatttaatatctaaatgggatcagtgacactggtaggatgggtgagagaagaaaattggctaaaattgcatcatggaagatcaggcttggatggggtgccataggtgggcctgaggggcaacatgagatcccaggagcacaaacttagaggggtgttgaaagataccaagacaaactgtctgctttaacattttgccaacagcccttctgagcctcaagaaaaaaaaaaaaaaaaaaaaaagaaggtggactcattcttgctctttggtggcatgaccctggatttcagaatctggaccagtaactcttactactagaattcagtaatactataaatatttttggggggttaacttaggaattttaatcatactcacaacattgtttttaagggaaaatgaattctgagttccaaacagttgaattacaaatggattatattctaaaagggaactgctgatatataaaatataatatggttttagtaaatgcattttgtttgcaagcctttgctcatgagcaatgtaataggtacagaagtaggaagaaaatactaaaacccctaagaatctaaactattttattaggcacctgaataaataagtagattgtataataattcttgattaccagtaaactatttcggggggaaaacactaatcttacaatgtctattgtattttctgattataataagaatgtatttttagtacagaaaactgaaacacataaaaatagggcttttgcctttttaaaaaattttttttttattttttagatggagtttcactcttgttgcccaggctggagtgcaatggtgctatcttggctcattgcaacctccgcctcctgggttcaagcgattctcctgcctcagcctcccgagtagctgggattataggcatgcaccaccacacctagctaattttgtatttttagtagagatggggtttttccatgttggtcaggctggtctcgaactcctgacctcaggtgatccgcctgcctcagcctcccaaagtgctgggattacaagcgtgatccactgcgcccggcttgcctttctttttagtggactaacccactctaggtctacaaggtaggaggaaaacaacagataaaacattttcatgaatgtcccatctttaggggagacatgaattcaggtgaaaagcatattattgatttaatttcacatgttttggacatttaaagacaaagttacagaactttatagctcaagtccctttactctttagagattgttggaggtggtgatggatccaggtccccaggttattataatgtattttaaagcctagagaaatgttactaatgattaaaacatttattgagcattttctgtttgcccggcactgttctaagagtgttatgtgtattaattatttcctttcttccttaagaactctatgagacaggtattagtaatatctttattttatagatgaggaaacaagtaccttatctgaaatcaggcaaccatgttttgattctagaactctctcttaactgtattatattttattaatgagactacataggctaaaatgcccccccccccctttttttttaagaagtaggctgacctgaaattgagtcacttaattatggttgtttcatgcttaacagaagctctgcagttatatatgtctttggtctgaaaagctaaagctaataagttagtaatgagtacagtctaggaagcaaaattattaccagttgaaaggttacaggagaaaaataataggtgttttttttttttttttttttttggtgaggcatttgggatcttgctggattatggtatggttgctcactaattacctcttctttttaatctctgggtgatcccctctgatatcaacaaatctttgctttctaaaaagcaaggtagcgctaagggagtcattttggattttgtggcaatttaatttttttttttttttttgagacagagtctcactctgttgcccaggctggagtacagtagtgccgtctcgtctcacggcagcctccacctcccaggttcaggcaattctcctgccttagcctcccgagtagctgggatgacaagagtgtgccaccatgcctggctaactcttttttttttttttttaagtagagatagcgtttcaccatgttggccaggctagtctcgaactcctgacctcaggtgatccacttgccttggcctcccaaagtgctgggattacaagcatgagccactgcgcctggcagcaattgaaatttgtgtccataatttagttcagggcaacacctccccgccccatattctttggcagaggtttgaaccccatattctttgacagaggtttgaacctaatgaaagagggaaggaatttagttttgatgttagagacttttttcttaccagggacacttgaatcaatatgttaaaatttgaagagaggagtgagtactctctctagtatcttttctttttggggggcaggtggtgggactgcattgatttaaccattgtgaaatctaggttccattttgaaaaagaagagcatatgtagaccttcatgtactttgcatatacacagtgtacttcgttggtgcctcagtctttaaggattaactaggaagaattttctttctgcatagaaactttataaaataacgacattgttaataattcaggcataatattacattatacctttcttgaatgctgacgttgcatacaagggtgatctgtaaacctccatcatttccttgctctcacttttagacctatttcctgacataaaaccttggtggtagttctggttttttttttttcttcttctttttttatttttgagacagggtctcactgtgtcgcccaggctggctggcatgcagtggtgctcaagtgatcctccagcctgtgcctcctgagtagctgggacaacaagcacaagccaccaggtctggctaatttttatatttttggtagagacccagtttcgccatgttgcccggccggtctcaaactcctgagctcaaagtgatctgccccactcggcctcccagattgctgggattacaggcatgagccactgtgcctggctggttctgtttcttctctagtcttacttctgtcaggctcacttacctgacttcatgtagaagcattcttcctggatccatgttattctcttttctgctaacctgatattctctttctagcagtgctagttacttgtttctttcagtattcagcatatatagcttttcgtgactgcttcagattacactcaaaattccacctgcacaatgaagcagataccacctacggacttccaccttcccttatttccccttccatttagtcaggggcaccctccactccacctgtgtatggtttgtatttactttaggttgtctttaagttctaaactcctcaaggcacaatttgattttgttctcttgatactgtgcctaatacctttgtatttcataaataataaaatatacatatttcttattttttatatacaataattttgtgaggatgtatttaataatgctaattaacaaagcaaatactgtacctaaaacaaaatgcatggttataattgtccgtttggttttttatttttattttttttgagagtgaaagtttattacaaatgaaagatttgacaaattattaaaaaagctgacaacccacataaacatcgcaaaatctagatgattaatattatttattgtttaactcttgacctttttttttttgagacaagatctcactctgttacccagactggagtgcagtgccgtgatcaaagctcactgcagcctgacctcttgggctcaagcaatcctcccacttcagcctccccaatagctgggaccactgacaaacgccaccatgtctggcctttttactttttgtagagatggggtttcaccatgtatagctgtcctttttatgtgtttgtgcaactatattagaaaatccagaataatggaatcataaaaatagcccacgttcagatatgctttataataatctgattaggataaatattatgtttatcaacacaattgtttatttgttaagaatgaaacactgtgctaaggctctgcagaaacatataacatgataaataccttgtattggggagacaaatgaagcgaatacaagtgagtctgaaaaacatggtactgtggaaacaatggtaagtaaacataccaggcaaactgtgtgggaataaaagtatctatttttaaagaaaaaaaaaattagaggcccagcaaatttcaaatactatttagcatggggcagtttttttggatttataaattggattgaatctcaaaaattcattgaaatgatgtgtgatttatggaacaaactaaacatatggagggtttgtagagtaaaggagtttcattttcagcagttgtagaagtcttgctgaggaggcgacttgtcgagcagcttgagattattatggatttttacagtaagagaaaattgtaggtaatagcctaatatggtctaatctcaactttaccagtccctgcctccataagagtataatagtttatgtgatggcttgaatgccagatgaccaggtccagtgtgtgtgagggtgtggtgagtgaacttgttggtatgtctagagaacttggtcagttgtatcagatagaccttttagggttatgaggaagagatgttaacttcaggaatgggcctttgagtgtacaatagtgtaggatagtgtctgtttattaattgtgcattcactctgggtcctcttccttcctagactaggagttagagtactcttggtggagagagcttagaatcacttggaaaactgtgtaaactctagtgacctgccctctctgtgccatagtgtttgtgagagggtctttttggatagtttgctaacattcctgtgtagttgcccttgttgagccaagtttgaccctaggtgtccagtcagtctatggcatcctttgctgggacaccaatagctggttcagcctggcacaatcagaatattagggttgtcttcactgatagacactggcaactttatgctggaagaacttcttgggacacttttcctggggaggggatggtagattgtaggtggtttgtagcaggtactaaggaccttcaagacttcaccagaatgccaacatgtggttgtaagaagggttatgcttgacgtgccgaaaggttagaataagattgaaaactagcattggagtaggctgtggagtaatagagctttgaaatcctttttgaggctttatgtgctttcaaagaggatggcttctggcagtggagagtagttttttccataaaacatttactttgcaaatatataacaaaagactgtttccacctatatgactgaaaaatggagcattgactataaaacacatcctgttatattttcctgatttgaacacaaaagacatgtattgctcatctaacactgtgtatttaatatttcctgcgtatgagtgaaacctgttaaacaaggtgaagaaaatctataaaaggttaagatgtttttaaaaacaatttttggggcagcgttttgaagaccagtgtgtttactccttgaggatttattaatgtttaattggctctttcgtgtttatagtgctctgctgcaaacaccttttttgattttaccagtagctgcactgccatttctttatactagaagagctagaagatttgctgccagggccagcattgtgcatgtcgtactttcatgcatgtattattattttaaaaaatcctgtgtctgtgggagcaggtcagctacatttctgatacacgtatgttttagccctggcttcaacaaggagcagcatgttgtgatgtaaagaactttgattttggagccagaaagcccaagttagcattttggctccaccacttgttagctttgttgccttgaataagacaacctctctttatttcaattccattacctgctttacaggattgttgaaaggatcaagtatgttaatgtatatactagtactttttagctgaacagagaaaatttatgtttagattctatccatctcattgattctttctattaaagacagatgatcctggcacacttttgcttaaattttatttcagtgttctgtgtttggcaatttggacttggcctgtaatatcttctgttgctgaaccctttcttctcttcatcgctcttccataccatctgtagctatgattgtctgtagttgtcaccagagactttgttgctctttaaatagtatattgtatgttacaaaatacataatttctacctaccaattttctgatcttatggtctattttcatatcttatggtcatgagctaaaaattaatgtttgcttattggggaggggcatgatagcagcaggctggagaccttcaggtgaggctttgatttcagtgataggtgaggattgaattcatgaatggcttgcaaatattgtgggactggccttgtacctcaatcagtttgtgtaacattttagaatgtagtagcttttctccattgtcatttgaattttgatgaataatgatttatttttctgtctttaaaaagggtttttttttttcctgagatagagtctagctctgttgcccaggctggagtgggttttttttttttttctttctttttttgagatagactcttgctcttgtcacccaggctggagtgcagtggcgtgatctcggctcactgcaaccaccacctcctgggtttgagtgattctcctgcctcagcctcctaagtggctgggattacaggagcctgccactacgcccagctaattttttttttttttttgtattttttagtagacgtggggtttcaccaggtctcgaactcctgacctcaggtgatccacccgcctcggcctcccaaagtgctgggattacaggcgtgaaccaccgtgccaggccaaaaagagttttttttttttttttttggaatgtacctgtaaacccaaaaggacctgaggtaagaagtggcagttttatggagtacttacatagtaaagaggaataatattataaaatattatggttttaaaatgcatggcctccagtagtttttgtggcttatattcagaagtttgacttaaaaagaaattccagaatttcaaaaatttgttagccataagtattttgtgactatgatgttaatgaatttgcactccccctgctggctgactttttaggaagacagtgagttaggaaaagcagaatcctaattcagacctgagaatatctgtcaaattttttattctctgtagaagtggctaaagttatagggggtatcattttgagtaagaaattgattgcattatgtctttcctcatttggacttgtttgcagtgatgtttagtgccaaggggatattcacttagttttttttttttttttttttaagtaggtttagattttagttaacactatataccatatatttactcttctctgtttgtgacggccacatcaggtacctttttcacccagtttttttttttcaaacagaacaacttgtaatttctgtgcctttatttgatcatttattcatttatgggatgtggcttagtttctgtaaagcactgataggtgttgaggtggatgtagaaggatgagatatggtactccatgaagccttaaagcttctctgctggaaatctgtaccatatgccagtgaaatgttaaataaaaatgagagcaatgtctagttaaatagcataaggccgggcgtggtggctcacacttgtaatcctagcacttgggagtcccaggcgggcaaatcacttggcaaggagttcaagaccagcctggccaacatggtgaaaccctgtttttactaaaaataaaaaaattagccaggcatggtggcacactcttataatctaagctacttgggaggctgaggcatgagaattgcttgagcctgggaggtggaggttgcagtgagccaagatcgtgccactgcactcctgcctgggcgacagagctaggctgtgtctcaaaaaataaaaataaaaaaatagcatgatgaaagtaaacagtttgatttcaaagatgagaaaggctatcatagtgttgtagataaagtgggtatcaagagtgactagaaaaggacactgaagaaatgatgtggtctaggtagacaggagcggggaggaaaaggacaggcattccaggctgaggggacaacatgataaaaaagacgagtaggaaattagtgtaatttattaagggtacagtgaaaaaagaactgtttcaggggctttacgtacttacttgatttgatcccagcattaatcttctggtgtggtatgagtgtctacatttcacaggtgaagaaagtaagacttacaggggttaaaactattatgaaatattatgaaagaattatgaaacttctaggttttcatcctccatatatctggctgcaaataagtctgtgctcctctagcaataacttcagagagagttggttagtaccacagagccttatgtattatgatgtgtggttttcacactccaaaatttacttagaaatacttctttttaagcattacatatggataactggagctttattctaatatttcactgtttttagagccttgtaagcttattgaactatttcaagtagaaatagaaaatatgttgtatgtgttttgctgctctgcatcataagcattttcttataatctttcccagtgttgtcactgatgcaaatggaataattgattcataacattctttcttattaagttgggctatgacttcagaattattttttaaaaatgtgctcaaagaggaaatagcctaagaaaattttattttttaagttatgttttgatttctgtttacttttttatatgtttactttttattgaattttttaatgttaaaaaatttaatttttaagttatattttgatttttgttgttttttaaccatatgtttactttttattgaatttattaatattgcaaagttcttgcactgccaaaccatgcctaagaattcaaagaaagaaatggtacagtagacggcctcattcacccatcatacagtatcttaaaacttgattcatgtacattttgatattttcatagtcttttaagaagttataacgagttggaatttaaatctgctgcaggggctgagcacagtggctcatggctataatcccagcaccttgggaggctgaggctggaggattgcttgagcccaggagttgagacctgggtgacatagtgagaccctatctttccaaaaaaaaaaaaaagaaaaagcaggcatggtggtgcttgcctataggctcagctactcaggaggttgaggtgggcgggctcacttgagctcactcaggaggcttgagctggggaggtcaaggctgcaatgagctgtgatcgtgccacaacactccagcctgggtgacagagcgagatcctgtctctaaaaaaaacaaaacaaaacaaaaaaaaaacaaagtgccctgggccttcagatgtctagcatagtatggtattacagaacatctccacgtattcatgtcagttcattcctcaataacataacccctaacaaaattttgctgggaaaaaaaaatgggtattttccagggaaaatatttgggccaacttccaactgattatttgttaacgtttttttttttctcagatgaagccttgtctaactaaaaatcccctatttcttatttaatcacccagcctccccttggcttgctcagctactcacccaaatccatcagaaggcaggcatcgagtaatggcaacactattgctgtggttggcaggtcttgtcaggagatactgtaaccttcctaggagtctgattcctgcgctgacactttgatcaagactgaactccaataggagaatgctcccacatcaggataagtttattcacctatttgctttatttactcttgccagaggcaagtctgcaactccctgcatttggcaaagggatttattagaaggaaacccacattccacatcaagtggtcacataccactttgaaatatttctattgaatcagatacaaaactagtaaattgccagactgtctcattaggtggaaagaaacttctgtaatcctgggtaggttcctcaagtcccttttaaggaccaaaaaccgcaattacttttgcaccaacctacaggtagtttaaactgtaattattaaaaacagaagtgctacatcacttgtctttcaccctgactcttcaaatgacaataaagacacaccaaaaggttgataatagaactagtgatttctttgatttttaatgatgacctgttttagtgttattgcttaacagttttaggtttcacaggtttttttttttttctttttcagtttaaccaaaatggtttctgaaacatattttcaaatgggtaagcagtcatggctttgattatagtatccacttaattaggaccaggcagtcagtcatctgttctgggagacaaaccagtccaggacaagtagcgtttggacaatatgccaaatcctgtcacatcacattgttgctctaaaatgggtggatggattgggttgatggcatacgctaagctccatgagggcagggattgtggctggactaagtctagtggcaattaaatagagctcaaattaaatagagcttttgctttgaggtctgaatccatctccatgatttgtcactagactagtgacaaacagtggctgggatagcatatgttgtttagacagcttttgcttgttctaaaagtttgaatgtgaattggggtttgcaactcaaaatttgtgtttaatatttgcaccttatgtttaatgaacataaagtttgtgtaggccatgtgaaaatcagagactgtatatttggctgaattgctctgtaatacatatattttatttgggagctctctgtattaccgaggaccaggatagagactcttactgtttctgacctgatcatttaagggcaggtttttgccaggttatgagactgatgcatcatgccttgaccagttaagattagtgacaatttaaattttctgcttttgatttaagtaaaaattcaaattaaatagagcttttgctttgagggctgaatccatctccataatttctttctacatgcacatgtgtagacaatttccctttatctgttcttacagataaacttctccataattgcacacttatctggggatctgagataagcaaaatgatggtttcttaattaaatatgagtactgtgcagtagtaaccataattctaaatgaggattatggatttttctggaagattcttttttcctgtggaacatgatgagaaatgtttaggagaggggacatagccatttttgtatgaagaccaattcaagaaaaaaatatatgtatgtgtgtgggtgtatatgtgtgtatatatgtatatatgtgtgtatgttcatatgtttatgtatgtttatatatgtggttatacacacacacacacacacacacacacacacacatgcacacatacacgcacactctcactctatatttattctttggtattcctgggggattgattccagaacctcctgtagataccaaatccgaggatgctcaagtccctgatgtaaatagcttaatatggctgggcgtggtggctcacatctgtaatcccagcactttgggaggccaaggcgggcagatcacttgaggtcaggagtttgagaccagcctggccaatatggtgaaaccatgtctttactaaaactacaaaatagctgggcatggtggcgggcacctataatctcagctactcaggaggctgaggcacgagaattgcttgaacctgggaggtggaggtttcagtgcgccgatagcgtgccactgcactccagcctgggagactgggtgacacttcgtctcaaaaaaaataaaaaataaaaactttagtatttccataaacttgcgtacatcatcctgtacgctttaaatcatctctagattgcttataatacctcatacaatgtaaatgttgtataaatagttgttgtattgttttgtttagggaataatgacaagaaaaaagatctgtacacgctcagtacaggtgcaatttctttttccgaatattttcaatctacagttggttgaatccatggatgcagaacccacattaaacagagagctgactgtatgtaaaatatggcacacacagatacacacgcacacacttgtctcttgaaattatgccttttaaactcagatcaaacaatatctgtcattgtacttaagccttatctctgaagaatttcccttttttgatgaaaagttagaaactacatattttacatgcattgcaacatctgtgactttgggttggggatgtggtttgaacagtttgggtggacaaaataaattgacttcagagttaagttgtagactcaggacacgaaggacagttgtgttatagcgtcacaggtgcagaggaagtcagaggcaagggagttgccatttggaatggagagctgggttaaataggagtaggtcacaaagagtgtggtccgtaggtaggttgcaagtcgaacggtaggtgcaaaagtgcaaaaacttctcttttccaactatgaaactaggagtggggctttcacccttcagtcttcctgcatctttagctgctttacttaatttctggtctgtgtgccctaatgccatatctctggtggcaactcctatctttttgcccctcactgctgtagagatggaggtctcactatattgtcccggctggtctcaaattcttggccttaaactatccttctgcctcctcctccgcctcccaaactgctagatgtgagctgccccaggctctgtagtggcaactcctaccttaacctggagatagtaggagctctgtttgtcccaggtggatagtaggagagttgattggaattgttcagctaaagggaagctttttaaaaaaagtatgttagaatgggattaggtgagattatcattcttttattttccagtcttttttgtttcttcctgaaattagatttgagggtggtattgtgaagttaggtggtttggtctatatatagtttgcccaatgttgttatatgatgtggtatttgagagaactctaaattatcttgataacccccacttctttttttcttagatgattaataagaatagaattaaattaaaagacagctttttaattttaaagacattattagactgtccaaacatgtctgaattcttagaattaaagggaagtttgaaattaaaatattggcttatccagaaagtagtcatgttaaggctgttttgttgactgcttgattaaaaattaggttacccagtggttttcacaggacactcccaaagattgttgaaaaagacattttgagtgtagaagtatctgagatactggtgcactgtacttggtgtagtgtattatccagtgacctttgaattttctgtgtcacttaaagaaaagaggttcttatttttacttcaatcactgtaaatgtcagtgagagatagctctgtggtcactgactttcaacagtggtaaggtcaggtaagaacttcacgaagccttttaggaatttgtctgtaaagggcactgtgttgtcatgaaacatacggactgctttactaaggacctgggatgctcacacagaaggcaactccatttgtggagaaggcttattttgtctgaattgtttaatgtcttgtctcagacagatgatgactcaaagtcaaatgttcacctttaggggacccaaaaggatacaaaagagaatgcatagtaatgattggcctataggcggttgagtggcaaagctagtttaaagaagaaaaatccttcctatctttttttgtagttctgtaagcattatttgaagaaacttggatttccctgtgtgctttaaagtgaagtgcatgttgtgcagtaaagaagcagatctaacctcattgtggaacttgcttgctgtggtgaatcacagaaggaatgatgtgaaggcaacatttatattttcgtgcgtgaaaaattcatatgaatcacagacagaaactcagaagtggccatgtcactctggtttctctgttaaggagctgtggtcctaagcttgctgctgacaggtagcgaattagaaatacatcttcaaattaccaatttttctgctgcatctgctgcattttagactagtaaagggaaggagcagaccaatgattatgccctttcctctctgtggcacccctatttaaggaaaggggatttgaggttgttgtatgggtccttaatgtgggtttaaaaatttttcattccacattagtggtacttgtccaattttttttgatcagctaatgaaatataataactgtttgcatattttactgcctattcgccatagttacctaaactagtggcattgctagaaaatgttgagaattgtcacaataagaaccagtactcagtctttgataaagttcccaaagtatgctttgtaggagggactaattgtccattgtgacatgaacctgaatattagagatagtgtactatagtgaaaaagtactttgggtgaaagactggattcttgccttggctttcttacttgagtatatgatttaatatttttgaccgagagttgctattataccaggggacaataacttcctccttttttctttttgtttcacatttaaacagggtggttgttaagaccagtgagagataaataagctaatgtaaatgttgacacctgctacttgaaagttaagaatgatgttaattgttaaatttttcttagatgtctttactagattgaaatttcctttaattcttaatttgatgagttttttccttcataaatgtgtattgacatgtgtcaaatgcttttactgcatcttttgaaatgatgatatggtttttcttctttattctgttaatggggcattccctgccctgtaggagtgatagttgaatagaaagaaaaacaaagaaatggtaatatctgttgtgattgagggttacaaaagatgcagtgggagtgtagagagaggagtaatgaaatcaacctgataaagttaggaaaactttcagagaaactggaacaagatggagctttggcatttgtgatagagggagggaggggagtggtatatcttgggcagaggacatggccattgtagtgggaatatggggtacatagtggagggtactacctagagatgtgactgtagcgcggggctggggttgtgaaaggagcattacatgctgtgttaaggtttctgtcttgtatgtggttataggaagccaaaaaccaagccaaagagttttgagaaagtgaggaatgtgatgagatttttgtgaaagatctctcctgcagtattatggtgtgggtgttgatgagttgttttaacaaccttacattcctgtgataaacgtcacttggtcatgatgaatcatttttaaatatattactagactccatttgttagtgcagtattttgttaaagatttttgcatacgtgctcatgttttctttgtcacaatttgatatgaggtgttatgcttgcctcaaaatcagttgttaaatattcgtctatttttctggaagtgttcaattgatgttagttattccttaaatgtttgagagaatttgccatttgaacctgtggtttggtttgtgtgaatattcgcatttgataacaaattcagttagtagagttagggctattaggattttttagtctatagtatgtcaattttgataagttatatttctcatggaatatgtccattttgcctaagttgtcagatttttttggcataaagttcattgtatcgttcatttaataatatatgtatggtctgtagtgattttgtctttatttatttattttttgagatggagtctcgctctatcatccaggctggagtgcagtggcacgatcttggctcactgctgcaacctccacctcccgagttcaagtgattctcctacctcagcctcccgagtagctgggattacaggcgcaccacgcctggctagtttctgtatttttagtagagatggggtttcaccatgttggccaggctggtctcgaactcctgacctcaggtgatccacgtacctgggcccccaaagtgctgggattacaggcgtcagccaccgtgcctggccgttattttgtctttcattcatgatattggttaatctgtatttatcaagtttgttaatttttttttttttttgagatagggtcttgctgtcacccaggcttaagtgcagtgatgtggtcatagctcactgtaacctccaactcctgggctcaggcaatcctcacacctcacactcctgagtagctgggactacaggcgcacaccattgtgcctggctattaaaaaaatttttttttgtagagttgggggtctcactttgttgcccaggctggcctcgaactcctggcctctagtgattctcctgccttgcctcacaaagtgctggtattatagatgtgagctactgcacccagtcttgattttgttaatcttaaaaaaaaaaaaaattaactcttgcctttgttcattttctctattgtttttgtttgccctgatgtttgcttttatttttctttctttccttctatgttgggtttaatttggtctttttctagtgtcttgagccagaatcttgggagattttataactttcttcttttcagatattggcatttaaagctatacatttttctctcagtactgctttagttgaattccacaaatttcggtacgttgtgtttttattttgattaaattcaaagcattttctgatttcatttgtgatttttttctttgaagtgtgttgttatttagaagtgtgttgttagctgggtgtggtggcacacgcctgtagtcccagctgtttgtgagcccgatgtgggaggattgcttgagcctacagtgagctgtgattgtgccattgtaccccagcctgggcgacagagcgagactgtctcaaaaaaaaaaaaaaaaaaaaaaaaaaagggcgggcacagtggttcatgcctgtaatcccagcactttgggaggccgaggcaggtggatcacctaaggtcagaagttcgagaccagcctggccaacgtggtgaaaccccgcctctactaaaaatacaaaaattagccaggcatggtggcacgcgccaatcccagctacttgggaagctgaggcaggagaattgcttgaacatgggaggtggaggttgcagtgagccaagatagcaccattgcactccagccttggcgacagagcaaggctctgtctcagaaaaaaaaaaaaaaaaaagagcacttaacatgaccttccactgtcttttggccttagttatttttttaactaagaaattagtaattcttttgtgaatgaatgagacagggtcttgttctattgctcaggctagagggcagtggtgcgattatagctcactgcagcctcaaacccctgggcttcagtgatctgcttcagcctcacaaatagctgggattacaggtgtgcaccaccactcctcgctataaatcagtaattcttatgattgttttcttatatgatttgtcatttttctctgttttagcagttttgtctttttcgttgttgaccatttgactatgatgtgcttaagtgtttttccttgtattttgtcctgcttatgtttcattgatctcctagaacctgtaaatttccatcttgtactccgtttgggaaaattttggtcattatttctccaaatatttttctctgccccattctctcttagttctgattatagaattccaattatacctattacatgtaggtttagacctttgatgttgtaatacacagtactcttcagttttcttattttttccctctgtgttgttcagattgaatagtatctattctaagtttactgactcttcctgtcatctttattttgtatccagtgaatgttcttattttggttattgtaatttttggtccagaatttgtgttcttttatggtttctgtttctttgctgaaatttcctattcatttattaagagactattttactctttaatccttgagcatagttatagtagctgctttaaaattcttgtctacaaagaaagactggggaactgtctcagactggtggagactgagaatatgtagcaactaaatgcagtgtggcatcttggattggatcctgggccagaataaagatattggtggattgattggcagaatttacataaggtttataaattccttgatagtattgtatcaacattaatttcttggtttctatagccatattagggttatttaagatactaacattagagaaaaccaagtgaaggtagcttaaaaaaatccttctctaattacacattcaggttatcatagtgttggtctgcatagatcaccttttctctttgagtatgggtcatgttttcctgtttctttaaatgtctagtaattttgaaatgcatcctagacattgtggacaatttattatagaaatactggtttctgttgtatacctccaaataatattaatttttgttttagcaggcatttcacttgaatggtctcaaaattgaaaccatctttcccaccaccatcagcagctaaattctttattcagtttttagtcttacctgggctgctgtagtctatcccatgcatgtatatttcatggatcagctggagatttgggccaagtttataggtagatttgaacctctccatttctggctttctccttttcttgatttccccctccactttccacctgatagaatcactctgaactctgtcatctggttcttcatctcagtaagacagtagtttctatctggattctattacctaacgtggcttacgtaggccttccctcaggcaaaaagccatttagaaaaacaaaaggaaactttctcaatgcaattcccattttccggtgcagactcacagtttctgcctggttttgattgctgttcagcgccttcaggtagttactttttatgttttgtccagagtttatggtttttacgtatggaacagtggggccagtaggaacatattcagttccacttctagtaatcttaggaagtatctcctggaagtggaacttgttttttgttaacctttttttgttgaaatatatcatacacacccgcagtagggaaatagaatattaccaaaacctcagaaacccctttcatttctcttcatgtcccttctcagtcattactcccacttgcctctccagagtaccactctcctactctggcaccatagattagttttgcttgttactgaaatttacgtaaatgatatcattcataggttttgctttttgtttggctttcatctttgtgtttatgaggttattctatgttgcatgtaatttgttcattctcattgctgggaagtatttcattgtgtgaatttactgtgattagtttatcccttctactgttgatgggcatttggattactttcagtctggagctattccacaaagtactgcttaaacattcttttacgtgtcttttggtatacatgtgtatgcatttctgcaaccttagtacatgctgccaaacagttggctaatgtggcagaacttaattgtttcattgcattaacaaacattgagtttttagcttttagaaaattggggccaggtgtggtggctcacgcctgtaatcccagcactttgggaggccgaggtgggtggatcacgaggtcaggagatcgagaccatcttggctaacacggtgaaacaccttctctacttaaaaacaaaaaaaaccccccaaaaaattagccaggcgcggtggcgggtgcctgtagtaccagctacttgggaggctgaggcaggagaatggtgtgaacccgggaggcgaagcttgcggtgagccgagatcacgccactgcattcagcctgggtgacagagcgagactccgtctcaaaaaaaaagaaagaaaattggaacctaaggagttaatgcagacacaattaatcattctttctgtgtgctaccccctagggtttggtcaataaatcggtatttttataatagaaggtaaacacagccctaattcatacataatcacttgtttgcttgcttgctagagcctgtcgaattttattgggatcatttatgcggttgtgattcttggatctatcgttgagagttgtatgaggtattttatatagttttatccgtcacataagttcttgctgacagtagtggacttaacagattgatggtccagggatatgtaaattgtctgttgacctaatttttagaagaaaagcagaatagtgaaggtcagctggaagatggaaaatgataacaaattgatcttcttagggagcatgtacaatataaggtgtgatgttttgtaacacagtagtttttctcagattggcacacttttctggaaagtgctatattttagcctttgtgggccacaagctctctgttgcagctactcacccctacattgtgaacacaaaagcagtttgtcataggtaatacataaacgaataaggaataaatgtgactgtgtcccagaaaaactttacactgaaattcgaatttcgtataattttcacgtctcagaataacatattttttttaaccacttgaaaatgtggaaaccatttgtattcatctgccagggctactgtaacaaagtgttgcaaactagatgtcttaagcaacagaaatttattgtctcatgattctttctgaaggctgtaagtctgaaatcaaggtttgttggcagggtttgttcctcttcaggcagtgaaggaaggatgttttccaggaccttcttcttggtttgtagatggccatcttctccctgtgtgttcacatcatctttcctctgtatgtatctgtctctgtgtactaatttccctttttggccggacgtggtggctcacgcctgtaatcccagcactttgggaggccaaagcaggcggatcacctgaggtcgggagttcgagaacagcctgatcaacacggagaaacctcgcgtctattaaaactacaaaattagctgggtgtggtggcgcatgcctgtaatcccagctactcaggaggctgaggcaggagaatcacttgaacccgggaggtgaggttgcagtgagccgagatcgtgccattgcactccagcctgggcaacaagagtgaaactccgtctcaaaaaaaaaaaaaaaaaaaaaaattcccttttttacaaggacaccagtcatattggattagggcccaccctaatgatctcattttaacttgattgcctctgtaagaccccatgtccaaataaggtcacatctgaagtattgcaggttaggtctccaacatatcttgtttttgttgccaggggtttagggtaggggagggacacaattcaacccataataccattctttctttttcgtttttgtagagatgaaggtctcgttttgttgcccaggctggtctcaaactctggactcaagcagtcctctcgcctcagcctcccaaagtgctggtattacaggtgtgagctactgtgcctggctctgtaacaccattcttagctgtggggctgaaaaatatggctaaagggctagactttatcagctggctgcactttgtcagcccttggcttatctgattgtaggagagatgatacctgtaaatcttacaaaggcctgtgtagatgtatctttgaatgagatggctaatcttgtgtacctttcaaatacaccagaagaacaataatcattttcatttttgaatgtgaaggacagcagtttatactgatgtacctgagtataggattatgtcttctcagacatttagaattcaggttcaaataccatttttgtgttatttttaattttaaaaataatagactcaccctggccccccaattggagatatttttgggagtggattggagttgcaatgtaataaaagaaggcttggaaagtgatttgaaatagttgtccagcattttgtagagatgcttttaaggattttataaacatttgatgaaagtgttattttagatgttattcaaaaaataaacttaattttagtacatgattaccaataatgcattagttgttgctgttctgttaattcatttttgtgaagatcttaaaagtaaatgatttttttttttggcctgctctacttaaagagcatcccagaactctgaggtgaactgtttaaaataaagataaatctgttatcagcaacttatgttcatgaacaagattttcttcgttgtcatctatatattagttcttgtttatgtaatagttaatttctgtatttttttttttttttaaatagagatgaagtctcattgtgttgtcaggctggtcttgctatgttgcccaggctggagtgcagtggggcaatcacagttcactgcagccttgacctctttcgctcaagtgatcctcccgcctcagcctcacaggtagctgggacttcaggcatgcacaaccatgcctggttaatttttgatttttttttttttttattggtaaagatgaaatcttactatgttgcccaggctggtctcaaacttctgggctcaagtgattttctctccttggcctcccaaagtgtggagattacaggcccagcagtaatttgctttataatatgtgaatgttttatatttgaacttaggagatatatttaccctaaaatcacttttttttctattttatattcacgttctttgcaaggtttaatttgaaagaaagttttactgtttgaaaatttggaaaattgctgattcagtatatgtaacaaattggaaaaggtgaagcaggaaataaaggaaattggttattttaaattgagttaatattctgatggggagggcacagcagaaatgaaatcagttcaaatttctgttccaagttttgttttcatttctttgacaacttttagaatcccgtaggcattgatttgtttctgccttcaacttcagtagatacaacttaattatttcctgttaagtagagttactggtagctcctgaaaaggtgagagaacttcttacctacgtgttagtggtaagtgaagtcatctcagtcagcattacggcaaagcaggtaagtctaaaaaggctttaaagtaaaggtactgcttgactgccaataaaatatagaagaaaatagagaaaagaaagagcccctactgttgtaaaggctgtatatttggaatatgttctcattgtaggagttcttgtatatattcatgtagttgaaatgatcagaggtaatgagatagttaattttatctctggtcagtctttcatatcaattcgtactctaagaatttgtaaagaatggctgacatggtgtgtgtcttagtctgtttgaaaggcaggggacattttggagtgtggttgaaagagcagtaagcctcttttgcatatattgataggaaaataatgtttataaccatgacccttttggcttgggacactcatctcatgatctttttgcctgtgagattaaaatacacgtacatataccttggctaattgaggttattttcgatgtttagttgtttttatgctattaaattcctttgctttgaagatattctttgtccactgtggagactctggaaatgcatcaattagttctatgcctgcaacaatcatttccttgagtgacacacagatcctaggttttaatctttgtgtatttatgcaagtactttatgtatatgaaaggagggctggagggttttgtataggtctttaattacacacacgtgcatgcgacatttttaaaatttatttcaccagtgggaatcaataaagtgggtgatttattgtttatcctgattatggacaaatcataccacttctttcttgggagcattgttttgttggtatttcttccacacttgtgagggaaaaaaagtccttagtgcagcattgtcatttcttatcctgtacatatttaatatgaacctcagattatcatggaaattgattgtttccttggtagctggttgtggagtgtttttgtttttgtttttgttttttaatttttccctgtaaagaattgaagggtatcagagaaaaaagcaggagtccagacgagataatggtggcttggattacagtagtaatagaggagatggtgagaagtagtcagtttggggctatgtttttgcaagccttgtgatagactggatgtgaggtgaaagaagaggagtcagagataatgcttaggtttctagtttagcactgagcaatccagtggatgatggtttcacttactgaggtgggaggatctactgtgtaaacataatttgttaagaactttacatgcttgatattgcttacttgtggcagggctgggattcaaacccagggaggctcacaacaaagctagtgttccaaacactacaaagtactatgtattaatagcttcttctgggaactactgatattgagaggagatgcggagagagaatgaagcaagagccaaaccagacaaagtcttggtcaagctaagaagtccgagttttattttaagtgaagcagacgctggaaggttttaagcagggaatgacttaatcagacttacacaatgcaaaaagatcaatctggctgctttcgtggagaacagattttagaaatgaggtaggaacaacagctgtatcagtccaggcaggagatgatggtggctagatggttggtgacagcagtagttggagagaagtaggcagattggaaacaaatttgcaatacagtgagagttgtgtgggaactcgtacaaatgtggacagcctgtgacactggagggaaagtatgatccgatccaatccaatccctatttgatttatggaggttctccacacagtcattagctcagcttgagtcactccaggagctcactgccattactatccgtgggacagtgggagagacagattgagggcagatcactggagtgatgaagggggcttgatgcagcactatgtgtgagccctatcctgaatgagtttggacagacagaggcaagccgaggtcaggccttgaacgccctgctgagtagagggttgtgttgtaggctccccagcgcttgatgtagctctgagaggtgaggcagggcttgatgtagctctgagaggtgaggcagggcttgatgtagctctgagaggtgaggcagggcctagatccctcccgcttggcatagccctgcccctgtgacctgaacaccccacagcagcaccctggggctgagcagctggggagtcccaccactggcagctacagcctcctcctctgctggccgaggcagtttgtcctgctggttgtgtagtttcttgaaactaggagaagtgaaacaacttcaagctgttagatttgggaattagtttagtttctggaaaggatttgtcctagcctagtctggttgatcagattttttagtggcaaggaagagacacttagtaatcacagggatggaatgagaggtaaacattttgtgtcatttattatataggcacccaatctccgtgttcctggtgaagttcttaagaagctaggaaagtgtctgtttctccaggacaggtcagctgctccaggtaacctttcccagccctgtgagttaattctagagctggattggattgattttagcattcttgtgccagggtcaaatatccttcttggtcacaactggagtcaggaatctcagaggaagagccccttatccccaacccgtatgtagttgagtattagccaaagtaaattgatttttcttcatccaaacccctgtgacatgtgtaactgttggttttatgttccttacaaagtataccttggagaaatcactgaagagtgggatagggtgagagaataggttgggaccaccatgctcagaactatctttgtatgtgatgggatgcttaatatcacttctttggtccagcaagaacaggtttctgctttacctctaattccaaatgcagaagttttttttgttttttgttttgttttttttttgtgggggagcgggtggtggtggtgcagggagtaggtaggggaagattggtgttagaaatggggggaattgcatggaaccatctttattattcttgatacccacatggacttgcatacttgggttagttatttcttgtggctgtgaaatggagttttctctctgtgtaactgacaaatatataggtatatctgtgtactagaacccaattaaatgagttaactgtaattaaaggtacttaaaaatgtgtgtttcttaaactttattttgcctgtatttggtgaatattttaaaagagtattcaagtaactgggatgaatgagcatgctttttctcaatctggatgatagtaaattcattattggtagaagatattatcctgcctgttatagaactttcagaatgtgagttagggtatgaaatactgaataacacttgaaaccagatatatctggtacttaattcttttgaactgaatactgcattattttcaggatagcatgaagatgttggcttggaacttttgaaggggctgcgttatagactctgcatggagacaaaccattagtactaaccacctggctgtattctaaggcttaaaagcaaaatctttatgtgtgatgttttgtatatttggcttaaaaaattcaccagcttttagaggttgtgagatatgggtcatttttgttcagataagagaggtcaataaagcatttactaacatgaaatgtttttcttttctcctttctcagtattaaaagaaaggtgaatggacaaaaagccaataaagggcttaattttaaaaatgtagcaacaaaaactcacactctggctgtcatggtacttgaagcttcatatttcaaaactgtattaacagctttagaaataaactttacagtagctgcatggtgtcaaccagtgcttttctcctttgctttatcctattgtgtcagcagggatgttgcagcaattctttttgatctaaaaattactttgttctggagctgaaaaagaaaaatgttctaatctcccactaaaattttacctgacagtgaggtcagtcaaacaatggaataacttgctaagggagttcagtgagaatctttcaccagagatgtcctgaagttgactagaatgagccagttggaatctgaagatcaagttggaaaagtcctccaggatgagataccccctctgaaccaaatttttaaaaaggagttaaaaagtgtgtattacaaggtttgagaaaacagtgcctatttattcagaacttagtttcaggtctgttttgtactttacaaaacatctttcatgaaggatatatttgataatggaaagtattttttttttaaagctgtatagttctgaatcacaaatgattgtgctatcgtgtatattctgaaaagttcgtgattaaatcacctactgttgtgtgctagcacctcataaaaaatactcttcaatgagatcacatggacacaggaaggggaatatcacactctggggactgtggtggggtcgggggaggggggagggatagcattgggagatatacctaatgatagatgacacgttggtgggtgcagcgcaccagcatggcacatgtatacatatgtaactaacctgcacaatgtgcacatgtaccctaaaacttagagtataaaaaaaaaaaaaaatactcttcaagggaaggctgattatgatagtctttatttttatttatttatgttttttgtttttttgagatggagtcttgctctattgcccaggctggagtgcagtggtgcaatctatacttactgcagcctccacctcccgggttcaagagattctcctgcctcagtctcccaagtagctgggaccacagctgcacgccacgatgcccagctaattttttatttaatctttttgtatttttagtagagatggggtttccgtatgttgaccagcctggtctcgaactcctggcctccagtgatctgcccaccttggcctcccaaagtgttgggattacaggcgtgagccactgtgcccagcctatgatagtctttaaattaaagacctagttgggtggctggcaagactgtcagtcattattaatgccagagatctggatttgatggtctgttctgtctttctgcttaggccagcaggaggtaggattgctgctggaggggaagctgttagctctggggcaggctaaatctttaatctctccacaggttcctctttcactaattagaaaagaaaacagctgggctgcaggagctttgctgttttcagatctccttagccaaaaagtacgagctatatagggttttgaacataacaatagagcactaaaaatacgaatttttagtctttgggaccttcatagagatttttgttccttgctccttagggtttgaaagaaaagttcagtgttgagagctggacttcagggataggggtaggcaagagtagagttgaatgctgtttgtatttagaatttcaacaattttagttaaaaaaaaaaacattcctttggatgctagtatatggtaagaagtacaacgaattcaaaaacattcctgtataatcacatgaagactataggtcagtggtgcagagctcagcatgtcgtctgtgtcatgacaattttgttcttttcacttcttaatagccaatttaattttgcagcaaaatgtgtccaatgttgaattttccaggttctctaaagtatgtctcgtgcaaagatagctctgacattagggtccttttcagtggtccagttgggtggccatgttgctggagtgggaggggagtgggatttaactttaggccttgtgttagcaaaagtattactctttgtttgtttgccatgtaggcagtccaacctcccctgaaatagaaatgactagtaatgatttgtttcttgtcagtatgaggtagaccacacgaagcccctccccgtaggctcttcagattctgtttattttgggggcagtagtcaaatcagaagcatgatatagccgcccccccaattctcttcctccttccctttgcccaaggataggatacttgttaaggttagggctcccaggcctagggtccctttgatgcttgaaaggattgcatggcaagctatgtttttctggattagtcctagggtttagtccctgctacacacactgctgctatacttcccccttggagaaggaaatgaatgtaattcccatataattgggaaatgccaacctcactggtctgtgcccctcccaatccccaccacccccatttgtttggtttggagtgtttgtgccccccacccttccacccttttggatattagagatgtgggccatggccagactaggttagcccactacctggtctgggctgcatacaaagataatgaacagggagtagctggccacttcttttggcatttctttacagaaatcctctttgtttctatgtctgttcactgtgggactttggaatttctttgtgtttatcccataaacattttctcttgctcaggacattccagtggttgcttaatgtttctctagtaccatccagtgtatggctatatttaaaacatgtagcctgggtgcattgtctcatgcctataatcctagcactttgagaggccaaggcagaagaatcatttgaggccaggagttcaagaccagcctgggcaacatagtgagaccccttctctacaaaaaaatttaaaaacaattagctcggtatagagttgtgcacctgtagtcctagccacttgggaggctacattgggaagatcccttgagcccaggagtttgaggttgcagtgaactatgatcacgccactgctctacagcctgggtgacagaatgagactctttttgtacaaaaacacaaacaaaactaaagcatcttacagtcctagttaataaagtcaataaagtgagtcacacatagtacaagcagtgtacaaagcacatccagagagtaagtttagcatcctaagatagttttatcttactgtaccagcaatattgtcacagtaaagagaattaacattggatggcccccaccccctacccttcgctgttgaacgtatagaaagtacccagactacaaatgagttttgtttgcagatattttaaataatgaagactgtagaaatctaccccatatttaaatgatgtataccttttcttttctttctttcttttttttttttgagacggagtctcgctctgttgcccaggctggagtgcagcggcacaatcttggctcactgcaacctctgcctcctgggttcaagcaattctctgcctcagcctcctgagtagctgggattacaggtgcccgccaccatgcctggctaatttttgtatttttagtagagacaaggtttcaccatcttggtcaggctggtcttgaactcctgacctcatgatccacctgtctcggcctcccaaagtgctgggattacaggcgtgagccgccgtgcccggcttgatggataccttttcattatctatttccctttctcccgtccacctaactagttcataatgtatgttcaggagattcgccaggcctgggaacctttagccagagtttctgaaggttatagtcatccttggtggagaaaacttggatgaccaagagctttacaagggccctagagctcctgggtagggaaagatgtctagagttctgatgtatgtgtagctcttataatagagattgatttttaacttgatcacatggaagtgggagattagaatggttttgatattgtttgagtctaatcagggctttacaagtgattgaaaatgaaatataccttgattcaggaaagtgagaattgagaattacgtcaggtggctggatgcggtggctcacgcctgtaatcccagcactttgggcggctgaggtgggtggatcacctgaggtcgagagtttgagaccagcctggccaacacagagaaaccttatctttactaaaaaatacaaaattagccaggcgtggtggcgcatgcctgtaatcccagctacttgggaggctgaggcaggagaaccacttgaacctgggaggcggagattgcggtgagccaagatcgcgccattgcactccagcctgggcaaaaagagcgaaactctagctcaaaaaaaaaaaaaaaaaaaaaaaaagaattacatcaggtaagtttgcatgtcttttgagagattgttaggctgtaattccagtgtggcttcaagctccagaccaaaataccaatgaaatactctagaccaaaaggccaaatgaaaatcatttgtcatttatctgctactctaaatatcaagtggcagggcaagattaccaacaagtacattagattgtagggtcattccaggtatgcagtgatgtcactcagaacgcttttctgagagatgtgaatgaagaagaaaaattatcagtggattcctcaagttgctgttgcatagagaacatttatcatacttcagtcactctagcccttgccagataggactagtttccaaatccacatgtgaattttgggttggaattttgaattcatctatattttccctccaccttcaaattccatttctgatggaaatgagatgagtaaatctaacaaggctcttgtaacagacatccacatgattgttttcagaaatctagttttcgagcctctttcttccaacagtaccatcattgctcagaatgtcttgggggcctcttgaatctgtactcaggtactgaagagcatctctggtggccaatcatcttttggagcttgtatttgtctttgggtgggagaaatgattaacatgttttttagagacaagattgggaaaaaaggggtgggtaattgtcaagttgaaggatactaaaggtctctattgaggtgactataaagagcaatgaaaagaatatttccagagatttggagtcacaagacttgtgtgaccttggtttcctcatccctaggaatacatttatatggtttataaatgaagatctgggctagacgcggtggctcacgtctgtaatcccagcactctggggggctgtggagggcagattaactgaggtcaggagttagagaccagcctggccaacatggtgaaaccccgtttcttctaaaaatacaaaaattagccaggtgtggtggcatacgcctgtaatcccagctacttgagagactgaggcaggagaattgcttgagcctgggaggcggaggttgcagtgagctgagatcgtgccactgcactctagcctggctgacagagcaagactctgtctcaaaataaataaataaaaatagatgtagagctgaagacagttctgaagaatttcaaccttatttgagtaatggtgttgatgtccaaaattatttccttgagattactcctttaaaagacagcacttaattgggcatagaatttgtttgcttggggagaggggcagaaaaagtcagtatactttgccaactcctaggctcaagtgatcctcctgcctcagcctcccaaagtgctgggattacacgtgtgagcccagccagaagtcagtatacttctgagcggaagcaactgaacaactattttaagttcgaacaggccaggtgcggtggcttatgccagtaatcccagcactttgggaagctgaggtgggtggatcacttgaggtcaggagttcgagaccagcctggccaaaatggtgaaaccccatctctattaaaaatacaaaaaccagccgggcgtggaggcaggtgcctgtagtcccagctattcaggaggctgtggcaggagaattgcttgaacccaggaggtggaggttgcagtgagctgagattgcgccactgcactccagcctaggctacagagcgagactctgtctcaaaaaaaaaaaaaaaaaaaaaaaaaaaaaaaaaaaaaaaaaaaagttcaaagaatatgctgttactcaaccttgattactacaaccaaccttaatgacaaagaaaccaatggtaggtttaaattcagtaatgtgatcttaggtaaatcacttgtgcatctctgggcctcagttttctgtctgtacaattaggaatttagatttgatttgttagaacacaagccttgttggtttgaaaggctgaatcctaaaatagtacaagttgtttgggtcagaagtagtggtttctaatcacaggagattttctgcagtcatatcatggaaaggacccttgattccacattggtctcttcagcactgttgctcagtaaagctattaagaaggtggtactgaggtacatgtgcatgagtatccatgcatatgctacaagtgagaattccatgttttggattttataattaagaagctattagttgtctggacgtggtggttcacgcctgtaatcctgatactttgggaggccaaggtgggcgcatcacttgaggccaggggttcaagaccaggttggccaacatggcaaaacccagtctctactaaaaaaacaaaaaaccccaaaattagccaggtgtggtggcacatgcctgtaattccagctactcaggaggcttaggcacatgaattgcttgaccttgggaggcagaggctgcagtgagctgacatcacatacacttcaccccagcctgggtgacagagtgagaccctgtctcaaaaaaagaaccaaaaactgttagttgtatatcattgtatatcatactcctattccttaatctggtaatgtattatcaatctgaaaattatcaagcataaagaatgttttaatgaagtaagaagtgttgtgatataatgaataaaagcccgtttggctttccttttaaatgtcattctaagtatgaattttgctcttggatttgaaagcagtgaaattacagagaaatggaagtaattctcttgtaaaaacacatcagagttacttctcagtttaaaagaaatgcatttattgttcttggcatatgtaagaatttgtattaaatatgtaataatcttgactttctttttaaaaatcaaaatcatgagtactttgtaccaactaaagcatttgttttatatcaaaattattaaaagaaatatattttaaacaagttaggtaaccttaatgtatattatgaggaaagtcataatcaaatcagaacttactatgttggaaattaacttgtgataaaaagaaaaaaatccaccctaaattgtattccctgatgggaagaatcttatctaggctaaggctgataaaagtatgaaattgtatttaagttttgcttctatttagattggggaactttggtttggtgctagatgcaactgtcgtaaatataccatgtatgcatcttctctgttaaatgattattttatgtagtgttaggcatttagccaacaagagttaatctaattaagctgtgaagatgtttgttaactaccatatatgtaatttctggccaagttctcttagccattgattgtagaaggaggaatatggtttattctttgagatattaatgtatagccttttggaaaacaagtggccttggcaaacacatttacaaagtcatgctatctcaagtgcagttgggcttttcattgtgttgagatttttgacttgtatgttctcatctatccgtcattcttgactatactaagaaggcattcatagactcttcttcctgagcattttcctaatttactaagtagaaaaaacaaaacaaaactgtaaggtggaactggaagttaaggattttttttcttaattgtgttacatctttctggtaagtacctacgtctacagctataaatttttttatgtgtatgtttcagcttccatatattagagtatggttaaaatttttgcaggtttgattagaaaaataaattttaatgtatgagtaaaaagtttctcattgtgcatcgtttgaatgtcattaaaaccagacttgcaagtttgaatgtcacatagctcagtctctgatactgtaatagatcagcttgacttagctctgaagtagtttaatgaagtcagataattttctaaagagaattaacatctgaaatgtagttgcataattatggcattatcaataggaatacataatggttcaatcatttatgctttattcttttagagcttaattttttcacttaatttggattgtatgtgcaatccaaattatgtgaaattatatatgcattggcttgtatatcccttttctttttttccacggtgctctggaatccttggaaatatgattagacaggagaccgaaatcccattttccagatcacattagtttatatttttgtttaatttccctggatatgttttactatttgcggaaaggttacccttaaaatgggtgaggatataagaagacttgtatagatctctttctctttgatgttgctgagaccttggactttttggctgcaagagacttaatacccaactgaaagtggcctaaaaaatgctatttctactatatggtaattgacctttttaaacaaaattcaattaagtgcaaacttatattttgtaaatacaataaaaatgctgcagcagtataaaattactatgaagtttctaaatgtttgctctctgttcctgtatttatcccactgtggattggaagcaaaccttttttgcagactagcagtagcacatggaccatcttttgagtaacacaagcataaactacacaattattatttcacttaacaagaagtctggatttggtggttccaggttgggttcagcagctctgcaatttgcttgtctttctccattacgtagttaaaaaatgactacagcacctctgagcatgccctcctcaaatgaggacatccaaagctagaggaagacggaggaaaaaaaggaagctttccttcgtctctattttctatattaatggggaataaaactttccccagtgattcatctgccactttgccaacttccgactcccagaaaacttccctttacatgttatttgccagatctgggtcacatagccacatcatcaattgtgtgccaaaaggaataatggattgctatactggcttagaccaattttgatttctcccctggcactgtgtctagggccaccagaagtaaatggggattttattagtgagaaggatggagtaatagctaggtatgttaccaagtattaactgccacactgacaagagaggtcagagtgtcttagacattgaatttaataacttgtttctttgtgttatagttaagaaaggcatacaaagttgataagaaaatggtaaatgcattagcctgtgagacccagtgtgcttgatactgaactatgactcctcttggtgagtcctggaatgtgccatggggcattgctgtacttggctgctagctggaatatctgatttgaaccatagtttaataactggccaggtagtttgaaacaatagaacattattattgttattgatagaatctttattgtgtaatgtatattattaggactttcaaatgtgtttcatttttagaagctacataatacatattttaagcagcgatttatttctgattatttttgcagtatgttagaaaagtaaaataatttgacatgttaagacgtgttccatccatcttcagggtacttctcatgacatttcatttgagcaactaggctttgtattttgttactgcttgcatttagcactcaattcttacttttagataataagaaaaaacaggtattttaaaaaaggacatgtagctgctaataatagcatgagtcctatggttccttctctgttcatatcctagctgacaacacatacaagcattgctttgctggaatattctgaaattaacaattttgaataagtttatacatgtatgtttataaatcctttcccagttaacattttttaattttgtgtttttaagtaaatagcacttcagtttgagtccctataggttgactattatcaaatttgagatgcttacatgagtgatccccgattgctgatatttggacatttgggtctcaatagagagattgcaggttgaatggaaagaccatgaacctgagagccagaagccctcagctctcttgttctgacactgttactatctgaatggctgcgaagaagccctttatttctttgagatgtggttgccttttctgtaacatgtgatctgtattgttctacctcattgggttgtgtagatagagttaatactctaaacaatttcacaaatatatagtggatattattattaatagtaagttttatggagtaaacatattaaaaggtactcaaagtgtcggaagtatggccagactaacactatcacattagttataattgttgctaattcacaaaaccagattgctttatcagtttatttcaagataagcacacagttctggtattgtagagttcttgataatctgagatttgaatatcaacatatagaacagcagtagttattctaaattcaatttttattttgaaacaatttaaactatcttgacaattcatcctagttttcagtatgttaaaagtgactctagccaaatggcagagcaggcagctccaaacacactaatctctttacagaaacatcggaagatgagcagaaactgtcagaaacaactttatcgaaactctcaaaatagtcaaagcgttatagtaactaaatgttttcatcaccacacacacacaacaaccctgtatgttttagctatcacttctctatcccccaaacccggagtcctcatatccacttgctgtctaaaatttccttctttgggacatttcatataaatggaatcatacaatacgtggtcttttgtgactggcttctttaacttagtataatgttttctaagttcatctgtgttgtagcctgcatcatatcagtgctgctctccctttgatgactgagcataattccattatatggttgttaccattttttgtttagtcattcattagttgatgggcattttggttgtttcaacgtagagcaccaaaatacatgaagcaaaactgacagaaatggataatttgacaaatagttggagatttcagtccccccccccgcctttaaaatacaaaaattagccgggtgtggcagtgcatgccatgcctgtaatcctagctacttgggaggctgaggcaggagaatcacttgaacctgggagatggaggttgcagtgagccgagatcacaccactgctgcactccagcctgggctaaataaataaataataaataaataaataaatcatagaacaactagacagaagataaacaaggaaatagaagacttgcataacactgtttaagcagctagagctaatacatttatagcacatttcacttaacaacaaagtatacattattcttttttgttgttgttgagactgagtctcgctctgtcgcttaggctggagtgcagtggtggatctcggctcactgcaacctctggcctcccagattcaagcgattctcctatctcagcctcccgagtagttgggattacaggtgcatgctgccataccctgctaattttttgtattttagtagagatggggtttcactgtgttgcccaggttagtctcgaacccctgaactcaggcaatccactcgcctcgccctcccaaagtgctgagattacaggcgtgagccatagtgcccggccaaagtatacattattcttaagggcacatgggacagtctccagtatagacaacgtagtaggccataacataaacctcaataaatttaaaaggatggaaataatacaaatcattttctctgaccatatgggatgaaattagaaatcaatagcagaaagaaatttggaaactctaatacgtggaaattacagcatactcttaaacaattagctggtcaaagaaatcagaaaatactttcagatgaattcaaatgaagacatagcatgtgaaaatgtataggatgagcagggtgtggtagcacgtgcctgtagtcccagctacttgggaaactgaggtggaaggatcccttgagcccaggaatttgaggccagcctggggaagcaacatagtgagatgctcttaaacattttttaaaaaatgtattggatggagcttaagtagtgcttacagagaaatttacagctgtcaatgcctatgttaagagggaagaaagatctcaaatcaataccctgtccttctaccttcactagaaaaagaagagcaagtgaaatctgaagcaaacagaaagaagaacaaaaataaagattagagcagaaattaatagagaatagaaaaataacagtaaatcaatgaaatcaaaagctggttcttaggaaagagcaacaaaattgacaaacatttatatagattgaacaagatacaaagcgagactcaattagcagaattaaaaatgaaagaggagacactactgttgaccttacagaaatacaaaggattataaaagaatactgtgaacaaattgtacaccagcagattatataacttagaggaaatgcatcagttcttagactctgaacttctgaaacagactcagaaagtagaagaaaattagaataggcctgtaacaagtgcagagattgattcagtaattaaaaagctacctcttaagaaaaacttagctctagatggaattctgagggattctaccaaacatttaaagaattaataccagttctacacacacacacacgcatgcacacacacacgtttaggaggaagcacttcccaactcatgaggccattaatacccaaataccaagaccaaaagtaaagtatcataatcacattccaatatctcttatgaatatgtatgccaaaatccttaacaaaatgctagtaaaccaaatcagagatgcataaaaagaattgtatcccatgactaagtgagataatctcaggagtataaggttggtttaacatctgaaaatcaattaatgtaatacatcaacagaatgaaaaacaaattatatcatcatctcaatagaggcagaaaaagcattttatgaaacaacacttttgataaaaacattcaacaaactatgaatcgagtggaacttcctcaatctgataaaaggcttctagctattactttttaactgtgttattttagtggttacttttatctttaacgtatgacagtctgccttcaagtgatactatacaatttcaggatcttctgtttttgtttgtttgtttgtttttttgaaggtggagtcttgctctgttgcccaggctggagtgcagtggcacaatctcggctcactgcaacctctgcctcccaggtgctagcgattctcctgcctcagcctcctgagtagctgggattacaggcgcatgccacaatgcccagctgatttttgtatttttagtagagacgtggttttaccatgttggccaggctggtctcgaactcctgaactcaggtgatccacctgccttggcttcccaaagtgctgggattacaggggtgagccaccgcgcccggcccaggacctttgtttctatctcttcaactttgtgttattgttgtcatgcactttcacttctccatatgttataaaacccgtactacactgttactaattttgctttacacatttgtcttaggctgggtgccgtggctgacacctgtaatcccagcactttgggaggccgaggtgagtggatcccttgagtccaggagttcaagagcagcctgggcaacatggtgaaacctcatttctacaaaaatacagaaaattagctgggcgtggtggctggtgcctgtagttccagctactcaggaggctgaagtgggaggactgcttgagcccaggaggtggaggttgcagtgagctgagatagtaccactgcattccagcctgggcaacagactgtgcctcagaaaaataaagcagttgtcttttaaggagatacgaataattagaaaagtctgtttacttgtgctcatttctttgtgtaggttcatattttcatttggtataattctcctgctccttgaaatccttcctttcctttccctttttttttttaagtctgttgcccaggttggagtgcagccgtgtgatcatagcttattgtaaacctggaactcctggtctccagtgatcttcccacctcaacctccagagtagctaggacttaaccggtgtgtgccttactaatttttttatgtttaaattttttgtagagacagaatctctctatgttgtccaggctggtctcaaactcctggccttaagcagtcctcctggcttagcctcccaaaatgctgggattataggcaggagccaccacacccggctttaatatttcttgtggtgcagatctgctcgtgaggaattcctttagcttttatgtttggaaatgtctttgtttcttcgtttttgaaatatatttttgctgagtatagaattctaagttgatagatttttctgtcagtatcctaaagatgttgctctactgtcttttagcatgcaacatctctaatgagaaatctgtcactgtccttatcttctttcgtttatatataatgtgattttcctggctgcttttaataatttgtctttatcactggttttaattaagcagctttattatgtgatgtgcgttggtgtagttttctttgtattttttgtgtttagttttgtagagatttttggatcaaagggcttattatgtttccaatcagtttttaaacatttctgccattatttcttcaaaaaattttttgcctcccttctacctcttcatagacttcagttatacatatattaagccttttaaagtttcctcactcatagatcctttttattttcttcattttttactgttttgttttattgtgactatttactgctaggtcttcaggttccttttttcttcattgcttaatctgctcttaatttcatccagtgtttttatcatctcaatatagtttacatctgtaagagttctattacgttctttttctctttttttctttgagacggagtttcgctcttgttgcccaggctggagtgcagtgacgtgatctccgctcactgcaacttcggccttctgggttcaagtgattctcctgcctcagaggttctttttttttttttttttttttttatcttatatgtctagacttaactttttgaattttcttttttttttttgatttagtacaaaaaacatgaacatacggaatacagttatatttattggtttaatgtctttggttactattctatcatctgtttcaattctggatcacttttgattgagttgatttttcttgtcactgtgggtcatattttcctgcttctttgcatgctagttaaaagtttaaattgtataccagagattgtgaactttaccttgttttcatagatatttttgtattcttgtaaatattcctgactttattttggcatgctgttaagtttcttgggcagagttcagtcatttcttgtctttctaagttttgttaggctgtggtgtaccaaatcaacatttaatctagggttcatttactccactactgaggcaaaacccttttgagcactctaccctgtgtcctatgaattgtgaggttttccattcttactgatgggaacacgcactattctaggccctgtgtaagctatggcatttgttccctctagttattttcagaagtctttgtccttccttacattgagtagatttacagatgtcatcataatggttatggttatactgattttgtttcttatttgaaacagaaagctcagcttttcactgttaggtttgatgttccattttggctttatttaaaccttttttctttttcttttacagtatcctttttttctgaaagaaagtttccttctgttgcctttgattttttttgttttacaaaaaaccgtggatgaatattaatttttatccagttatttttctctgtccattggatgctcaagtttttttctcctttattttgttaatgtggcctattacataaatgtttgagtattaaatcagccttggactcccatgaaaaaacccaactttattgtaccatggtattttattgcccattttggtttgctaaattttgtttacattctttgtatctgtgttcatgaatgaggctggtgtcttaatttttttcctctttcttttctttctttctttctttctttctttctttctttctttctttctttctttctttctctctttctctctctttctctttttctttctctctctctttctttcttttctttctttcttgccttcctgccttcctgcctgcctgccttctgttttgtgtgtgtgtgtgtctgtgtgtgtgtgtgtgttttaaatacctataatgcccttattgagttttggcatcaaggttatgctggtctcatcaggtgagtggatgagtgctccttctcttgccctgctgtgtttaagatggatttatttcttaactctttgtagaaattgccagtaaagccaaccgagactgagattttcttcatttctaatgaagttctaaattttggatttattttcttcttcactgtaggattggttagattttgtttattctttttggttttggtaagttttttttccctagaagtttaaaatttataatttattaacatgatattgttgataatatcctctttttaaatttagatatgacttacatataataacaagtatgatgttaaatttacaacgtaatgaattttcatacatgtatatttctatctatatatgtctatatttgtgtaatcaacagctagagcaaggtaaagaatatttccttcatacctgtaggctccttcttgccctcttctacttaaagccttgtctgtacgtaactattattttgatctctatcactgtagttttagttttatctgttttaaacatcatgtaactagaatcataggcacttcttcatgtctggtgtgttttgctcaacattatgtctgtaaggttcatctttgttgttgcttatggtagtaattctcatcccattgtgtgaatacagaacagtttatggatttattcacttgtgggtagacattggcttatcttccgtctttgttaggtgtaatgctgctgtgaatgttgctttatatgtctcttggaagaaattcagcttcgtatttcaagagtatatagatgagagggaatcggtgagtcataggttatcaatgctaagcttttgcggtagtggctataccagtttactctcccagcatcagcggattagtatttcagtgttccacacctttgccagaatttggatattttcagtcttctagcctctggtggagttatattggtgtggcattttaattttaatttgcattgtctgatgtctactgatgttgaactgttttccatttttttattgaccgcatagatgtctgcatttttgaagtgcctgttcaagtcttttgtccaatttaaattgggaatcaacagtcagcaagtagtcagaaaagaatagcaaaaacacacaaaataaataaattgggagtcagtcttcttattgatttatagttctttttatagtttacgcacatacccacacacacaccccatgtatgtgtattgcagctatcttctcccaatctgtggttgacttttttattcccttagtgttatcttttgatgaacagaagttctcaattttaatgcagtgttatctatcattgttttatgtggtcaggactctttgtgttttaagatatcttttcctattacagagttaaaaaagacattcgagttcattcttctagttttattgttttatatttcgcatttgggtctactgtacacatttacatgtgatgtaaagtaatggtgaaagttcatttttttttcacactgatatcaagttgacccagctccgtttattgaaaagaccattttccctagtgcttgctgtggtagtgttaagccacatgcaggtctgtttctggacttttaattctgttccattggtctgtttgtctgtttctacatcagtgacatgctgtctctattgctgtagctttcagataggttttcatatctggtagtgtaagtccttcaggttttttattattcttcatgattgtcttagctattccacagcctttgaattttcatataaattttagagtcagactgtcaatttcagttaaaaagaaatgctgtggttttgattgaaattctattgaatctaagcatagtatatatatttccatttatgtaagtctttaatttccctcagaagtgttttataattttcagtgtagcaaccctgtacatcttttagatttatttcttggtatttgatatcttttgatataagtactatgatttaaatttcactttttaacttgtttattgttttaaatgaggaaataaaattaatttttgtatgttgaccttattcagtgaccttgctaaattcattagttaattctaatattttacagatttctttccatgatacccagtcatgttatgtatgaataatgacaggtttacatattcatttcttatttatttattttgagacggagtctcactctgttgcccaggctggagtttagtggcgcgatctcggctcgctgcaagctctgcctcccgggttcacgccattctcctacctcagcctcgcaagtagccggtactacaggcgcccgccaccacgcctggctaattttgtttttgtatttttagtagagacggggtttcaccgtgttagtcagtgtggtctcgatctcctgacctcgtgatccacccgcctcggcctcccaaagtgctgggatttacaggcatgagccaccacacctggccattcgtttctgatttttaagattcctttttcttttgatgatgttggcaccactaatctttttgattcttatttgactttccttgcttaattccacttgctagaatctctactataatgttgagtagttgtggtgatagtgtaccttcttacttttttcctgcatcggggaaaagcgtgcaatatttcaccatttaatgtgatattaacctattattgttagcctttaacaatagtggctgagtagccactattattgttaaaatgtgcccagcctgttcatttttgtgttgtgactttttctgaggtttcatgaatgctttaatgatccgaagttattgttcatttgtccaatttagatgtatatttgtatttaaattgtagatgtaaactaatacttgaaataagcactgtttaaataggattgatctaattttagcccttatgttttagacgttagagatgcccgttattatctttgcatatttcaaataaaatttctttacaattctttaattgccctgttttgaagaaataatacaactaatgcacatggtaaaaatttaaacagttcaaaatggtttacagtgaaaagtaaatatttttacttccgttcacagttccattaccccgagggcaacctatgtaaccatggtgttttttgatggggagtatccttctactttgtactgtgcttaaccattatacatttaaacagtatatgtttgggcatgtactatacatactattcagcttcttatgatgtgttttattgattgttttataacagtgtatgtagaattacgtcattcttttgggtaagattgttttatatcagtatatgtagaattattcttttgggtagtgtcatattatactcaatagattcagcatactttagtctctttttatggacatttaggttattaccaatcttgttttaactgtttaactgtgatttagttatgtaactattttaaacaatactgcagaaacccttgcaatacaagtttttctgcgtatgtgtgggaatttcttcccatattatcttaatgtttttatttataacttcttttatactgtgttctgagaacattacatagcaaagtactctttcagtactcttgagaattagaaattactattcaaaattttactctcttggaataggcttgcagaagacatctctttttcaagaggagaaactcatcttacaaatggtgtttgagcaaacttccttttgtgtagaaattcagtgtaaaattttaatatcaaataatgggcaatattgagttgttgcaattttcattacttttaaactgatttagttttctaagtagagtgcactagttctgtagatttttttcccctctttttggaaaagcactagtattttgtaaagaatacattacttgcttgttgttagtatttgtagtaacaaggttattaactcattcaacaaatacttgtcacaggtctgttatgttccaggtagcggaaattccatgctatggaaatatatcagtaaagagttcgtcatggagcttttatggagttgcagaatcgggtggggcaagaataaaataattgatttaattgtaaataataaaaatatgttggcaggctaattggtgatcaatactaggagaaaaataaagcatgcaggcagaatatggagtgccgagattcagagtttaaaataggatataccttagggaaggacctacaagaaactggtggttgcttttaatagaggggaactgagtgtgtgaaagacaggagtgggaatgagacatacgtttcactagtactttttttgtgcctactgaatttttttttaacatgcagtatgtttattggaataaattcaattttattgaaagataggctactgtggtgttagaggtgagggagcaagggagcaagccgtccaatttttggcaattcattctggtgctttcactgtggccaggccttcttactcagaaatgagtagtaagtggttctataatcgtatattcctaccgatagcatattaaggaaggaaaagggcatcctgagaaagcaagggagatttgagtggtaaatgggtaagagatgaaaagttatcaaatccagaaaaaccttttactgttattttaaatcatgaacaaggctgtgttggccaggtgtggtggctcccgcttgtaatcccgacacttgaactgaagttcgagaccagcctgggcaacatggtgaaaacccttctcttgaaaaatacaaaaattagcgagacgtggtggcacacacctgtagtcctagttactcatcaggaggctgaggtaggaggaggattgcttgagcccaggagattgaggctgcagtgagccgacattgtgccactgtgctccagcctgggtgacagagtgagaccatgtttcaataacaacaaaaaaaggatgtgtttgtctttctaatatggaaatgaaatcatcaattactaacttccagtatgtttcagttaagccttttagaggggcttcagccttttgaatgaaagcagtgaggttgagtgaaggtttgatactcacttccatgttctgtttgctgcatctgaaccactagcagactgacttgaggtttctctcacaaaagctgaagggattcacaggtgcttaggttaagtactggagagaccttcttgctgaggcctttaacaaaattgcaaaagacaaaagtaatttaattccttacttggttctctggtgctgtatataaaaccaattgacatgtaacacttgtagctgttgagggttaattttaaatattctgttagtttgttgagtgtcctctggtaattctgtttttaaattcagcgtttgtatttgtatatttggaaagtatagatactgcctgcaaagggtaaaggtggggttaatttggaatctgaatataaaatatttgttataaaatgaatataatagcattatggccaggtacagtggcttactcttgtaatcccaggacattgggaggccaagccaggaggattgcttgagcctaggagttcaagaccagccgaggcaacatggtgaaacaaaaaatacaaaattattgtattttgtatttttaatacaaaaattagctgggcatagtggcacatccctgtagtcccaggcactcggggggctgaggaaggaggattgcttgagcccaagaggttgaggctgcggctgtggtgagctgagatgataccactgcactctagcctgccatgcactctagcctgagtggcagagtgagaccctgtctcaaaacaccaccaccaccaccaaacaaacaaaacaaatataacgttagtaaaaattataaaagaaaatgttgttcatatcttttcaggtgtgttagacccttctagttcttgtctgttgcttccacatctgtttccaatagctgtaatcatgaattagatcccatttccttttttaaaaaagtaattttaattgaatgtagactttttcttttcagatagagatgcagcagcaagcttcttttacttactttttttttttttttttttttttaagagatgatgtctcactatattgtccaggctggacttgaattcctgggctcaggtgattctcctgcttcggcttcccaggtagctgggactatatataggcatgagcaactgcactggccatgtcccatttacttaacattttacaaacattaccctatgttgttacttagtttggaagtagtttcatagatgattttaaatagtaataatttcagagtaacataaagctggaaaattggcaaagcatgtcaagctgtgtgcagtaatttaggatggatccttacacttctctaaaaagtattcatttttaaaaggttgctttgatcaccagtcttgaaagttttgagagtctttattggtacataatgagaatttttaagcttagaaaaccaattttgtgttaaaacttctttatttattgggtagacttgtatcagaattataattacctgtataattgaaaaatcctataatttaaggtgtaaatatttaagctttctagttagagtcaccaacaaaatatataggaatatttaatttcttctttgacacgtgaaatattctggcaagctttcagactagtagaacagtttccagagattgaataaaattgtttatcactaatttactggtcatctagattaccacattggttttctgggaacttcatcattcaggggctaatcatccattttctgaattttctaaattactgtcaaagcgtctcctatctactgtatcacctttcttgctaccaagcttttacttacagcgcatattccgtttagtagagtaagatggaatagcaagagtatgtaacattgaccctaggtcagtggtctgtggttcttgggtgggagagataaaggaggtttaacaattgagaatttcaaagtcatcagtggcagagcacgcgctctaatagcatgaataatttaatcataactaaggtaggactgatgaaaattttaaacgtgcaattcataaaaatgtgcttgctttttaaaaattgttttccataaataagttggaatctatcctctgtaccttgtaagttgctagctgctattctaaacaatagtccctttatgaggtgagaggtttttgttctgtggatattctcaaagggcaatatgacgaaattctgaaataaagggacagattttctttaaaaagaaacaaactacttggcctgcttggaaaggaataaataactatagcctacagtttttgcttttctggaatgccaaatttcagctcagagcagattcttcagctgagcaataaacctttgaaaattgctttataatggaaatgctgacagaccattaactatagtggtgcaaatgtgctgctctgacatacataaggttgtcccaagttgctaaatagaataaaccatgttgggcagtgtacatcctgtggaagcctatgtgggtgtatacagtttgtcatgttatgccacctgattattaatgggcgaagttccatcatatcacctttgacatgcagcagaagtaccgttttagaaggaaggagtggtttaggctctgctgatgctgatagctcattttatatttgctatactggaaaaggcccagggtaaatttaacatgatgcatttaatcaccattccaatcacagtgccactgaagcaaatcaatgttttcttactaccaattcattggaacttccaggtcataaagtatcattattaggcatattggaaagtctcagcccaatgaaaatgtggattctgggattttccagttgctttgaaatagtgacagaggctgcctggctgtacattttccccatgtataatgaaaactggaatttaaagggattgatacgacaaagcaagaattatataatgacctagggaaggatgaagcagaatgttcacttctaaaagcaaaataaggaaaatgatgaagaggggtgattatttccatagtagcctgcttagtgactcatgtccctgctaataataagtattgtgagaatgtgtcttattcttggctatattcacagcgcctagaacagtgcctggcacataatgtggatgtcagtcaatgttggatttacttgtgcttgtttatttaaaaactatttggggttagattgtcaggaaccctgctacatgttgtgtaaggcttctagtgtgtacgtgtgtgtatttcatataatacatttatgtgtatgagcagttggaattgatcactaaaatatttcttaaaggtaatataagtacaatttggtatgttgagtatcatgaatgaatcaatgcaaagattcaagtatctttgggtagaatcatgtcctttgaaatgtcagtgtacagtaaaaaggtctgacatcataactagattataaatcctatactcttgtactccaaagtcagtatagttggactggcttgtatgtcctgtttgacaaaatataaattttactttcctgtggcaattcccaaactgggctgaccacttggacttttaagaaaatgtaagcactcttgggcattgacccaacgattttcattcactagatcctggggtggggcctaggaatctgtgttttttaataatttcctttctgtaggtgtttacatatagtcagtttctctgctacccacctttcatgatatactttgaaatttggtgacaatcaccttggaccttttgggttctctggaaatggtaaccagtaaggtaattaataattaatatcttatactggtagagggaaagaaatgctaacatgtgtcatactaaagatcttttaggactagtgctgactttctgttcatatatttcactggaaagctattgtcaggacattttgcggaaggtgttttttaaaatgtggcatattcatagagttgtattgctggaagttaccttagaaatcatttagcttattcccttttatatttgagttaatcttaaaaatgttagggttagggtgtaccacttattagttaagttgcctcatttctcttagccatggtttcttaagcataagatgggaatgataatacctacctaccttatagttttttttaaggatttaactgaaattcaaaaaaagttgctagcatacatcttgtttgtagcagtgtagcaagtgttcagtaaatgtttaatattttgacatacctataatatgatctatggtatacataaaagccaaaagaggtagaaaaagttatagtaattaagttcaagttaaaaatgttgtacacccacaggcagagttttatttttaaattatggtataatacttacacaatacaccattttaaaccattttaaccatttttaagtaaatcattcagtggtgtttagtacagtcagtgttatgcagtcatcactgtctagtttgagaacattcttattaccccaaaaggaaacctgtacccattgaggagccacttcctattcttttctctgtatccgcttgcagccactaatctattttttgtctttatggatttgtttattcagtctctttcatatgagtgaaataataaaaaatgacttttcactgtataatgttttcagggcttatccgtgttgttgtgtgtatcttactgcataacttccattttttttaaatgaccgaataacattccattgtatggatataacagccttgtttatccagtaatcagttgatagacatttaggtcccttccaccttttggctgtgtgagtggagctgccacgaacatgcatgtataagtttttgtttgaacacctattttcactttttgggtatacacgtgggtgtggaattgctaggtcttgtggtaattctatgtttaacttactgaggaagtccaaactgttttccacagtggctgcaccattttacactccattagcaatgtatgagggttccagtttctccacatactggccaacacttactttctgttttttttttttttaattaaattttatagccaccctagtgtatcttattgtggttttgatttgcattttgctgatggctaatgacaggcatctttacctgtgatttttgaccattcgtatatcttctttgaagaaatggctgttcaagtgctttgcccactgtttaattgggttgtctttttgttgttgaaagcagtcttttgattatgaaattaatttatgtattcttctctagggagcttatttggaaatatatacttggtaatataaaaatttatttcggaatataaaataaaggactggacttcattactttttaagtaaacttttattggatgcttccttttaatgtatttttttttgtagaaatgaaattgttttaattttatagcttagcctgatgcctgattccatgcttgcactgactctctgtctgcactaacaaattatcagatttattcctttccaaaatatcattgattttttttcagatcatagaatattcctctcccaacttttttgttgacagctttactgaggtgtaatttacatgccataaaatacacccattctaactgtacgtagttcagtgatttttagtcaacttaacagcattgtaccacagttaacacaatgcaatattatagcatttctatcattctgaaaagttttcctcagaccttttggaagtcattttctgttcgcgccccttggtgaacactgatgctttctgttactcttgatttgccttttctgagtatttcacataaatggaatcataatgtatagtcttttgtgactagcttctctcactgaacgtgtttttgtggttcatctgtgttgtcgcatgtatctgtagttctattttttattactgagtagtatttcattctgtggataataccacattgtgtttattcattcactagttgatggggatttggatcatttctagtttttgactattatgcataatgaacattcaagtacaagtctttgtgaggacatcctctttcaactttttattttgaaaaatttaaaccccacagaaagattgaagtaagtagtatagcaaacacctatttactcttcacctagattgactattaacatttgcctgctgttctttgcctttttctataaatataccttttccagaaccatttgtagatattatactttatctcttatgtatttcagcatgaatttcctaagaatgagaacattcacatacataaccacgattttatcacacttaagaaaattagcagtaatctcatgtcagctactttatagtccatattgaaacttgtcccaaaaatgtcttctgtagttcccaccccgccgtttctaatgtaacatccccaaatgatttatgaatcgcagttggtttgatatttctcttagtctgtcttaatctagaatggttccccttctttttgtttgtcctgtcagtgaggtttggaagaatacaagccttccacattttagatctgtctcattgtttttaatgatttgttttaggttaaacattttgacaaggattcttaattttaaggtgaagttgtgtacattttagcacaccagtgataaagtgaaaaagtgagttatagcacagatctaaaaataccttaaatgctttattttaatgtaaaacgtaaatgtacattgccattagtgtgaacataatgtcaagttctccccttgtgtagaaaagtttgatcacatgtgccatgctggtgcgctgcacccactaacgtgtcatctagcattaggtatatactaacctgcacaatgtgcacatgtaccctaaaacttaaagtataattaaaaaaaaaaattaaaaaaaaaaaaaaaaagaaaaaaaagaaaataattagggagcttcctgatagcttaacacatggaggttcctggagagtggcccactcaggaaggcttggaagctcccagcaccttccccactaccttgccctacacatctcttcatctgtatcctttgcaatatcctttataataaacaagtaaacttaattttcaaagaaaaaaaaaaaaaaaaagaaaagtttgatcacttgcttagaggtactgaatgccagattctaaaggaatgactttctctttgtattaagtaatttgtaggatgaaactttgaaaccgtatgggatcttgtttgtcagtaaccttttacctgattgtttcagggtccttgaaataattattacattgggagaatgctttaaaaaataatttcataagttgtgtattagttgaagacatttgacattgtctccttaggtttctgtacttgggtaaatataccccagatgtctcattgacttgttacattgtattttatgcttaactctttcagagagaaatttacttatgaatttgttatggtagtaagtgtggagatggattttgttttagaagttgcttttgattttacattgataactcgattgcactttagcactcagcaagatgatagagaaattaatggaatccattaagagggaagactttctaaatagatgttcacctgacaaaacgagattttttttctttttttcttttttttttttttcttttttgagacggagtcttgctctgtcgcacaggctggagtgcagtggtacgatcttagctcactgcatcctccgcctcccaggttcaagtgagtctcctgcctcagcctccctagtagctgggactacagatgtgcgccaccatgcccagctaatttttgtatttttagtagagtcggggttttgccatgttggctaggctcctcttgaactccttacctcaggtgatccacctgcccttggcctctcaaagtgctgggattacaggcaggagccactgcgctcagcctaggtttatttctgaatgttaagaattttgttcagaattctttttttttttttttttttgatgttttgctaaagcttttggtggagtttcctgttttgtcctctgcatttctgaaattgcttatactatagttgtgctgattaatcatgggtagaatctcaaaatgttacattcaagcctgtaaatacttccatttcttttcctgggaaaagagaatacagcatgtcaataatatcagtaattaatgtgaagctctttgctctatcattgatttgtgactggcttacaccagaacatgggaaatgtacatcagaagtctcttattcaaattgataaaactgataggtaagtaaaaaaatgtgttaaagcatggaatcttaaaaagcaacttgaatgtttagtttaatttaaaacataaatttacatgatttgcgtttttaaatgtaggtctaaggcttgttctttgcatgtcatcaactgatttgagagccatacacttgtttctgcataagccacacaaataatacatagtctgtgataatttagcatagtagaatgtggcctctgagaccaggcctcctgggctgcaacccttattctcttttcttactagcatatgaaccaaggcaagttacttgacagttccttgcctcagtttccccatttgtaaaatgcagataataccagtgagtcagtaattgtcaaacacatactagtttaaaatgattaactcatttaatcctgttggtaactggcatgtaagtgcctaagtaattgttaattaagtaatgtccagttttggtttcattaagtgacatgagagtctaaatacatttgtgaagcaatctgaaggtactctttctagatttaaaaaaaatattttaattaagactttttaaatcttgcaaatataaattgtgtatgtttatggtgtacagcttggtgttttgatatatgtatacattgtaatggctaaatcaagctaattaacacctcacacacctatcatttttggggggtgggaacatttaaaatctcttagcaattttcaagtatacaataaattgttactaagtataatcaccatacaattgatttattcctcctaactgaaattttatgtcctttgatgaacatatccccaaccccccattctactctctgcttctgtgagttggactcttttacattctgcacataaatgagatcatgtggtatttgtcattcggtgtctggcttatttcacttaacatgatgtcctccaggttcatccaggtttttacaaatgaaagaatttccttctcttttaaggcttaatagtattccgttgtgtttatatgtcacattttatccatgcatccattaatgggcacttaggttgatttcatgtcttggctattgtgaataatgctgcagttgaacatgggagtgtagatatctcttcagcatcctgattccattcctttggatatatacgcagaagtggaattgctggctcaattccactggtagttctatttttaattttaatatactgttttccatattggatgtactaattccaatgagtagtatacaagggttccctttttcccccacgtccttgccaacacttgttgttatctcttgtctttttggatcatggccatctaacaggagtgaggtgataactattccactgcagttttaatttgcatttctctggtgattattaatgttgaatacttttttgtgtacctgttagctatttgtatgtcgtcttttgggaaatgtctattcagatcatttgaccatttaaaaaattgggttatctgttttcttgctattgagttgagctccttgtatattttagatgttaaagaagtatggtcatcagaagtacggtttgcacatatttcctttcattctgcaggttgtgtctttactctgttgactgtttccttttctttgtataatctttccagatttatgatttttatccatcccagtctttaagttgtcctgaccatgcttggcagtatgtcttttgatctgttcaaagcagtcaacatagattttatagaaataatgcatcctttttgcacttactggtttgggttgtaactgattatattatctacagtaacagaacaggcataattataaggcagatttggaaacagaaaccactgattcttgttagacattcagttcaacaggtgggagtggagatgagcttgtatattgaaaaatagctttgctgcctgagatggcatctggcaagctgtggttatgtcatcctattttatggggggcctcactagcataggttactacagtcagttgagtagagtgttgccaagaaaacttaatgctgctttctttgaagatgagtatgatgcagattcaccatcttagggtgcctaatgtaggttggttgctatggatctgtcttctgccagtcttttatctgtgtgtgtgtgtgtgtgtgtgtgtgtgtgtgtgtgtgtgtgatggtgtaggtagcatatgtttgtgagaggtggcaagttttgtggctaagaagatagactgacctaggactatcaagatcctctgagaacaattacctgtggctcatcaccagtccccagcactgaggagggggaccatgcactctgagttgaattctgtcagtcggatcctgatcccagtgctttttaatacttccgccagagtcttagatggtagcacacagagtatgctcattaagattgtgaaatggcatcaaattgaataggtggctcaatagaaaacttgattaaatttcagaatacctgatggttcaggaaagttggcgaatatacatatggcatttagctggatcagggcaagataattttcttaaggaaagtaaatagttgttgaaatttggtatgggagtagagtttttgtactacacatgatagtacaaagtatcccaaagtgctgagaaaaaccagttaaataagggtcattgataatgcttttgtagttggtccaagtgttgtgggttattgttaagctgataatgcctttgcattcaaaatcattgataagaagtcatataattggaatggtgcttatggaaattacagggcttcactgtacttagtatttcacagtgtaagcatatgatagggatatcagaaagaaatgttctgagtgagaaaactgtttgaaaaactagtaaatagtcctgtagatgaatgttgtagtagatacttagtttagaaatattaggaaatttagtaattctcttaataaattacacaggtataccttacagataatgcagtttttgttcctgaccaccacagtatagcacaagttacacaaattttttggtttccgagtacatataaaagttatgtttataccatactgcagtctgttaaatgtataatagcattatgtctaaaaaatgtacatactttaattaagatatatttttgcttaaaaatctgctaacaatcatccaaaccttcagtgaagcacaactttttgctggtggaggattttcccttgatcaaggtggtggttgctgaaggctgggtgggggctctggcagtttcctaaaataagacaacaatgaagtttgctgcatcaattgcctcttttttatgaaatatttctctatagaatgtaatgctgtttgatagcattttacccacagtagaacttctttcagaattggaatcaatcctctcgaaccctgctgctgctttatcagctgagtttatgtaatattctaaatcctttgttatttcaacagtgtttacaacatcttcaggagtagatttaactcaagaaaccattttcattcattactcattcatttcaattttattatgacattgcagtgattcatatcttcaggctctacctctgattctagttctcttgctgtttccaccacatctacagttatttccttcactgaaatctggaacccctcaaagccatccatgagagttggaatcaacttccaaactcctgtgaatgttgcttttttgacctcttcccatgaagaggtatcacagatgttcttaagggcaactagaatggtcagtccttcccagaaaatagtctattatttactttgcccagctgtctatggcagctatattctttttttttttttttttttgagacagagttttgctcttgttgcccaggctggagtgcaatggtgtgatcttgactcactgcaacctccgcctcccgggtttaagcgattctcctgcctcagcctcccgaatagctgggactataggcacaggccaccatgcctggctaattttttttattttattttttcatttttagtagagatggggtttcgccatgttggccaggctggtcttgaactcctgacctcaggtgttctgctcacctcagcctcccgaagtgctgggattacaggtgtgagttactgcacctggctggcagctatattcttatgaaatgtatttcttaataagacttgaaagctgaaatgattccttgatccatgggctacagaatgaatgttgtgtttgcaggcatgaaaacagcattcatttccttgaacatctccatcagaactcttgggtgaccaggtgtgttgtcagtgagcagcagtattttgaaaggaatttttttttctgagcagtagttcttaacagtgggcttaaaatattcagtaaaccatcctgtaaacagatgtgctatcttccagaccctgttgtttcgtccctggagcataggcagagtagatttagcatagttgttttgttttgttttttgagacagggtctcattctgtcacccaggctggggtgctggagcgcagtggtgcaacctctgcctcctgtgttcaagcgattttcctgtctcagccacctgagtagtggggattacaggtgtacaccaccacacctggctgatttttgtatttttagtagagatggggttttgccatgttggccaggctggtcttgaaatcctggcctcaagtgatcagcctgccttggcctcccaaagtgctgggatcactgggatcacaggtgtgacccataattattttctttctttctttctttctttttttttcttttttttttagtggagacggggtttcgctgtgttagccaggatggtcttgatctcctgacctcgtgatctgcctgcctcggcctcccaaagtgctgggattacaggtgtgagctaccgtgcctggccaggtgtgacccataattcttaagggccctaggatttttggaatagtagctgatcactggcttcaacttaaagtcaccagctgccttagcctttaacaagagaatcagttggttctttgaaacgttgaagcccagcattgacttatcctttctaactacgaagtcctctgtagtatcattttctagtataagactgtttcattggcattgagaatctgttgtttagtgtagctaccttcattttagctagatcttttggataacttgttccagcttgtacaacagcacttgctgcttcaccttgcatttttgttatggagatggcttcttttttttaaacctcatgaaccaacctctgctatcttcacacttctcttatgcagcttcctcacttctctcagcctttatagaattgaagagagttaggctcttgttctggattaggatttggtttaagggaatattatggctggtttgatcttctgtcttgatactaaaactttctgcatattcgtatgttcactggagtaggattttaaatttcccttcagaactttttctttgcattcacaacctggctaactggcataagaggcctagctttaggcctatcttggctttcaacatgcctttctcactaagcttaatcatttctagtttttgatttgaagtaagagacatgtgactcttttcagttgaacacttagagggcattgtagcattattgacctaattttaatagtgtcccaagaaaatgggagacagatggaggaatggccagttggcagagtgatcagaacacacataacatttattgatgaagtttgctaccttgggcttatccattgcactctggatgtgctgacccctgcaattttccacaaatgtgagaaacttgactgcataatttatggtagtgggaggctgcgtttgcactctcccctgatgctatgtgtttttaaaaaattttttgtttatttattttttcagacggagcttcactcttgttgcccaagctggagtacagtagcacgatctcagctcactgcaacctctgcctcccagattcaagtgattctcctgcctcaggctcccaagtagctgggatttcaggcatgtgccaccacgcccagctaattttttatttttagtagagacagggtttcaccatgttggtcaggctggtctcaaactcttgacctcaggtgatccgcccgcctcggcctcctgaagtgctgggattacaggcatgagccactgtgcccggctgctgtgttttttttaacttaaaaaaaaaaaaaaaagtttgctggcttgtatgggcatagtttatggtgtcccaaaacaatgacaatagacattaaagacactgatcacagatcaccattgtagatataataataatgaaaatgtttgaaatattgcaaaccttatcaaaatgtgaaacagatatgaagtaagcacgtgctgttgaaacaaagacttgctcaatgcagggtttccataaaccctcaacttgtaaaaagtacagtacctccaaagtgtggttaactgtagtgctataaaaccaggtatgccagccgggcacggtggctcatgcctgtaatcccagcactttgagaggccaaggcaggcagatcacgaggtcaggagatcaagaccatgcaggctaacacggtgaaacgctgtctctactaaaaataaaaaaaaattagctgggcgtggtggcacgtgcctgtaatcccagctactcaggaggctgaggcaggagaattgcttgaaccctggaggcagaggttgcagtgagctgagattgcgccactgtactctagcctggtgacagagcaagactctgtctcgaaaaaagaaaaaagtaaggtatgccatgtataattacagtggtctccctttatccatgttttcacatttcgcagtttctggtacctgcagtcaaccatgttgtgaaagtattaaatggaaagctcctgaaataaacataagttttaagttgcacaccattctgaatagcatcatgacatctcatgctgttctgctctgtcctgccctggtggcgaatcatccccttctccagtataaccacactatgtatacactacctgcctgttagtagctgtcctggtgatcaggtagactgtcatggtatctgtcatggtatctcagtgcttgtgtttaagtaatcctattttacttaataatggccccaaagcacaaacatagtgatgctgacatagtgttaaaattgttctgttaattattgttgttaatcttttactgtgtcggatttataaatttggaaatctgtttgtataggaagaacacagtatatatagagttcagtactatccatgatttcaggcttctgctgggagtcttgaaatgtatccctcaaggataatgggggactactgtatatcattgtgtgatcatagatttatagaatgttagcggtcattggtctcagtagctcactttattttaatgggtgacaaaacccaattgcgacgtcccaccttcaagctaagccctttcttcccaagtcattgctcttaacactacccctgtagcaactgtttttaccctgaagacagaattataaagtttacaacagtgggaggaaatatgtgttggacattagaaatttatgattacaaaggcaatgaaatatgatacacaaaaagcaatagaatctctggtgattgtagaacaggaatactttaagtctttttgaggcagagatagaaaagatgtactcttgagttcccttctgtttttttgctgggggttataaccagataattttctcttgcaaactctggtcaatcttgtattttgtgatgaataattaaaataggaaatgaatattttgaactttgagcttcacttgtcagtgagcattggactgggaataaggaaagcagtttattttctgctgtcacctttcaaccattccttatctagtttcgtcgtaggtgtggtatcctgactctttcacaaactccctgagaatggcctagtagattgatgtaaggtataaaatgtttggaatttgaacaaatgaaagatgttgaagtacaaatgacatttaaaaaatatgtcagtgacattatgtatacattaaaatttttcttatatgtgcatattgctagatattgctttctcctcctccatattttgtagatgttctgtcggtatttttatcttacctgaatgacatgaacagaaatgttgcatcgtgtagaagtctttttttgttttgttttgtttttgtttttttgatatggagtctcgctctgttgcccaggctggagtgcagtggtgtgatctcggctcactgcaagctctgcctcacgggttcacgtcattctcttgcctcagcctcgcaagtagctgggactacaggcacccaccaccacgctggctaattttttgtatttttagtagagatggggtttcaccatattagccaggatggtctcgatctcctgaccttgtgatccacctgcctcagcctcccaaagtgcgaggattacaggcgtgagccactgcgcctggcctgtgtagatgtcttttcctggatatcctccagcttctagaagtaccttgtgcttttctttctcagccatacagcttccttgctagcctgtttaaccttgtagtttgaacccttgtaactctattatctcccaggtttatgtctcattttctgacaaggaaagatctaataataatactttaggttacttttcatctttcattaaaattatcatgcctttgatttaatttaccataaatatggataaatcagagcctctctctgtaagcctgaattatcttaatgagagtggatgagtggatgaagcaaaaatatttggcacttgggtaggacaggtgaatatttaattattttgacacactttgggaaaaagtactctgagctccataaatgttgttgttctcccaaccccacctattttcaaaagcaacattgttagccagaagaaaaataaggtcagataataccttattgttatctctcttaaatttgtcattctcagtttaattctcagatacttgctcttgtactagatggttgggaagttttctgtgtgttttcaaaacatgaaaaatgccttttttttttttttttttttgagacggagtctcgctctgttgcccaggctggagtgcagtggcgcaatcttggctcactgcaacctccgactctctggttcaggtgattctcctgcctcagcctcccgagtagctgggattacaggcatgcgctaccacgcccagctaatttttgtatttttagtagagacggggtttcaccatgttggccagggtggtctgaatctcctcacctcatgatctgccttggcctcccaaagtgctgggattacaggcgtgagccaccgcgccgggctgagagatcttatatatatgttcacccattttgtcctgatggtaactgcacatgcatatttaaaggtcatggattatataaaattatatgtaatttgtatatgctcgtaatataaattttaaaatgttacttttcctagttatgaacagatttaaattctccatgtctgcacagacatcagacttcaatatttaccaaattattatttaatatttaccaagccgttttaaaagttattgaccatggtttttcagagaatatcacattcatttttttttttagcctccaagttgtttgagataaagcactttaaaatctgtaaatgttgcagtcactggaaaatttatcccaagccacaagaattcattcatgtaacattaggagagttgtcatcatcttgacgtcatttatgatcttcctcacatttcaaggctgttactgcattgctttctagaagatcttcagaggccttcttcaatggcagctactatttgtaatcactctccagaaataagtattaaatctgtgtttaaaaccgaatcctcccctttttataaaactagtttgttgttgtaaccatgacaaagtatccaatattagagttggcttgacatccttccatacctcagtgtccctgactagtgatgagaacttcactgtctcagccatttcacagactaactggagagatgcctctgggactgggactctacattcctcttttgaaatcccaaacaccattcctttccctgggcatgactgcatacttggatttctctttctcacttccaggttttttttgaagctttttttttttttttttttttggcccttgttagtatttagtataaaataattggtgtctgcctcaaaagtaaggatttaattgtaaagcaattccttctttctgaaagataactttagggaagaaaaccttatcttatgtttggggatatatagtgggacagttgcaatcattgtatatattgggtgtgttagagttgatagcctcattaagtttctcttatgtggaaaaattatttggcattttaattcacttcattgtttttttttttctccttttctacaggggctttcattcatatattttaatttttcttgttcttcttttgactagtttattgatggccatgcctcatcttgtctgtaattgttagatggtgctggactaaactttcagtaatatatacagggccacagatgataatgggactagttttacatctatacactataacttttagtgcaagtacttgaaacacacaaaaatcgaggcattttgctctgctgtccttgaatttgggcataaaatgctaaaaccactgctaattacagtaacccacttggaatctaaattgttacattaaaattagtttttaaagtgagcaggatccatattgctacattatagaaactaatacccttattaacagctccatcttctccattgtaatatttccttaaaaagaaaatttgcagacatggtctgaatgatttagagtgatgtgtaacagtttggacaggctggttgcacccctgaaagcctcctttgtcattgccagctaggatgtcatctgtttgaactggtctttttcgtgtttgcctagggtgagtagagagtggtgatttagtagagctgttggctgcttcctggctgctgtaggaagttagtttttctggctatatgtgtatgaggcgggaagcagattgttaggagtctttaatattctaattttacctctgagaaaactgggatgacttagagtgtagtaggtattgtggtttgtttttcccttcctttcctttaccaccccactcctcgccgccttctccttctctttgtcctcttacccatccctcccctttcctcctttgtctggattattagaagaggttgaattcagaaatgtgactaatttttacagattgtgtttttacagactagtttttagaaatgtgacagtttttacagattgactcccttcactgaagaaggaactttctttgtagtctagatttttttagttttatgatacatgtctagtgtagagaagttcagggaccataggactggaagagcttggtatacttacgtgctggtactgtttttttttatacttttctctatttttcttgtgccctaggtttttccttccagttgggttaaaaaaaaaaagttgttgaggaacattgatatggtgaaagagttgttttttatttccatatttatattaaaatagttttttgcatgtgtatgtttctctgagtggggagagatagtagtcttgtgtatgtgtcaggaaaatattataagatgtttccagaattcccagaaattaggactgttactagaattccccaagatgaattagcatgaaggctaatttgtcattaaaacattgatatccttcaaaattgaaaaaaaaatttagaagaaacatttaacaacataatcatttctgccatcaagtaaaaattaaaaagtacaacagtgttggccaggtgcagtggctcatacctgtaatcgcagcactttgggtggctgaggcaggtagattgcttgagctcactagtcagagacctgcctgggcaacatggcaaaaccccatctctgcaaaaaaaaaaaaaaaacaaacccacacaaaaattagctgagtgtggtggcatgtacctgtagtcccagttactttggaggctaaggtgggaggatggcttgtgcccaggaggcggaggtcacagtgagccgagatcacaccactgcactccagcctgggcaatagagccaggccttgtctcataaatgaaatataaaatataaaataaaataaaataaaacgttgttggcaaagatgtattcaaaatagtatgtagaacttacctggaaggtaattttgcaatatttaccaaaatatactttttcatctagtaaggtctccttctcagaatcagtcttaaagccattcaaatacagatttatgattaaagatttaagtccaaaaatgctcattatagcaatatttataataggaaaaattggggaaaaacaattatacatccaacagtagtaagagtgtgactacattatagtattagtatgtaatggattgtcacagagcaacacacatgtttttgaagaatatttaaggcgtgataaatattaaatgtaaatgtaaattgaaaaaatgatatctgtagattttcattatgcatttctttatgaaatttttgtatatacacaaaagaaaatagtcatgcattgcttcatgacggggacatattctgagaaatgtgctgttagtcggtttcattgtggaaacaaatgttgaacatcatagagtgtccttacacaaacctaggtggtatagcctactccacacctacactatatggtatagcctgttgctcctaggctacaaacctgtagaacatgttactatattgaatactgtaggcagttgtatttgtgtatctaaacatagaaaaggtgtggtaaaaatgtggcatgaaagataaaaaagtgtacacctgtcccaggcacttaccatgaatggagcttacaagactggaaattgctctgggtgagtcagtgaatgagtagtgagtgaatgtgagggtcctaggacattatgttactgtggatgttataagcactgtacacttaggctacactaagtttatttttaaaattttctttaataataaattagctttagcttactatagcttttttaccttataaactttaaaaaaattttaaactgatgactcttttgtaatcacacttagcttaaaacacaaacacattgtatagttacacagaaatattttcattatatccttattctataagttttctttattgattgattgacagagtctcactctgttgcctaggctggactcaaaagtcctgggcttaagtgatccttccttctcagcatcctgagtagctgggactacaggtgcatgccaccaggcctggcacctttatttaaaaaatattttattttttgcttttaaagcttttttgttaggccccagcacacagacatgcacacaattatcctaggcctgcacagagtcaggagcatcactgtcttctgcttccacatcttttcccactggaaggtcttcaggggtagtaattggtatggagctgtcatctccatgataacaatgccttcttctggatacctcctgaaagagctgcctaaggctgctttacagttaacaactacttcttcctcttctttttttagtaagtagaagaattacagtctaaaataatgatataaagtatagtaaatacacaaaccaatcacatagatgtttatcattttttatcaagtattatgtactatacataactgtatgtgctagacttttatatgactgacagcacagttggtttgtttactgtgttgctctaacactacagctatgatgccattaggtgacaggaagtttttggctgcataataatcttatgggacttctgttgtgtatgtgaactgtcattgatgaaagtatcattatgcagtgcatgactatatgtaatgtgtatatatggtatgaagcataataaaatgaacacctgtgaacataccatacaacaaccaatactgtaaatataataaattctgaattatagatatctatctaaaaaagtatttcttattttggggaattataaatgagttttagtttttactttttgtttttttttctacattctgttcaaggggtatgtattttcaaaaccagaacatactattaaacattattagaaaaagaaaaaaatttaagcagatttctcactccgtgtcattagaaagaaacttttaaaagtgtctgccacctgttatattctgagtgacagatcatggccagatacataggatgacgttatctaccagccataggtaatgcattgtgacagagctccagaaagatgacaggctgacagccacaggaattgtggagaacctgtcttctagctggtgtttgacctctacaaaatacatttcaaatatctacttaagtgcttttttttttttttttttaatggttcaggccttcaaaagagattttatttcttcatttaacaagcatttattgggtacctgttaaataccaaccaagagtgaccaaaggagtctttgctcttatggcacttacattctagtggtgaaagatagcaggcaaacaggcatgtggtgagatatcaaagaatgatgtgaaagaagaaaacaggaagaggaactgatttaaattgggtggtcaggccacaggagttgtagctcacacctgtaatcccagcattttgggaggctgaggtgggaggatcacctgagcccaggagtttgagatcagcctgggcaacaaagtaagacaccatctttacaaaaaataatggactgatgtgtgcctagagtcttatctgcttgggaggctatagtgggaggatggcttgagcctaggaggtcaaggctgcagtgagctatgattgggcactctggtctgggcaacagaatgagacccagtctcaaaaaaacaaaaaataaaaaaataaattgggttgttgagggaaggccagtgaggaggtttgaactaggatatgagcaacaagaaagagacagcattacagtgatttgggggtacagggaacagcatgggcatgagccctacagcacagtcagagaacagagaaaaggcaagcatggttgaaatgtggtgaatgagggggcagaatgataagagagcaagaggggaagtaggcatagtcagatcacaaggagacttccagacttttttttttaaaaactttctccaggtaaaaagtttggattttatactcaataggaaattgttggatagtgttaagcaagaaaataacacgctccaacttgttttaaaagatgaccatagctgctatgtggaaaaatcattgtatagggtcaagaatgggaacgagaagaccaataaaaagctatttacagtggcctaggtgagagttaatggtggccatcatagaagcattaaggaaggagaggaatacatagatttgagatctatttgtaagtagaactaatgcatcttgctgagtgttgtatctgtaagactacaggaaggacgggaatcaaaaatggtttctgctggacgcggtggctcatgcctgtaatcccagcactttgggaggccgaggtgggcggatcacctgaggtcaggagtttgagagcagcctggccaacatggtgaaaacctgtctctactaaaaaatagaaaaattagccgggcgtggtggcgggcgcctgtaatcccagctacctgggaggctgaggccggagaatcgcttgaacccaggaggcggaggttgcagtgagctgagatcatgctcctgcactccagcctgggcaacagagctacactccatctcaaaaaaaaaaaaaaaaggtttctagatttttgatgtgagcaactgggaagaaggtgtttcccatttatatgagtggaaaagatgggtcaggcaaatttgtgggaaatactgagaattctaatttgaaatactaagtttgagtcaaacgttgagatgtcaaataggcagttagatatgtgagtttggagcaaggtaaagagatttgggattgaaggtaaacatttttgcatctttcgtgtatagatacagtattttaaaaccatgaaagtgtgggagatcactaccaaatgaaaagtagaggtaatgaagactgagtttctggacctccagttaagggtctttgcaggggaggagcagtagcaaaggtggctaaatgggagcagttgtggtggaagagggttgtttgatctgggatttgagtgacatgaaggtatgtgaagagtgttccggaaagaaggatggatctagctgaatgctactgagagggaatatgctatgatcagatacataacccttgtatattagttttctgaggctattgtaacaaattaccacaaagttggtgacagaataatagaaatttattttctcaaagttctggagactagaagtccaagatctgggagggcttccttccctccaaggtggctctgagggagaatccattcttcacctcttccagcttctgggggctgccccagcattcctgggcttgtaaccctgttactccagcttctgcctccatcttcatgtggctgtttactttgggtgtctttctgaattccctttgctactcccttgcaaaaatgttctttgcctctctctcttgtgatgtcatttagggttcacctggataatccagggtaatctcatctcaaaatcattaattaatttggaaaggaccctccaccccctgagtaaggtaacttcgggattaagacttgatatcttttggtagccattattcaacctactaccccttggttttagaaacgtggtacccattggagagctcaataagagtagtttcactgctccagtgaaactttacctttcatgcttactgtcaaaaagagagctctgttgtctgttccaagaccatgcaagttgattacactgctttttgttaggtagcgagtagttgtatgcctgtgattagcttcaagtttcccatgttcaacatgagaaaggatcaaagttcccggaagtctctgccagttcttttggattcagtgttcttgacccatgtgatccaagctggcattgtttagaatgaccattatttcggtagccaaagtctggtttattttagatttaaaacatctctgttttgagtaataatatcagtagttatattatttcttttataacctgattgacaaccatgttgctgaaaaatttctatccagaatgtggaatggatgtcatttaggtaatacataggtatggtaggcattttaaatacataaattatctgaagagagatcaagggactctgagaaaaaggccattttgccatttttttaaaccaggtttctgaaactcagatgttaaaactggcacactggttgccaagttatcctctgaaggctttccatgattcctgctgggcaattgggagtagcagaagttatatgagttatatctggctttttgtggcattgcgtggacaagagatagtgaccgcatcagaagggcgcctgattctctggcagggaattctggccccttcagagaagttgagtggagatgagaggggaggggacaatcccaatattccaacaatagagaatgttctgcaaactacagatgtgtgtatactgcatccatactagtcatctctttaggatggagaggcgcctctagttcaagttcagttagttaaaacaggcatgtaggattttcttcattctcacttcttccttgcgttggaactgaaatgactgggaatcttgggttgttttcctatatgcctgcagggtcagggagagcagaagttgtgcttcttctagatgagaagctttactttctcagggaactgacttgatttccatagacattctcacaaaccaccagagtgctggttctggactggtatatgcccctcagcttctatattggggcagaggccgaagtttggcatgatgaatagaatacaggtgttggaattagaccagattaattcacttactagttctgtaatcttcggcaagttacataccctcttgggacctctgttttctcaatggtaaaatggggttgaaggtatctggtattgtgcctgccacattataggcatgtaataaatgttagatgctaccattaacacatctctttatctttttactcatcttattcacttgttgatactcaattttcctcattgctgttgtgtttatattaagcaggattctaaaggaatatctacttgttgacagcatcttttttgggaaagaaataatgaccccctttcccccatcttgtgacaattgctgttaggtctttggttccagcacatggggcaaacaatcagcatcagagaatacttcctgagggaggcttgctttaattgtaaaacatagtaaagagggcaaaagaaggttggcttattctatttttaggggcagttctggtcaaaggctcaaatcttgggaatggagttgctgaggaatgaagttttaaataggtcagcttgcctaacgtagagcactccaggaggtctttggaaggaagagctgttaagaatgagtccgcttgggagaggatcaggaagggaagcagcggtgagatgaatgtaacagaaaagtcattattatttattattactattttttggagacagagtcttgctctgttgcccaggctggagtgcagtggtgtgatctcagctcactgcaacctccgcttcctgggttcaagcgattcttgtgtctcagcctcccaagtagctacagacgtgtgccacctctcccagctaattttttctatttttagtagacatggggttttgtcatgttgcccaggctggtcttgaactcctgagctcaggcattccgcccacccctcagccttctgtagtgttaggataacaggcgtgagccaccgtgcctggccagaaaagtcattattgattgcccaccatgtagtccctagggtgctgtgctgtcaggtgctgtgttgtgaacaaaggatgttgggttggcctttggagatagcttacacccaaggtcagatatttttctgtagttcctagctttgtgacctagaacagtctgcccacctatgtaatggggatgagactgtatgtctttgatttctaagacccccttctaagttgaataatgccttggcagaggaaggggtaacatagtgttccattattggaacactaagcatgtgggaattatttatatcctgctcaaggtcattgccctggtctcactgcaaaaattcaaaaaattccaacctctggcataaacgggttaaattattcatcgcttgtaaccaattctaaggtatttccttgttacagaaatgctaatgtgatttttttaaaagtgcgttttaaaagcaaaacaatatggtaatacccatcttagtgatgttgggacgattaataagataatgtatgcgaaatgcccatccaagttagtattcagtgaattgtagctattattaatggatgaaaggacatgaaaactaatttgattggcgtatctgaagaaagaattttaaacaagaaggtcataatgtgattaggatctgaaataggaaagatcaaagttcagctaatgttatagagataaatgactgtgtatatgaggagaaagttttacccatttacgaagtatttgtgataacttcatatatttttctgtatgaaaagagggaatgtggtaatcatgtggtttaaattgactcccataccatcttctgggcattttataatgtttctgaacttgctgctatataagctgctaatatacgcaataaataaaagcaaacattggctaatttacaggtaaaaaataaaaataaaaaccaagtgtttatatttttgttttttttttttaatttttattttgttgaggggggagtggtggctagctagggacttgttattaatttatcagtttattagttcagttgcctgaccagaaagttctttgcctacgtttctgacatcttatgttttgattagagtgatatggagtttttagctcttctttctttcttttctttttgtttgccccaggtccagcaagactatgaatctctgttccaaatgctttgctggtaagtgcagaaaaagggttttttaatttactttcatttttctttctttttttttttttggttctttttaagactaaatcatttgaccctaaaggatttatgcatggggttttgttttcttagcttgtgtgagaaagcagtttcaccttaccaaggtgcttcatatatttgcctaggacggttgaaacagttttccttgaatgaaatcctatctcctatgtacttgcaccaaacaaactttccttggtttactgttgttggtatacagtagaactgtaaaaaatgcgtgctcatcttgacttgaatgattattggttaatgttgctctatcaatgagaatgtaacagaatattttcatgttggagtcaggaagagaatcaagctgagttagcccatcatcagatccatcatagaggctgccatggtgtctcacgcctataatcccagcactttgggaggcagagacaggaggattgcttgaggccaggagtttgagaccagcctgggcaacatagtgagaccttgtctctataaaaacaaaaagcctcctgcagatccctcattcaaatcacctcgggtaagtcacgtaatctctttggaccttggattcatcattataaaatgaaggacttgggcttgacatgtgccaaggtccttttctagccccagaggtaattggttaacttctggaattatgactccttcatgaagttgaaacttttaggtctttttatttttactttttaaaaaactttctatctagcgatcctatataaataagtctttgctaattaggatatgtttaactttccttctttattcattttgtcaaaggtaaacaaagctgcatactagctaaagttctaaggacaggttttagtcagtaatacacttttgcaatagggaagagagtccagtatgaaatgaagtcaatgttgatttgcagagatgactgggagttttaaagggagaatggcaggggacttggcagggtggataaacggaatctgtagactcaaagaagtgaagaatttaaaaagattggtaaaatatggtgattaggccagctgtgcctgttagctgacactgtgactggggaatagataccctatttttcctgatggttacatttttaaaggaatggctttcaggtccttgagaaagacactcctgagttgtaggagtacagctcaaagggacagaggaaggattcacagttgtaagccctttttagtaaatgatctaagaggatagttagggcctatcttcagatgctggctagaacaaacagtagattctttggcagccttgagctttaagaggcagacaatttgagagaggctagggtcatcctagggaggtaaccttgagctgttagaaatgttagtatttaaaattagctggatgtggtggtgtgcacctgtagtcccagctactccggaggctgaggcaggagaattgcttgaacctgggaggcagaggtgcagtgagctgagattgcgccactgcactccatcctggtaacagagtgagactccgtctcaaaaaaaaaaaaacaaaaaaaaaaccaaccaaacaaaaaaaagaaatgttagtgtgtgtaagtcttttaatgtgaaaggagggagtggaccaaatcatttgttttgagagtctgtagtttttaaaggtccaggttgaggcctggtccagaagagggctcagaggaggctggctagatttttattaaagagattttttttgttgttgttaattttaatctattcattatgctatttgggcaaggaagtaatcatggtgtaagctttagaccgttacatttgtgcctaaactaggggttagatgggaaagaattggggaagctgacagcttttataggttcaaaatttggaatttgtcagatacttaggtttttaaaagaaaagaaatattggtgggtttttattcagcttttagcagtatttgtgccatgttaaaggactgtattcaggccgggcgcagtggctcacgcctataatcccagcactttgggaggccgaggtgggtggaccacgaggtctggagagcgagaccatcctggccaacatggcgaaaccccgtctctactaaaaacacaaaaattagctgggtgtggtggcccgtgcctgtaatcccagctactcgggaggctgaggcgggagaatcgcttgaacctaggaggcggagtttgcagtgagccgagatcacgccactgcactccagccagaacgagactctgtctcaaaaaaaaaaaaataaataaataaaaggactgtattctgctgcttaccttatgtatctacaattacagatatgaagaaatgcttcttcactgatgaaaggttaactttatagtgaagacgaaagtagcagtgagacaaaatgtatacaggttgagaaccccaaatcccaaatctgaaatgctccaaagtgcaaatgttccaaaatctgagaaaaacaaatcccaacacttctggtctcaagcattttgaattaggggtactcaacctgtattagattatatatttgtccccacatggagaccccattgtaatttagtaaagtatggctttgggagaaggccagacacctttgaataataaggtggttcacatcaaatactcctgaggaactatcttgtgcccctaaatgaatacaaagttaaaaaaattttaactatgaagctagagttcagccatgggctttgtgtttctttggacttgttacagttttactttctgtgtttataattatctgtctcgtgatctgtgtctatttacattttatacagccttgccatttttgcttttataaaaatattaggacattttcaagtatctaaagaaaatattcgcttctctctatattttttacctacacactactgctttctccagttgcatttgcgtggcatgactagttaatatcctgtctgctgaaacagaattttatgtacctttagaaattcaaaagaaaagagatcattgaactttaaaaatacatttttggatgtcatctcagtatgaacataaggagagtatagtgaatgcagtattacagaagagccatgagttttacaagacaacataaagattattttggccaaagccactgtgatcttaaaagactctttttaaagtatattgtaaaatgtacagtgtactttaaaagatggaaaaatcactttttaaatagttattgtttgccactaggttaaacattttcttttcaagattccttttcaaaatctatgtggtgaaaaaattagtttgttataacttgtttacataaaattgaatgaaatgggaaaaacatctttaaagtcttaccgagagaatacgttgtaggttaggaactaggggtgtgtgtgtttacttggagaactgttttgctgctggtgaaatattctgctaagtggtgagcacacacctgacccaatagccatcattacttaagctgtttctcctttataaaatattcttgggatgtttgaatttagaggaaaggaataagaaaggagaaatgagtatatgcagagtgacagttgctaaaagccattgaaatgttagttgctggtaaactatataccaaattataatgcttctgtgtattgttagaatgagaaatgtttgtatcagacctttgcatgtatgtggaagagggcccaacctggctgggctggatttgctaaagactcgaagctcaaccaaaattcctctctttgaaatgagagaggtttttttgtttgtttgtttgtttgttttttaaactttttgacaactatcttatcattaaccctggtttggcctctgttacctttaaaggctaaaatcatttaagactgtttaaaggatctctctctctcatttttttttttttttttttttgagacggagtttcgcccttgttgcccaggctggagtgcagtggcgcgatctctgcttaccgcaacctccgcctcccgggttcaagtgattgtcccgcctcagcctcccaagtagctgggattacaggcgtgcgccaccacgcctggctaatttttgtgtttttagtagagacagagtttctccatgttggtcacagtggccttgaactcctgagctcaggtgatccgcccaccttggcctcccaaagtgctgggattacaggtgtaagccactgcgcccggcccttttttttttttgagacggaatctggctctgtagccctggctggagtgcagtggtgccatctcagctcactgcagcctctgcctcccgggttcaagcgattccaaaggacttttcttcacaaagacatttaagtatacttctttctcagtcttaagagaaaggccttgacctagaaacctttatcatccaatattttctatgccaggataactacgacacttacagttaagtattctggggaagtaccaggaagtgattgactcaagtattaggatttgaggtaaagtggacttaaattgctcatctacattctctttatctgaggtcatttagtctatttaaaaaaaaaaaaaaaaaaaagtccagacccggtggctcacgcctgtaatcccaggactttgggaggccccaggtgggtggatggatcatttgaggtcaggagttcgagactagcctaaccaacatggtgaaaccctgtctctactaaaaatacaaaaaaattagctgagtgtagtggtgcatgcctgtagtcccagctactcgggaggctgaggcaggagaatcacttgaacccggtgggtggaggttgcagtgagctgagattgtgccactgcattccagcctgggcaacagagtgagactctgtctcaaaaaaaaaaaaaaaaaaaaaaaaaagcaaaagttaatcttaccatactatattctctccattcctgtaagaattcctatttgttatttttctaccttccccgtcagtccccctttcacatattctgtattttcttttctcaaattacaattcagtacatttgtttggaaatgtggatctatatctctcaagtctaagactattgtgtaggtagagaagcctgaaattcctggagtttgcataaggaccttttagttgatatataattcttcccagtcaaaagtgttgattatttttatattattgctaaagaaaggttttgcttaacagctttgcattttgaagttgtggagactttctaaactattgaaaaggatggtatgtaagcaccctgggacatgagttatcaattgattttgccacaaatctttccaattatcagagctggtctgaggatctcttatggcctaattttggcttttcttacccccttgataatattctacctgtcacactgtcctttcattaaatatttttatattgttttatatatgattttacttaaataagtaaatgaatataaaaagcgagaaaattttatgacatagttatggcaaattaacatttattggttgaaatactacctcttaatgcagtttttcaaactgggtattgtcactcattagtgggtagacaatttaatgggtcatgattagtatttaaaaaattctgagtagaatagaaaatatcagtgtattgcacatagtaaagttattttgtgaaacctttgtttgacttgcattgagttgaaaataatgtgtaatgggttataatgtaaatatgtgtatattactattatgattttaagtttgaaacccagtgaactgcaggagtatggctttggaaaatcttggaatctaatttgctttgtaaaatagggaatatttcatttgtgtcttcaggcaagaggttaatagttgatttcttgtgatctttgtcagttctgagctgttgagtagtttagaaatgaagcttaaactagacccgatagcctactacagtgttaaaatacatatgaaaagtcaagcatagagtctaatgaatattcctgcctcttacaaaggtagaaatgatactgcctatggtatttttttttgtttgagtgcaaatccaattcatgaatttgtgcattttagttgaccagtgtttaatatttaggaatagttagtacctaattcatgatgacctcttgttctagcatactgaaggccagctatcattaaagcagtgcttttcacagaatggttttgctgacctcctaaatagaagtgtggatggcagaagcatcaaagaggatgatcacaagtggggaaggcagaaattttaaaagaactgactgaagtaactcctctactaatgtgacaccatctctatcccccacaaacccttggaaatactagttttgggagaagagaggagtatggtgactagaaagtagctataacctgttgatcattgtatactttataaggcagtgagtcagaagatatgtttaagaaatggaaggttgttggagtagctctgatgacagatgcttatcataaggcaaacttaatatatgttccacagtgttcagaataccacttggtcggtggacttttaaatgtgtgcatacttaatttttaataaaccgtagacatggtatatttaaacatactgtttcatttaagactaacttttaagaaatttgctatcacgtggttcacatatgatgtacaagtgtatagttgcatgagataaagctggaagatgacatgaaaaatttaattgtggtagtctcagagtaagagtaattggggagctttaaattttaattttgtctgtgttttcagatttaagtattaatgtaattgcacaaattacaaatgtttaaaaagtgaagtgaatttatacaatctagaagtggtttgtttctttctggaatgagcaaaataaaattagctatcgcctgcagcattgggaatctaagtgttgacatctaaggtgagtgatataacaatgctgggcgcagggtgaaatggtagataagccaaaatgctaacatttttcttgaaagtgacttgagtttcatgatagttccagaagaggataacaaattcccatttcataccaagtaaattaaaatatttccttatgaacttgcaacttagtggttgcagttacatactaatctctttcctgctttcatttcctgttagaataccagagtaaaagtggtctgattctagtcacttttgaaaagcaaagagttgtaggttacagctgaattttgaggctttacagtaagagaaacagagtgagtctgacaaattttaagctcatatattttccttttagaaatgtaggaactctgcacaaataatgtagaaacaaattaccaatttcaatacaaaaaattttgcaggatagtggaatttgtaagcttgtcataccttgattttttgaattcaccttttcccaaaagaaagcaactgttggccaggcacagtggctcatgcctgtaatcctaacactttggaaggctgaggtgggcggatcatgaggtcaggagatcgagaccaacctggccaacatggtgaaaccccgtctctactaaaaatacaaaaattagctgggcctggtggcacatgcctgtaattccagctacttgggaggctgaggcagaagaatcgcttgaaccagggagtcggaggttgcagtgagccgagatcacgctgctgtactccagcctagcgacagagcgagactccgtctcaaaaaaaaaaaaaaaaaaaaggcaaaaaaagtaactgctgctcttaagacgaagtgtttgaatagagtatttctgtttttgtaatctttttgacttgattgcttttgtatactctttgatttcttctaagccagacgcccaagagggatttctcgtgtaacacacacacacattttggtcatgtgtttgttaaaaggggacagctcaacttaccaggctcttcttaaccattatgtgtctgttggtaggtatctgttggatggttgggtgtctgacattcagaatatccacaaacccacccagaagtaacaaatgttaatgttttgccttttttcttatcacactaaaaagggcactaaaatgtcacagttttcttttaccctagtcatcatcttcccaactcagagacaactactctccttcttatccttgtatttacactttttattatgaatgggcatttatataaatattgttatgattctgtttttaaaatgtttaaatggtattttgtactagtctacaacctgtattcttttaaataatgcttttagaaactaatcatgttgacacgttgctcttgttcattttaactataatattccattataattaatgtctagatttacctagaacaatctccgtttatgcattttgtgccagtgaaaatactaatagtacctctttgtaccaaactggtactattgtaagtgtaccaatttgtttgatacattaattggtcaccttcattataatgtgccctaatttatttatctagtcccctgtagagggacatttgttttcagtggccatttttataccacagttgcaatcctgtgttttctctctctctttttttcagcacttgcttgactatgttaaaagaatgtttctgtaggaaactctgttctttatggtgtagcctcccttactctgaaatgcaagcaagactcgggcaacagttccttaacggattagcagtgctggactgtggcagccttttctaatctcttagtctatagcagtttgatgtcttactaataagcattcttaaattgtgtggttaattattatgctagtcaagatacatgaagcagtgtgttaaagatgatgatgatgatgatgttatggaaattatgtcaaaaataattgttgcatttctaacgggaaacagtgctcagtgctgtgaaatagctgagaggtggcttctttcaggcctcaagtgggaaaattgtgaccatgtgttagagtatgatagggaaaatggaagaaatttagtagttactaggtcttttaagatagtttagtctgtcacttggctttatttcttccctcttgttggtctaaagctgtagtctctttgtggtagacaggattatccattgtggcatagagagaaaatgttagaattcctacttgtgtttatttttgtcctgtatacataatctcattggtatctgtattagtttcctagggttgccacaacaaattgccatacacttggtggtttaaaacaacagaagtttattctctcacagttctggaggccagaagtctaaaaccaaggtaatggcagggttggtttcctctagaacctttgagggagaattcattccatgctgctgcttgtttctggcttgtcaatagttcttggcattcctttgctcatagacatatcattctagtctctgcttcatccacatggccttctcccctgtgagtctctatctttccctcttctgtctcctctaaggacagttgtcattggctcagtcttatcccggattatctcatctggaaatccttaacttaattacatctgcagaagctttttttcccaaaattatcacattcacagattctgggtggacatattttgggaggtggggacagggacagggtgcatcattcagtccactacgggaatatgtaactacttttaaaacagaaatggaagagatgtgcactcaaattttatgctgatggtacacctttatcaaagcttggagacttctagtttagagaactgtttgggttggatacagttggcctcttttcatgtaattagacgaccctctgtgacatgaaaagtagtataagagttaaggccaggaacggtggctcacacctgtaatcccaacacttcgggaggcttaggcgggcggatcacgaggtcaggagtttgagaccagcctggccaacatggtgaaaccccatctctactaaaaatataaaaattagctgggagtggtggtgcacgcctgtaatcccagctactccggaaactgaggcaggagaatcacttaaacctgtgaggtggaggttgcagtgagctgagattgtgccactgcactccagcctgggcgacagagcaaggctctgtctcggggtggggaggcgggcagtgtggggagttaattggtaatattccctatgtttcatatcctcagtagactaatacaggctactgtatcagaatgaccaggcttaggtttatgggctcccttttagacttgtcaggaatatggataactttcagatagactcagaaaagcacgggactgttttgtgcttcagaggctttggctccaccaagtttcagatacttagcgtaattcttgttctggctgttgcctttgtgtgtgaattagaagattatgatgaggttgctttttgacatttttcctggatataatacccacttgtacttaattcttagtccacagtagggatgatgagtaaaaagatgggacattatttttgggccattaatgtatgactaaaatatcatctttcatgctataaaattttataccctttaaaagcttcagtgcttagctggttcttgcagtgtaaagtagatctaactgtatgttaacagtcttaactattttttttttaatttataaagaaaagaggtttgattggctcacagttctgcaggctgtacaggaagcatagtactggcatctgcttctggggaggtctctggaagttcccagtgatggcagaaggccaagcaagaacttgcatatcacatggcaaaagcaggagcaagaaagagagagtgacaattttaactattatcaaaggttgttttacatttcttaatttacttttaaactaaatattggggagagagaagaaaaaataccttaagacttccggcttgaagaaaaagaaaaatgacacataatcttaaatggagaatgctgaaagacagatattttagtagtggaacaagaattagtttttgtgaaaaaagagaggaaaggcatagacaattacatgggtttttgtttgtttttgtttttaaaggcagtaaaatcctgaaatgaaataattgcaattgtaactaagattgctgcagcccttttatattatgaagtcctttaatacaatattatcacatttgattcttacaatgttggtgattttatagctccattttacagataaggaaactgactcaaatgggttaactcatgttcccaagattaaataaattttaaagaactgagatttgatcaatggaagtttagacttggatctaatctccactgtttgatgttattaggatgaaagtagtagacttagatggaattgtactgtgaaaaccaaagctaaatagattagtcgggattgtactgtgaggatgtaacagtaacattgttttgcatttgtgtgtaggagtattctcttttcttctgctcttttcttttagttcagttgtagtttgcctctagatcccctcataatcagagaaacagtgctgaaagcttcacaagagtagctaatttaggaaaaggtgtgcatatgtggtggggggagtgtttttgtctaacacattttctgttttggtggtgagatcttcatttcttaacatctttcttgttcttgttcatatgacttttagctcattaaccttgctctctgtgctgcgtagtgaagcaccatttctatttagtctcctgtgtttagcttctcagaagaatttttttgaaaatgtttggaagtgtgatttaattgcaaggctgtttgcacattgtcagtgtgaaagcaaagatgaatttcgtatttagactgtgcaacctgcagatttcatttgttaaaccttccagttggtactcccgttctctcatacatgtgtgcataataatagtatggaaaaaaactcctgttttgttgtatccatatttatcagtttggttgagttatggaaaagcctgtcctttgctttgtgtatttgctcatttggaaaccttgtatagtttatagagacactagtgatttgttccccagcttccctgtgggttttgttccatattacaatctaattccacctctctgtcccatactcctgagctgttaatttgtacatttcgatgccgtttgtttcatcctgtgttttttaatccaaactgaatgtaatgggctgtgtgctttagggacctggctttgccttgccaattagaacaaagtggttactgagtaagagtatgttttaaataaaacatggcacctctgaatggtgctgatactcatttgggaataaaagagatggttttaaccctttgactcacaaagaagagccattataaaagatcatatatatatatttttttttctttgaaaagaagggtaaagtttacctccataaaatgtggttttacaagtttcttaaggtaactaaataaatttaaaagtttgtcattaaaaatgtacttttttccttcatgatcatttgagacatgttagcaaaattctgtaaatttatgaatattgaaccaatggctgctgctgaattttgaatttgttcatgtttaggaaggtgagggtatatgaaaccaatagatatgtcagcctctttttatttttataatatatcaagccaagttttcaatttagtggtgacactccttcccccagagatacttaaaaattatgaaggtgaatgtaagcttctacaatcttgtgggaatattattttcagataattgaattttgagccatcaatgacttaaggctatttggaagtttagctgcactttcaccaaatatttatagcacagatgtttctgaatagaccataggctaatagtttactaattcacgtcatagagagacacttcatcagttacttctgttattgtatttgcatctaccctaaaaatagagttctctttttagctgatatagcagataaactgtaattcatcattggaataaggaaaacataaaacttactttgaagaaaaagtgggactgtatcaaaaactttgaaataaagacatccaagggaaagctagacgtagaaagacttggtgacaggtttagacaacattatagcatgtattaacctatgcaaacaagagagaacaaaaggaatgcatttctgtagaacagttcaattaaaaagtatgtaggagtatcatgttgaaaaaaaaggtttctagaaaaatgatgtctgtagtagaggaggccagttaattggactaagtgaaactaaacataggcatttctaacattgtactgggaaagtcttgcaagccctactgctggtttgaagagacgatcattgtaacagtattactaaatgccctgtacttcagatttgaagattaacctccatattgctagtactttaaattgttcagttttctgagtaaagatattaaagtttaaatgtgcttccatcttctcctcaacactgttttaacctgtagctaaactgacagtccaggagattgaattttgtttaaaaatgtttgatatctgtagagaacactgtattttccagctttgcataaagtgacagtgttttccttaactcatatgttttaggatccagtagctgttaatttccatgcctgaagcacaaattaatgtcaggaaatctttctcaaaaattattttcatgcaggtcccaggcttccaatggcaactgaaagctgggttattcatttctcctatacctgttactcagtgtgcatcataagtatttgtaaacactggttttgcttttaggaactctagaagtgcgaatcccattaatcatgtgatattagtaaatgatgatcatagaatatttgagtggaaagaattttagagcccttttcttaccaaaacactggtactcagtccaaatgtctactgaattaatgagtttcaaagtaaactgaagtggtgagggtaaagtggcttattatttcatcttttatttgcatacttcaacctcagtttcctttctccttccagtgttacatgctatattagtaatcttgaagatgagactagaaataaatctataacaaagttgcaacaaccctttaatttgtagatactgctttaggattgtatgcctttttctgtttactatctcttaattcaggtgctgttagtcttgcaggtaaacattcattgttctgtagagttgatacagttgtcaaatttttgtgtatttgtgtgtatgtgggtttatgcacatgcatacagttatttagatgtgttgattataatttttaattaaaatttttatttaaatatgacagttggattttatatgagattttataccatatagcaattacaagaagaactaaaacgtccaaaaacactatctgcatcattagtaccttaaagaaatttccccaaacttgatgaaaatctttattatagatttttaaaaaacccatgataaagtgtttcatgttctaagatacatactctgtggaaatggatcttttttatagtgtccctctatcaagtagcctgggtttataaaatatcacagagacaaaattcttttctcaaaatccctacatggccctacaagaggaggagcctaaaaaaagaaaagagaaaaaactgtgtgtatgcttcccttaggccaaaatttgtcttcattgaatgggaaaggcaaaactactaaatcggtttttcttttgtgatgactgaggtcttgtgttttgacctacagcgtatatcacgtggagaaaggtgcttcatataacttgggtagcaatttgagaacttaagtaatgacaatactaagtatttaatattttttcttttgggctgataccagtgggctgggggaggtccctaaatgccagtgggacatcaactctgatcaatggtcaggctcttgacagtgtcttcagtaggaattcaaggatgagttggaaaatagtgaaatgtactaagatttattgcaaaatgaaaagtacatgctcaagaaaggggagtgcgagcatactccagacagggtttggcttctatctgtatgggtttctttaatcaaggggtggagtattcatgaagatttctggaaaaaggtgaaaatttctcaactttagtgccacccatttttacaccagtatgggtgctcccggaactgtcttggcattggtgggtgtgatttagtatgttaatgagcatataatgaggtcctaggtgaaacctaggtcaaatccagtgccatgttgggtccacttcgtcttagctagcttaacccacactctgcttttcagggtcttcttggctcctagcttatgtatgtatttcaacagtttcctttttgctagtcatgtgaaactgctgcctggaattttcttttccccttcaaccaccctgtattattcctgtctcagggcttgggggaaactatatggtattctggaaaaataccacgtggaggcagataattttggacaatgggaaattttgcattggaagatcattgacatagtctttttttcaagacagagtctcgctctgtctcccagggtggattgcagtggtgcagtcttggctcactgcaacctctgcctctccggttcaaacagttctcctgcttcagcctccctgcaccaccatgcccagctaatttttgtatttttagtagagatgaggttttgccatgttggctagtctagtctcgaactcctgaactccagtgatccacctgccttggcctcccaaagtgttaggattataggtgtgagccatggcacccggccgacatagtcttattttagttatcagtggtaatttatttttggacacaccatatggtttaatctttataaagcaaaaatgaatgtcttgtctaaaacactgttttatatagttgtcatataaaatacctgactttgttttagcagactttttccttttttggtgtcaatactctgagtttatgaaaagcacagctcttgcttgagtgcttatcagacacctggatacctgaggcactgctggtcaccacttcttgttaaaatttggtcagtgattctagttgcattataaattaaaattcagagaaacaaccccaccctaacatcagagtggtgtttttggtgtcttaaagggttggtgtggtttgtttagtggctccattgaaaggctgcctaggacttctgtctgaattttagatggacataaatacagggtattcattgtggaggttcagagtgagagaataatggggaatgtaaaagcatacaagtctgttttttaaaaactgcaaccaagggaaccttttcaaagtacactgtaaaggtcaagtgtcttgtatttcctacctgatctctatgtgactgaatggaggctatttcacttctgatttataagatacttaccatgactcaaggttttgtgaacatctgacattattagcgcttttgtcttttgcatggctccacccttaagaaggaaaacacagacctagtttacatttagagaagcccttccctataggcctttgtcgcacagctcaaaagagcaacaaccttagaaaagtaattgggtttttcaaaacacaaaattacaatttttccccccattccttcatgcacactgtaaagttaccaggataccctttctcaatagtttaaaattgtgacctatttttttccccctttttggtgtcctgatcagggttgggggagagggaagcattaatttttttactaatttcccttgaattcaccagtgccttaatttctcacagcattatcaaataattgatgtttatgctgttttggaaactggcttttaacaagtgtttttgctatagcgtgaatgaaccttgacaacattatgctaagtgaaataagccagtcacaaaaagaacaaatactatttattctgcttacgtgacgtacctacagtagtcatattcatagagacaaatagaatggtggtttccaggggctagagggtgggggaactggagagttgtttaatggataaagaaagtcaatttgggaagatgaaaaaaagctctggagatggatgttaaagctctggagatggatgttagtggcagtagttgcacaacaacgtgaatgtacttaatgccactggaactgtacgattaaaaacggttaagatggtaaattttatgttatgtgcacctaaccccagttaaagataatgattaaaatagtgtttacttttgagtacagttttgttctttacacttgccaaaatctttctttgttcaaatttcttttaaaaatctgttaacaggaggttaagtgtgaatatttcatcttgttctgtgacagtaaactagtcatctatagtagagagcagaaaataaaaatatttccagaaataaaactgagatttaaaaacaatttaatttttttccttttcatatttatctgtgtagatgatgccataacaggcataatttatattatttatatgattaaattaaaaagttgtggtggcttagattttggacaagctactttacctgaaatattagtttcctcatttgtcaaattgggggttactatacctccttccctgggaataaaattagatgatatagatgaaatctctttaaaggtattttattaaagtactacatgtatgtagtttgaaaagtcaaaatattacatgtaacaaaatgccctgccctttctactccaagtttccccacatgcagtgattaagaggaaacaatgactctgaattctgtctgctgtttcatctaaatttatacttctccatatttatgattaatatacatatattgctgactttttgatttatcagttgtacacattttttttttaccttgttgtgatatataaagcctttgctttcttataccaccctctcctattccccccaacatatttgtagtgaagttttggttaaatcttcagtatttacttttttatgggtatataaatattatgacattggagcatttagcttagtatttcctttctttttttcccttcctggaggattttccagagatctttctgttacttctatttttattccattgtgctcaagaaacattttgtatgaccctcatttatttattgagacttgttttatgacaaaatacgtcttggaaaatgttttgtttatatttgaaaagaaagtgcattctgctgttgttgagtagtgtgttcttcaagtgtcagttaggtcaggttggttgacagtgttcaagtttccatgtctgttgattttttgcttacttgttctgtcagtaacagagagggatagtgaaatatctgaatacaatcatggattaaagcagttttttcttatatttgtatcatatttagcttcatgtgttttgaagctgtcttactaggtacataaatatttagcatttttacatctttataaattgaccccttcatcattatgaaatgatctttttaattgcagataatgttatttgttgtgaaatttaccttgagattaatttagccatgctagttttcttttggttaatgttcacctggcatagtttttttctttttgttttctttccaacttttgtttttagacttagggggcacatgggcacatttgttacatgggtaaattatgtgtcatgggggtttggcgtacagattagtcacccaggtgataagcatagtacccaataaatagttttttgatcctcaccctccttccatcctccacccctaagtaggcctgcgtatctatatttgccttgtatccatgtgtacttaatgtttagcttccacttataagtgagaacatgtggtatttcgttttctgttcctgtatgtgtttgctaaggatgacttccagctccatccatgttcctgcagaggacatgatcttgttcttttttatggctgcatagtattctgtggtgttgtctgtaccacattttctttatccagcctatcattcttgggcatttaggttgattccatgtctttgctattatgaatagtgctgcaatgaacatatatgtgcatgtgtctttataatagaatgatttacactcctttgggtatttatattcctttaggtatacaaactcagtaatagattgctgggtcaaattgtagttctttgagaaatctccaaactgctttcttcagtggcggtactaatttactttcccaccagcagtgtataagcattctcttttctctgcaccctcaccagcatctgctgttttttgactttttaataatgttctgactggtgtgagatgatatctcattgttgctttgatttgcatttctctaatgattattgactttgagcattttttcatgtttgttggccacatatttgtcttttgagaagtgtctgttcatgtcctttgcccattttttaatggggttatgtggttgttgttaatttcagttcttattgtgtggggaaaactctgtgtttttcctctactctcacaccacagcagtcatttatgcaaagaaaactcctgtgaccaaatgtgtgtgggggggtctctccccaccaccaagcagtggacaccagccaggtatcctccagttcaattctgacactatctacctggaggtgtagtgccagatcccacaggttgagggctccttccccaagactgctccctcctttccccaccagttgcaagcccaggtttccggaacttctgacacacacatcaagttgagattcccacaaccccctctttgggttcgattaatttgttggggctgttcacagaactcagagaaacacgtttactaagaaggatattttaaaggatacagataaatagccagataaagaggtacatagggtgaggtctggaaaggtcccaagcactggagcttctgaccctgtggagatggggtgcacgaccctccctgtacatggaagagttcttcttcaccttcctcttgccctatacatgttcagctatctggaagcttactgaaccctctcttcttgggtttttatggaagcttcatgacattatcatttcttcccacagggtatagggtgggaccctctcatgggagggtattaagacccacaatcagaaaaggtaggggaacatgagacaggaactgtggattgtggatgttggacctttgttgggtgcatagttggcaaatattttctcccattctgtaggttgtctgttgataatttcttttgatgtgcagtctgttgataatttcttttgacgtgcagaagctctatacttaggttccacttgttagtttttgttgcaattgcttttacagtctgcatgaaatctaggttttcttctgggttttcatagttttaggttttacatttaagtctttaatccatcttgagttgattttcgtatgtggtaaaaggaaggagtccagtttcaatcttctagccaattattccagtactgtttgttaaattgggagtcctttttccattaatgtttttgttgacttgttttttttttttttctgagtcagagtctcgctctgtcgcccagcctggagtgcagcagcgcaaacttggctcactgcaacctctgccccctaggttcaagagattctcctgcctcagcctcccacgtagctgggattacaggcgcctgccaccgtgcctggctaatttttttgtatttttgtggagatggggtttcaccatcctggccaggctggtctcaaactcctgacctcaggtgatccacccacctcggcctcccaaagtgctaggattacaagggtgagccaccgtgccctacctgttgactttgttgatggttatagttgtatggctttattttgggttctctaacctgttccgttggtctgttttttaccagtactatgctgttctggttactatagtctcaaggtgggtaatgtgatgcctccaactttgttctttttgcttaggattgctttggttattctggctcttttttggttccatatgaattttagtattgttttcttctaattctatgaaaaatgtctttgtagtttgatgggaatagcatgaaatgtgtaaattgcctcgggccgtatggccattttaacaatattgattcttcctatccgtgagcatggaatgttttccacttgttcgtgtcatctctgatttttttcagcagtgttttataattcttgttgtagagatctttcacctccctggttagctgtattcctaggtgttttatttttatttttttgtgactactatagaaatgggattgcagtcttgatttggctctcagcttggacattgttgatgtatagaaatgctgctgatatttgtctgttgattttgtatcctggaacgttgccgaagttgtttatcagatctaggagcttttggatagagattgtattttcaaggtataaaatcatatcatggctgggtgcagttgctcacgcctgaaatcccaacactttgggaggccgagacaggcgaatcacgaggtcaggagattgaggccatcctggctaacatggtgaaaccccgtctctactaaaaatacaaaaaaaatttagccaggcatagtggtgggtgcctgtaatccctgctacacaggaggctgaggcagtgggatcagttgaacccaggaggctgaggttgcagtgagccgagattgtgccactgcactccagcctgggcgacagggagactctgtctaaaaaaaataaaaataaagattaaaaaaaccatatatcatttgcagaaagcgatagtttgacttctctcttcatatttggatgccttttattttttttctcttgcctgattggtctggctaggatctccagtactgtgttgaataagagtgctgagagtgggcatccttgtcttaattctgattctcaagggaaatacttctagtttttgcctgtttagtatgatgtttgctgtgggtttgtcatagatggctattattttgaggtatgttccttcagtgcttagtttgttgaaggtttttaacacgaagcgatgttgacttttatcaaaagccttttgagactgttaagatgcatttattgagatgttcacgtggtttttctttttagttctgttaatgtgataaatcacacttactgatttttgtatgttgaaacaaccttgcatcccaggaataaagcctgcttgatcatagtggattagctttatgatatgcagctggatttggtttgctagtatctcattgaggatttttgcatctgtgttcatcagggatattggtgtgaactttcatttttgtgtgtgtctcggccaggttttggtatcagaatgatgctgacctcatagaatctgttagggaagagtccctcttcctcagttttttgcaatagtttcagtatgattggtaccagctatcccttatttgtctggtagaattcagctgtgagtcttctggttcagggcttttgctggattggtaggctttttattacagattcaatttcggaacttgatattggtctgcttaggatttcaatttcttcctggttcaatcttgggaggttttatgtttatagtaatttatccatttcttctagattttctagaagaaatgtgcatagaagtgttcataatagtctctgataatttttttttaaatttctgtgaggtcagtcgtaatatcctcttgtcatttatgattgtgtttatttggatattctctcttgctgaggtcccatttctgccacttctccatacagctcttcctgtcagctcaaatgtctgtgggggtcctggggtctcctgcagctaggattctaggtccatagtgagagtgggctacttctcaccaatttaactcaccccttccccaggaacgactgtgggtcaggaacaagtcctggtgctcagcagccccatgcagggttcccagcttccttctcctctagcccagagtctgtgtcctccctctttccactctcggtgactttcttctgcagatctgcttggagtgtgctggtcttcttgatggtctagtctcggtgggaaatattcttcctggctatgtctagttgcccatcttggctcttctcccatttattttttccgtagttttttttcaattcttttaacctgtggtgtttttatatttaaaatgcttttcttgtaggaagtaggtagttgagtgttgctttgacgtgtactacaagtctttaccttttagttaaggcattaagatgattttatttaaatgtggttattggtataatgaagtttaaatctctcattttggttttagttttctatttgtcccatctcttctttttttcttctttccctgctgtcttttcaattagttgaacatttttaatgattctaatgtatctcctttgttgacttatattaatgattaggctagggtgtatcatatatatttaacttctcactatttgtcaagtgatattctattactttatatgtggtataaactttataataatatactttcatttcttccttcctgatctttatgctactgttgtcatacgttttacttttgcataattatctttttttttttttttttttggcctttcttgagacaaggtcttgctctcttgctgaggctggagtgcagtggtgtgatcatggctcactgcagccttgacctcctaggctgaagcaatcatctcatcttagccttcgaataactgggactcaggcatgtggcaccacacctggctatttttttttattttttgtagagacagggtctcagtatatttcccaggctggtcttgaactgctgggctcaacttgtcctccttccttgaccccacaatgtcctgggattacagtcgtgagtcatcacccctggactatagtcaattatcttttaaagagatttaattaagaagatatcatatgtacttgtctatttaataaccgtttctgctgctcttgacaatatagatctagatttctctctggtatcatttcctttttgtctgaagaatttcttttaacatttcttttggtaggggactattggtgataaattctttctttttttctaactttgaaaaaggatttcatctttgttttgaagatattttcactgggtatagaattataaattggcttttcttctttagtattttaaagatactgctccactgttttgtcacttgaattgtttgtgatgagaaatttgttggctttatttttgttcctccatatttaacatatcctttttttctctgggtgcttttaaaattttctctttatggctggttttgagtaatatgattatgatgtgcctggtgtaattttctctttcctatgcttggagttcattgagattttttggacctgtgggcttatacatttcattaaatagaaaaccttttttctattttttaaacacctcccttccctctccccatcacttgaaggagataactgatagttatcccacagctaactgatgctcttatttttttcttgtttctctgtgtttcattttggatagttgttatagcttcatgttcactaatcatctgcaatttctaatcttctgctaatcccatccagtgtattttcaatctcacatgctacagtttccatctctagaaggccagttgggtcttttatattgtccttgtctcccgtctagctttttgcacacagaatatagttattccgtatgttttaatgtttgtatctaccaattatctgtgccagttctgggttagttttgattgattttcccccttcatttttggtcatatttttattactgtattttgtctcgttgcattggatatttttgtattccttaaaaacttcccatgctttattctgggatacagttaagttacttggaaacagttttatcttttgtggtcttgaatttattatttgttaggcagccctacaattcacagtctaggactaattattccatgcttttgaggcaagatgtctcctgtactcaacagtgtcccatgaattgagagtttcaaccttgccttgtgggaacaggcacattccctggccttgtgtgagcaccaggtatagttacctctaaccctttcaaatgggtcttagcctcaggctctttcctcacacagatgcccttacccagtagtcagctaaatactccaagggagcccctctgtaggtctcctgtgttctgtctcttccagtactctgtcctgcaaattctagctgctttgttctctgtggactctcagctctgcctcttcaaccaatttttgtgtgtgtgtgtgtgtgtgtgtctctaagggaatcactgtccttatctagtgtattgaaaaccgtttgatacattttggcagtctattggttgtttaagacaggaagataaacttagtctctctccatcttagctagaagtggaagtcctccagatcatctttattaaagttagtaggaaagctaaaagatatgttgtttagttctgaaaaatagaaaatctcaagggaaccaaagtttggttgctttttaagggactttccgctgtcctgtcagtttacattggcctttagtgatatatgtgccattcatttctgctgtacaagtcagtagtattatatttgagcttttaaagtgatggagcaccccaggatagaaaggctcagtgttggatcataggaagagaacggtgggtacaattttttggctgcaagtgccaaagtagtaagttctgctatgacccagtaactattataaaccacttaggctctgaaatagggaattaaatgatgccagtgctttggtgtactccaaggaatcagtgtagcttaatgagtgagagcttgagctctggaggcaaatagcctcttcctggctctgccactttacctcagggcaaatcaccagtataaagtcccagatcagcgcagtagtatgggaataggagcaagggtgaaatctaaattacattgggataaaagaatccatgggttcttgatgggaatcatatgtaaggaaagaggaagaaataaatgtgactataaggttttcagtcactgaacagaataagaaaattggttgcctgtgcttgtgggtgtggggagggtggtttagagtcggggtggagggttgttgatgaactgggttttggacgcagcttgagataatttgggaagtgcatatgctgtgtagggtactcagaatttggaactctgtgaaacatctaaaatcaattttgaaaaattgccacgttaagatgaggtccttgcacatagctagtattcattaaatgtttgaaaaacaaaataatagagttgaagcttactgtgctcagggcaatatttctaaaacttgagcatatacctagaggggctgttaaaactcacattgctgggccacactctacagagtttctgatttaggaggcatgaggtggggctggaaccatttgtgtgtcttaaaagttcccaggtgctgcagtggtctgtggatgacactttgagaaccagtggcttatggaagtaaatagaacacaaaggaatgctcagatccttggaggaggaagcagaaaaggagataaatgaagtcacagaggtcacaaccatcagtcagagttagatgacactagtgacatagattatagaaaggggatattttaggatttcaactttgggtaacaaatggcatcaagtgaggtagggagattaaaatgaatgagaaatgattattggatttaatgaatactgttatttgtgatcttggagagcagtgtttatctttttggggtcacggaactttgaaaactgatgaaagctgtggatcccttcagaaaaatgtgcaagtgctcatagttttgcatatatttctaaggaggttcatgaattttattgaggcacttgcatctgaagtaattgaggcacttacatctgctttagtatggatggtctcattaagagtgctaagtgtggaagccagatatgaagagagggaaagcgtgggaagaaggaagtaattgtggatatgaacagtccttcgggattgcaaagccttttgggagtggactgataattgtccagtttccttacttggaggtctaagcctgtgacagtcttcacatctcgctgagtttctagggatattgtgaaaaaaaatgtactcatttatgaaaactgaaatgacccatggctttcctgacttcctggtcacttgtttctttgctgctcttcagctctggtgtggtcagagttactgtgtttgaaacgattcagtcttttagtctttctgtccatgtgttaagcaagttccccccctttcttcctctcttttcaggaataacgcaaattatctttttctagaagaactattctataacttgccaattctagttgaaacattttaccatttcttatatccttagtctcatgctctggatttggcatcaattttttttttttcattgaattccaagactctttttgttgattgtgtaaccttggacaagtgacataaatgtctcggagtctcagtttgcacttgttcttggtggggatggtgataacctgctttacagtaggtttgtaaggatcaaaataaattagtgaggcacttactaaactttcaacatgtatacatgtaagttgtttcttattaggtacagtgtaataaaatatattggtaagcaatgctagggtcatctagatttgttttttactcaagcagaacatttggctgtagtatcttgaaactagaagctggtatggaataattgttgcacagatttaaaatgatggatggaatgaaaatagagttgccagctactttttagctaagaaatatggtagaactctacccttagttgttttcaaggacacatgatctactctaggaaacttgtcagtacttttgtatgctagttgcatacggacctaggccgaaattatgaggaaaagcagcaggaccctggtaaatattcctggtgggataatttatgcatatacctttggagaaaaactccaatatgctgtgtgtgtgacatatagggtgttatgctctatgatttgtttgactatatttaatccaaaaatcgtgtacacaaatcaaatagagggactggaccagatcaatgagatcaataacaaaggtaaatttggatttttttttcttggaaagaatttataatatgactatggacagacaattagtcataaaattttaaaaaatatttgtctttattctttagtggtgtccattcagatctgtaaattttcagtacaaaaatatgattttaaaaattgctcatttaggctgggcatgatggctcacgcctgtaatgccagcactttgggagaccaaggtgggcagatcacctgaggtcaggagttcgagaccagccaggccaacatggggaaaccccatctctactaaaaatacaaagattagctgggcgtggtggcgggcgcctgtaaccccagctcctcgggaggctgaggcaggagaatcgcttgaacctgggaggtggaggttacagtgagctgagattgtgccactgcacttcagccttagtgacagaacaagactcggtctcaaaaaaaaaaaaaaaaaaaaattctcatttaggtagattctgaaccattttatgtaaatgagatttttaaaaaataatgctgtatttctgccgtcactctaattagcaatcctggaagcaaaatatttgacttaagataatgagcacttgaattgacttatacttagggaaaaaatggaactacatagtcatagcaattaagcttgggatgagtatgtatacatcaccttttcttccacacttaagacttctaaaaaaccttgcttggcttttcaggaccgccccccccttccccacccaccgacggacaaaatgtaccttgtgtttacattgcttgtattttacaattgtaaatttccatagggatagacgtgaattctggtaaaatttctccccaaaccttgcttcatttattttccaaactttaagatgactggcccccattaatgtgtctgtaaagtttgaaccttagtcaaaagtacaaaaatggttaaagggctttaggaaccaaattcctgccatagattttatcaccaacatctttcctctgggtcattacccatttgttggcttcagtggaagtattggtgaagaatgaaagagctaagtccttggggtatagaagtggaatagtgagtaagctgaggtgtggtattctcggcagcccccatttcaccttctgaatttgcttaaatgcaagactttgcttttgtgctggttttaaccaatgtgatgcagcatagcctaacacaacacagtggtttgtaaatcaggctccagtctagttctgtgacattaatgtgcaacagcagaacgtgtttcaacattatcagtgcagtttctctccacggtagtgatggtttcctgcagatgcacttagtctgacttcatcaaaatggaaatgttaacattggaattacatagatggctccaaatccagaaattctgtccactattgttatgtaaatgaacagtgtcaagaatggattttcacttaattttttttagagcctaaagtattaatagttagcctattctctgttggttgtggtagtattccatttttgttgctttactgaatgtcagtttgaataatatggattcatattatgtatagaaatggtaatgatttcacataaattgtcaaatatgtaaatatttgaatatacaagaatttgatgtagacattattggaacttactataaaagaccttacacttgtgatccttgcttcatatggacaagcattttctggagctgtttcctggttgtatctgtattttgaaagtctttccattaactttcatcttctagatccagaattaaattaagactaaatagaggctagttcctcaggcttacaatttaaactgctttcttcttgagaacacttatcacctaacctgggcccatgaaacttgagaaggcgaaatctgtatggaaataagttgtatttgttcaaaagattttcttgaatatctgctttgtttactgccttacattaagcactttagggagaagtaaatatatactacttgctctcaaaatccttaaagtctaattggggagggtaggcataagcattgaaatagcaacacagtatttcaagcaagaccactgaaatgtgttctgaaatcttcaagataccgcagtgtagcatctatctgtcttagctataaaatggggataataatagccctacttatttttctgaggattaattgagatcctgtgttaaataaaatagtaaaaccacactgagctggtcagctttaggcacactgaccagccaactcactcatgcctgcaaagctgtcctgcaacacaggtaattcagattcatacttagcaaaatcatttgttatatgcagtgaaccttgaaacctcaaatgtcagatccttgaatgccaaatgtttagtgtgacaaacatttcaagtctatgtgggcagcaaacattcatatacatatacaccctttactttggacagaaggcaatggggagtaccatcagtgatgtttgcctgagcctggcaacttaattcctttgtggcactgctcactttccatgaattacatcctcttagcacgtacacattctgctgatgttcaaacaactaccttagaatcctgtagctaccttcgcatttgtgtgccttccgtttataaataaagggaataaagggaagtttagaaaatgttgctgtatttacatgttcattcattctaggtatagaaacagaaacttctctcatcacagtttttactcatctccaagttaaatgacattcatctgttctgagagttcttccccactcctttccctaccccttgggaaaaaaaattgactggttttggtggctcacacctgtaaccccagcactttgggaagccgaggcaagagggtcacttgaatccaggcatttgagaccaacctgggcaacataatgagaccccacctttaccaaaaattaaaaaaaaaaatcagctgggtgtggtgggatgtacctatagtcaggaggctgaggtgagggtgttgcttgagcctgggatattgaggctgcagtgttctgtgattgcagtactacattcagcctgggtgatagagcgagaccctgtttcaaaaaatagtaaataatcagtgctcttaggatctctgattccaggacttggctcttggatggcatttctggacctgccctgggccaccagacaggagcccactcccttgaaaagtgagtcactgccaggtggtagttgggcagtactccctgtgggcctgaggtatcagtggacacgaggtgaggctcctctgcctttggaaaggggagggaagagtaggaaggactgtgtcttgtggtttggttgccagctcagccacaatgcaatagaacaccaggtggacatctaaggtttttgactgtagtctctggctccaggatagcacctctggcccctccaggatcctgggggagcttgctgccctgaagggaaggacataggtctgcctggctttgctacctgctgattgtagagccctaggacactgagcgaacagaggtgacagccagggtgtggttacagtgggccttgggtgaaacccagtgctatgctggcttcaggtttgacccagcgaagtcctagagctggtggccataggagtacttgtgtcagtccatccccatctctaagtggctcagagcagagagagaaagagattctatttgtttgggagaaagtacaggaagaaaacaagagtctttttctagtaatccagagaactcttggattttgtccaagaccgtcaaggtggtacctcttaagagtctgcaagaaacacagtcctgctgggcttgaggtcccccctaaagcagatacagcttagatcacaacacctaagtcctttagaatatctggaaggcctttccaagaaggatgggtacaaacaagcccagactgcaaagactacaataaatacctaactcttcaatgcccagacacagaggggtgtctgcaagtatcaggatgattgaggaaaacatgatcttaccaaatcaactaaataaggcacccgggacaaatcctgaagaaatagagatatcagacctttcagacagagaattcaaaacatctgttttgaggaaactcaaagaaattcaagataacacagaaggaattcagaattatatcagataaatttgaaagattgaaataacaagaattaggcagaaattctgaagttgaaaaatgaaattggtgtactgaagaatgcatcagtcttttaacggcagaattgaccaaacagaagaaagaattagtgagcttgaagacatgctgtttgaaaatatgcagtcaggcaaaagaaaaagtaacaatgaagcatgcctacaggatctagagaatagctataagaggacaaatctaagagttactgggcttaaaggggaggtagagatagagataggcatagaaagtttattcaaatggcaggaaaccttacaaacctagagaaaactatcaatatccaagtacatgtgagaggtgaagccggctgggcttctggatctggtggggacttggagaacttttctgtctaaaggattgtgaacacaccaatcagcgctctgtgtctagctaaaggtttgtaaatgcagcaatcagcactctgtaaaaacgcaccaatcagcgctctgtgtctagctaaaggtttgtaaatgcaccaatcagaactctgtaaaatggaccaatcagcaggatgtgggcggggccaaataagggaataaaagctggccacctgagccagcaagggcaaccctctcgggtccccttccacgctgtggaagctttgttcttttgctcttcacaataaatcttgcagctgctcactctttgggtccgcactgcctttaagagctgtaacacttactgtgaatgtctgcggcttcactcctgaagtcagcgagaccacgaacccactgggaggaacaaacaactccggacgcaccacctttaagatctacatgtaacgctcactgcaaaggtctgcggcttcactcctgaagtcatgcgagaccacaaacccaccagaaggaagaaactccgagtacatctgaacacctgaaggaacaaactctggacacaccatctttatgaactgtaacactcgctgcgagggtccgcagcttcattctttaagtcagcgagaccaagaacccactggaaggaaccaattccggacacatgtagcctatggaacaccaagtagatttaacccaaagaagactacttaaaggcatttaataatgaagctccaaaggtcaagaaatggaaaaattccttgaaacaaatgataatggaaacacaacatacccaaacctgtgggatatagcgaaagcagtactaggagggaagttcatagctattagtgcctacatagaaaagaataaaaacttcagataaataacaatgcatcttaactaaaaaagcaagagcaaaccaaacccaaaattagtagaagaaaaagtaaagatacgagcagaaatacatgaatttgagatgagaaataatacaagaaatcaatgaaacaaacagttggctgtttaaaagttaaacaaaagagacaaacctttagccagactaagaaaaaaaaaaagatccaaataaataaaattcgtttctagttcttcagcttccatcctgcttcaccagcaacagtaataccttctctttatgatagtttccagtctgcttctgaatgtagaagccttctttcctccttttctttctttgactttctgctgtttttcctctcaatctagaatttaaagatgttctattgatctaggtgtcaagccctcttaagatctctctattggatatagtactctctcatacagcaacagagtaagtaaataatgcaaggtacattatagataaatagctgtgcgttttcctgtactattcccaacatctcaattatgagtctgttattttacaaatcctacttttctggaagaattgtcaactgtttttggcttgggctagtgttccatatattataatcctttccatattttgttctgttgtaattctatttctccttctgtttcattcttttttcccccctcaggttttccttgtcctcccttctcctaactcctgcaaaataaaacaaatctttgagtgcaaatctttcctcaagacttctggactattgctgtcttttcaaagatcaggtaataaagtaaaagagatatgaactttgatgtcctgctctgatgcctagctgttacaggtgcatttacctaggttctgtatcacatgactaccctaccatgctacaggaccagaagggatgcttgattcataaggtagccagtctataacttctgacctgtgtggctcttggggaaaatgtgaacttctgagagaggcagagggagattaaactggtgatgtgcaggtgtattgggctgggccatctttggttgtgcaggttgaagaagaagaagaccttggcaaagagaacaaagcagaaccactcatagtgtcagtgactgcacagccccttagagacagccagccatctttgatttctgacattgattcaatccctgcctttggatcccaatgagacgtatgtattcttgtatgcagtttatcttcacttgagcctagttaagtagactactctcttatataccgcagagcaaagccaaaatacccatattcaaagaacaccaactggtctatcatgcattccggcatcccttcttccatcatttctcagtaactttagttttcttttattactttatgtggttttcaggactctatggcttagtgattaagggcttaagttcatatcatttactgtggaacttaagcaagttgtacatcctctctgagccgtagttttctcatctggggaatgagggtagtaataggacttagagccctgtgaggatttagtgagatactgggtggacagcatacagtagcaggcatgtagtaagtgcccagtgaatattagcttattgtgtgtaaatgtaggatatgaaaattagtgtgttgctttttaaactatctgtggtaaaagaccagttcttttcttccctcaacctatgacaattcagtatttttgtaaagtacaataaaaataacttgatttttaaaagcaccaattgtaaagacataaaatatgtcctgatttttattattatattcagcaaacttattctgtcaagttattataaaattttctaaattctacccttaatttctctacttactttgtttagaccagtaactacttattgaccagttactggtctatttttttagaccagtaacaatttccagaccggcactgatctgtggactgtgagtagcactgtcctggtgtatacagacacagtctcatggatgtcagaatatatatgcgcacacatgtaattggggaaaataccccaaccatttctataaggttaatagcgagtagccgggagttcatatatccatttcttgacccggacagtatacaagggacatctgagacctctggaattccttccttatatgattgttattccactgcttcccaggtgagggttgtcattcttttttttttttcctttgagttgtgctgttcttcccttcttgtccttcacttcatgaggaaactatactccctgaaggccaggtaaatatatgttgtcttagacaaatcagctgtgctaagtagttgagaataggatactgaatactgctgccttatggactgaagtgaagcaatcactggcagtgtggccagaagaataactttttaaatttgagacaggatctctgtaacacgggctggagtgcaatggcatgatcatggctcacttcagcctcggcctccctgggttcaggtaaccttcccacctcagcctcctgagtagctgggactataggcatgtgctaccatgcctggttaatgtttatattttttgtagagatggggttttgccatgttacccaggctggtcttgaactcctgggctcaaggaatcctcctgccttgacctccctaagtgctgggattgcaggtatgagccacatttcctggcccagaagaataactttaatgatcctttacacaaccgcaaaccagactgcatggtttgtagacaaagggggaatgaatcatagaagaggttggcatttgcattttccttctatgcaaagacagtgacagaccatgatacagaattgcaaacagcaggttctagaaatagtaactgtgattgatgactaaaagtctatacaaatgctagaatgtgaccagggttgggtattctcttccaagtattttagggaaaactaagcattacagtaccagattttattttcagagaaattagaattttcagttaaaaagcacatacaaagtgccaggcattgtgctaaggtgccttatatctctcacttaattctcaccacaggttgatcctcattattcactgagcagacaacgcttagagagattaagcaacttgtctgaggccttgcggttcataagtgactgaacctgattttgaacctaggtttgccagacttacagttgaattttctggattttctcataagtggattttctggatttaccttaaaaaaaaaaatcaccataactttgctggaaccatttgagaagaagttgccagcttgatgctctatcactcccaaatactttagtgtttattttctacaagaacacttttctttgtaactaaaacaaaatgtccaaaaccaggaaatttgtattaatagattgttaccatctaatcctcaggtttaataatatcttttatagcacacgtccccataatgcccctttatttccttctggaacagttccctagtcttttcatgattttcatgaacttggcacttttggagatgacaaaccagttataagttgtattttccttgatttgattttatctgttatttcctcatgtgatgcaagctatgtacctttgcaggaatatcatgtaaattatgttgttctcattgtactctgttgttacagggcatacattttcagtttgactgatgactaatgatgacctctctaactgcttcattagggtgatatctgctgggctttagtactgtaaagttactcttcttgtttttgtaattaataaatgttttgtgggaaagtattttaaaactaggtaagtatccatctttgtgacactgtttactcatttaatttgtatctacttatactcatggtttcctattttattcagtggattatgatcttctgtactgttattggttttgatgctcaaattgtcctagatttggcctgtaagagcctcttcaggcattctatgtctattttgagtagtttcagtagtttcttgctttctggcacaaaaaagatattctaagctcaccttgtactttctgcatcccagccctagataatcagtcatttctccaaggagccttggttctttttaagggaaagaagtatttagaagccaggatctgggtaaccagtgtgctcattaccattggggtgttgctacttccagatcctctcagtggatacttttacatttacctatattttctatgtttatttctatgtttaaatatattgaaaattgtgaattaatactgataactccagttccaactcaatacctcaggattcattctagttttctcactttcttttatagtgttctcttacagcaagaaacttggtttccattatccttgatacacatgctaaatgattggtcttctcttgtatgttgccaacctcccatctttgacactattttctccccttcatggatgtcctgtttttcctttttaagtgttgactccacattccagacacttccccttttttgatgtagtcacccttttctctccatgtgggctctcaagtaaatttacttgatgattttattttactaacataatcctcttgttttggtgtttttgctgccatacgtaaattgtaacattaaaggttccctaaaacaattgccctgctggtaggagagcaccaactagaatatctaaatgggagtaattgaacattagaactgaaaaataacatttcctgggatcatcctgggtcaataatttgtattctgcaagtgatcacaggactagaattggttttttgacaagaaattgggatttaatgggctatctctagaagtctcattagagatttaaaagaaaaacaagttttactattctgtagaggatgtagaatgagatacgttcctggggaggcaagagggctaagaatggatgggggaaaaaaagcgtttttattgaaattattaattgggtgaggcctaaccattgataggatattatgcatttagtaagccaaacaagatagagaggtgggttagcgaatactagatgcagacccctccttggaagggtgaaaaaccagaccacctgacagaggatcagtaggaagcctgaagctgggtgttaatatgggggtgtggtattggtaatatttggtgtgtgctgctccatggggaaaataagcagtaaggatggctagcagttactacgagagaggctttaaatcttttcagagtgagaactgggacagggagtgaccagggttggcacactcattcccaagaccacatactttctcatgttttctcatcaggccaagctgatcaaatttattcaaacccttcccccttcccccttccgccttcccgcttccctttctctgtgttgctggggctggtgttaaactcctggtctcaattaagtgatcctttcacctcagcctccctggttgctgggattactggcgcaagccaccatgcccagttgaccctgtgtttttgaaacacccgagtgtgtccagtaatctgcgaacattatgaagtcctacccctaaaattcttaaagatatatttcagtgcagttaaactgcagtcatgtgtcacttaacaatgaggatatgttctgagtgaacttcctagagtgaacttccacaaacctagttggtgtagcctactacacacctaggctatatggtataggctattgctcctagtctacaaacctgtgcagcatgtgactgtactgaatactacaggcatttgaaacacagtgttaagtgtttgtgtgtctaaacatagaaaaggtatagtaaaagtacagcattaaaattttatggtatcactgtcgcatatgtggtccatcatttacaggaatgttatgtggcacatgactgtttatgctatttggagtatttttaagcaagagaaaggtatataggggaatcaaatacagatgcttcttgatttaaaattaggttacatcctggtaaatccattgtaagttgaaaatgccgtaagtcaaaaaggtggttaatacccttaagctgccaaacattatagcttaggctacaacctaccttatacatgcttagagcactgacagcctatagtcgggcaaaaatcatgtaacagaaagcctattttataataatgtgctgaatatctcatattttattaaatagtgtaccaaagtgaaaaacaaaatggctggatgagtactcaaagtatggtttctactgaatgtgtattgcttttgtaccatggtaaagttgaaaaagtatgtaactcaaaccattgaacatcagggaatgtctgtatacaatagtggtcagagtagtgagttactcagaagaactaaaatattgtgtgtgaggggaggggacttgcttcagtagttattgaaatttgctttaatttttttttctctgttcccctgtactagatttgagtatttgggagatacttactccctaaaaatctgagggaaactgcttctttgatgggaaccttgcttagtagattcttgctcaatgtttatttttaggaaacaatcaaatccccttgtggttattaaattaatttagtatcaggccgggcgccagtgacctcaggagtttgagaccagcctggccaacatggtgaaaaccctgtctctacaaaaatcccagctacttgggaggctgagacacaagaatcgcttgaacccagaaggcagaggttgtagtgagctgaaatggcaccattgcactccagtttgggtgacagagcaaaataaataaataaataaatgaataaatgaataaatataaaaataatttagtatcattaaaatcagagaatttagaaggcttgttaggatgtaaagtcatacccagaagaaaaacatgtataggtcagggatcaaaaatgtgtcagatttttcataacaagaaaatgtgaatagttggtaagtccgtaaatggtatatggcagatccttgaattatgcttgcagtttttgaaagtttgaaattaagtaaaaattaaaagtcacaaaagattttgcatgtcaagattctagcctttttcttctggtgtactgagaggccagaggagcccattctagggactaagtattgacagaatttggttctgtggcaagaattacctggtgtcctagcactaaggaccagtaggtcagagcccttgacttagatttcaggacaagaaacagaaagattggaataggattggaatggagtctccccgtgattttaaaaaacacttagtatggggccaggcgcgcggtggctcaacgcctgtaatcccagcactttgggaggccaagatgggtggatcatgaggtcaggagatcgagacggtcctggctaacatggtgaaaccccgtctctactaaaaatataaaaaaaattagccggccgtggtggcgggcgcctgtagtcccagctacttgggaggctgagataggagaatggcgtgaaccgtggaatcagagcctgcggtgagctgagatcgcaccactgcactccagcctgggctacagagcgagactccgtctcaaaacaaacaaaccaaacaaacaaacaaacaaacaaaacccactaagtatgcattggtctaggactaccatttatgaatatccttagtctttctgtgatgatccttgttgaaaatttagattgatgatgtagtttgtgatgttgatacaagtgtatttgttcacagagatttgagcatattcctttcaacatcaggaataacttttagtttttgtttgattgtaattttttagtctccattctctgtaatgtgctttacgttgaacaaagtgcttttgtagttcttgttattttgaacccataatctgagacctttttttctaagccgtctcgtgccccagcccttacttactgagccctcttattgtatatactgaacgcatttttaaattgaagagatactattctgtgtatctttgcaggcgaatgagtcctaggttggccagtgtctcactagttgagattaaatttttgcttatacttgttgatttgactgccttctgaatagtattaggaacacattgtaaatttgttgttgatggctggctgaagttttccagcacatttcttgaggttgccaagttcttctacaatgactgaatctactcttcattcattctagtcagcagtctcacacttaattccaaggtttacttaagatttttttctgaaaaagcaatgcttgctttccatatttgcatattttttctctgccttaatagcagaaacaatggcttcatcttgcatttgtatcagattctttccattgatatatcttgtccttattagctagttgtttcccagctgggtgcagtggcttatgcctgtaatcccagcactttgggaggtcaaagcgggaggattgcttgagcctaggaattcaagaccagtctgggcaaaatagtgagaccccatctgtacaaaatgaaaaaaaaaaaaaaaaaaaattagcccagtatggtggtgtgtgcctgtagtccctctacttgagaggttgaagtgggaggattgcttgagccgtgatcttgccactgcactccagcctgggcgatagaacaaggccctgtctcaaaaaaaataaaataaaataaaataaaaatctttgctttcaaaaaggtttttggttgcataggagggaaagaaaaaaaatggaatatcgaaattagttgtgtatgctgagtttttctaccacttccttcctttgggttaaacagcctctctcctatttattttaacttgtttgcaatttattaggcttggtaggacccagctgttatacctcactcagcacattacccattttgcttttttaaagtgactgaggcagcagctgttctccagctgcacacagaaggcccacataaagctgggtttagcacataagccccactctaagagcattaattcaccaacccagtctttctattttgtcagccactcaaagtttatacttgcctctgtgaggcttcagaaataatggataaatcttctgttaatgaaaatacacctccagatataatattcacactaagtgtggtgttagaataacagatatggctcctcagtagtttttggactcttgtaggtatatggaattgtgagactgttcattttgaggatctgtaaagagttaggacttaccaggtatgatttgaaacactcaagattgtctcttggagtctcacacaacagctattattttatttgaatgagattattagcagattgatagttggaccaggtgctatactttatgccctctcttccctttgtaaggttttcaggcctattaattttttttttttttttacaccattggggtaagattttattttggctgaaggtacttaaaatgggtgggtgagtgatagataatatttgtcttcactattggctgtaaactgggattagagtagatttatttatttattaagcagtcaactagaaacaagtgctgtgaagtcaataatatatggctttagtgaagattccacttaactgaaagtagacctgaattattcatgcaatttgccaacatttatatccattaataaagtggtagtttattttgaaaaaaactttgcacttactgagtttttgttggcatttccctccctcgagttcatttgtcaaagtcatcatgaatatactgttagtatattcatggcttttgattgtttcactgctttttcttagtttctgagttgctgatttggtaaaactgtcatgattttctttgtcagttttcaaatgttgcaaagggggcagaacaactttgagtcccatagatgattgatggtgctttgcaagtagttaaatacacccaaggtaaaggaaattttatgggattaaaaaaattctatgctccattctaggttgatagtatttgaagcaaatttcatttcattggtgggtggcctcagtacctaaactttaaaaagcatggattcataaaactgttacaacaccacttatgaaagtttctgaagaactaaagagttgttaaaaagctactgtctttctctaaacttggttactgtggagtagcactgtctgatgcaactttttgtaatgatagaaatgttctctatctgtgctatccaacatggtagctacatgtggttattgaacacttcaggtgtggctagtgtgacttaggaactgcattttccattttatttaattgtagttaatttaaatagccacatgtgtctattgctttctgtattagatagcacagctctgaagcattacactgagtacttaagctaagctagtgtttctgagagaaagtgatcctttgtgattttcctgaagctgaagaaggcctgtgtatggcctggagtcagaaattgttgtgacttttcttgattttttcatgaaataatttaaggactgtcttttctttcaaatctgggaaaattctgaaatgttctttctcatctacttagaaagcatttactatcacctttgacgagcaatacagtggccagtatattgtgttgtaggtttgattagttctctatctcagagagacagctttagtgaccgagagtttattgcctatctgcaggaaaataataaagttttcctgtactcaaaattgccagacttggaagtagaaatagcagcttttgcctttctacaacaaataattattcttttggctaattcccatacctgccacctttaccttcattattttctctgaaaaagaaatctgggctcattgcaacctctgcctctcccctaggttcaagcgattctcatgtctcaggctgccgagtagctgggattgcaggcgcctgccatgacacctggctaatttttgtattttttagtagagacggagtttgaccatgttggcccagctggtctcgaacttctgacctcaagtgatctgccctcctcggcctccccagactgctgggattacaggcgtgagctaccgtgcctggcctgaaatcatgcattatatactctctctctctctctctctttttttttttttttttttggagacagggtctagctgtgttgttcaggctggagggcagtagcgtgatcacacctcactgcagcctcaactttctagattcaggcaatcctcccacctcagcctcctgagtacctggagctacaggcgtgcgctccaacacctggataatttttgtagagatagggtcttgctgtgctgcccaggctggtctcaaactcatgggctcaagcgattgtcccaccttggtctcccaaagtgctggaattataggtgtgagccaccatgaccaactatatatactcttgtttggtctggctactttcactcagcatattttgagattcatctatgttgttgtctatatcaatagttcattcttttcttttgctaagtagtattccattatgtgggtagtactacagactgcctaatccatttattagttgatggacatttggtggctttgagctcctgaactcatgtagtcctcctacctcagcctcccaagtaggtaggaatatagatgtgtgccactatgtctggctatcacataaatgtctttatatggatgtatattcctttgcttctgggtaaatgcctgcaaatgaaatggctgatcatatcataggttgtatgttttaactttttaagaaactgccaaacttttccaaagtggttatattgttcaacattcctaccagcagtgtatggaagtttcagttcctccatatcctcaccaacacttagtatggttagtctttttaattttagaccttctaataggtgtgtactgattcctcattatggttacaatttgcatttctctaatgacattgagcatcttttcatgagcttattgccatccatgtatcttctttgttcaaccgttgaaatttttttgcctatttttaaattgggtttttttcttttgttactgatactattaatatcctttattctggatacaaatctttttcatatttatgtttgcaaagattttttcttgctctttgacttgtcttttttataacagtgagttttgaagagaagtttttcatttcaatgaagttcagtttatccatttgttctttatgcttttaaatattttttctgcattttcttcaggaagtttcatagtttcagggtttatatttatactgatgatttatgtaaatttttatatatgatatggaggtatacatctgagtttattattttcaagcaccagtagttgaaaaggctatctttcttcacactgcagtgcctttgggactttgtcaaaagtcagttgtccatatatgtgggggttttttttctggagtttatattctgttgcattgatctgtttgtctgctttatgccaatacctcttttgattacataaactttataataattcttgaaatcaggtagtgttaatccttcaactttattttcagagttgttttggctattctaggccctttttatttcaatatgagttttagcatcagtttgtcagtttctcccaaaaatcctgctggatttgtggttgggattgctgtgaatgtgtagattaacgggaaaatttacatcttaacaatgttgagtctttcaatctatgatagaagtgatctctctttaggccttctttaatttctctcagcaaaatttcatattttttgttgtataggtctttcacatgttttgtcagatttatctctaagaagttaatattgttgatgctactttaaagggtatttaacctttgaaaatagtatgtgatggttcatatattgattttgtatctgtaaacttggtaaacttattagttatagtaactttattatttattcattgggttttctataaagatgtattagtccattttcacactgctgtaaagatactaccagaggccaggcgtggtggctcatgcctgtattcccagcactttgggaggccaaggtaggtgggtcagttgaggtcaggagtttgagaccagactgaccaacatggtgaaaccctgtctctaccaaaaaaagacaaaaattatctgggaatggtggcacacacctatagtcccagctacttgggaggctgaggtggaagaatcacttgagccccggaagtagaggttgcagtgagccgagattgcgccactgcactccagcctgtgtaacagagtgagacactgtctccaaaaaaaaaaaaaaaaaaaaaagatactacccgagactgggtaatttataaacaaaagaggtttaattgactcacagttctgcatgaacagggaggcctcaggaaacttacaataatggtggaaggcaaaggagaagtgaggcatgtcttacatggtggcaggtgagaaagaggaagggccacactttaacaccatgagctcttgtgagagctccctcactatcatgagaacagcatgggggaaaccacccccatgatccagtcaccttccaccaggtcccttcctggtggggacacgtggggattacaattttagatgatatttgggtggggacacagagccaaaccatatcaccagacaatcatgatgtttgtgaatgaagacagttttacttctttctctccactttagataccttttatggtcatgtgtctcttaattgtgaggatgcattcagagaaatgcattgttaggcaatgtcatcattgtgctaacatcatagagtatactgcaccaaatactgtaggcaattgtaacacaatggtaaatattttagtatctaaacataagtagaaaaggtatagtagaaatataatcttatgggaccctcattgtatatgtggtctgtcatcgactgaaatgttgtgttacgtcgtataactgtatttcttttctcacatgattgtactggttagactcttcagtactatttatttatgtatttatttatttttgagactgagtctcgctctgtcgcccaggctggagtgcagtagcacgatctcagctgactgcaacctctgcctcccgggttcaagtgattctcgtgcgttagcctcccgagtagctaggattacaggtgcccaccactacgcctgggtaatttttgtatttttagtagagacgggggtttcaccatgttgaccaggctggtcttgaactcctgacctcaagtgatccgcatgcctcagcctcccaaagtgctgggattgcttacggacatgagccactgcacccagcctacaatgttgaatagaggtggtgggagcaaacgtccctttctgttgctgatctaagagggcaagctttcagtctttcaccagtaagtatgagattagctataggtttttcacagatgctcttgattaggttaaggaagcccccttttatttctggtttgctgagttttttgttttttttttttttcaaatgaagaatgaatgttgaattttgtaaaatgcttttccttccttccttccttccttccttccttccttccttcctttccttcttccttcctttctctcctctcctctcctcttcctttcttcctttcttccgttcttcctttcttcctttcttcctttcttccttctcactctgtctcccaggctagagtgcagtggcttgatctcaagctcactgcaacttccgcctcctgagttcaagtgattctcctgcctcagcctcctcagtagctgggattacaggtgcccacctctatggctggctaattttcgtatttttagtggagacacagggtttcaccatgttggtcaggccagtctcgaactgagactgtgcctggctgtaaaatgttttttctatgtctgttgagatcatgttgtttttctcctttaattcattaatatagtgaattaattacactggttgggtttcaaatgttaaagcagtcatacaattttgggataaattccgtttggttgtgatacattctatttttggataaaattttgcttagaatttttgcatctacatttcatcatggatgttggtctgtagttttatcttgtaatgtctttgtctggttttgttattagagtacttctgaactcatagaatgagttggaaagtattcccttcctctttaattttctgttaggggtttgtttagagttgctgttgtttcttctttaaatgtttgatgagattcatgaatgaagccatctacacagggagttttctttgtcagagagttttaactgcaaatgcaatttctttgataatgatacacggttattcagaatatctatttcttcttgagtgagcttgtcttttagtgcgtttgtccatttcctctaacttgtatttatggcataaagttgtttataacatttcatccgtctcagctcactgcaacctctgcctcctgggttcaagtgattctcatgcctcagcctcctgagtagcagggattacaggcgccggccaccacactgggctaatttttgtatttttagtagagatggggttttaccatgttggccaggctggccagcattttatgcttttaatatgcataaaactgtagtgaagacacctctcatttctgatactgataatttgtgtcttttttttttttctctagtcagtctggctagacatttatcaacttattgataatctcaaagacccctcttttgggtttcatggcttttttctgtttcatgaattctcactttaatctttatttccttccttctactttgagtttaatttgttcttattttctttcttaaggtgggaactgagtttattgatttgaaatcttttctaataaagatttaatgctaaaatttttcacctcgttactgcttcagtggcagcctgcaaattctgctgtggtggtgttttaatatccatctctgctaatttcaacacctctgtcagttctgagttggttgtgattattcttttcatggtgggtcaagttttcttacaactttgtgtatttgattatctgtgtttgggtggcagatactgtgagatttactttgttgggtgccatgtatttctgtaaatgtacaaatcttgagctttgttcgaagatgcagttaagttacttggaagcaattttgtcttttggaattgtgcttttatggtgtgtgtgtgtttaaaagtgggtttggagaggtgctcaatgtagagttaattgttctctacttccaagataaaaccttcttgagtactctatgcaatgctcctgaattatgagtttttccagtctgacattgggcacaggcactattccttgccctgtctatgtgcgtctcaagccctgtcaaaacaatccattacgatggttctttgcctggcatcagatagttttttcgtatgcatgtgctgacctgtacttggctgaataatcaggatcctctcctgatatataactcttccttgtgtgtttttctgttctgtgaactctagctgctttgttctcatcaggcctcttagcttatttcctcaacttaccacatctgctgagtaggaccagctatataattagcagggcccagtgtaaaatgaaaatgtgagcctttgttaaaaaattatttagtttcttaaaattctaattttaatcagatcattaaaccaagcactgcacccttcggagctgcagctgcacaggttacatgcctaccaagccagggctactgctgtactccacttcatgttcccttctctgttccatggcccagtaattctcttcaaggcaataagccaagacaattgtagggctggtctcctttgtttcccatctctcagaggtcactgtctttttttttttttttgctagatatccagagtcatgaaaattgtaatttttgtctgtttttatttgtttttgtttcaggcaggaagagaaatccagtccctgttaacctgcctcgcttggatgtagttgtttttaatgtacattttgtttaaggaccttgtagtagctgcttttgtgtcagactaggcaaagatttccctatttggcctcttggcttggtgccttgtttagagctgtttgggtaaaatctctcttgtatcatttgctgatctgttttccaatttgttttcctggtaaccatcaactcattttctgaattgtatcacttgatttgaagcaagtattagcttcctgcttgaaaccactctacccttattcttctttctgctgcatttaactgcaaactgcaatgggtgaggacaattctcttcttccacctcctgcacaatacatccccttgcagtacaatttgatcggcatttgtgcagtaaggtattaacagcttttcagatatgccctgccctattagcaagaatatacagtgatacaaaaatgaatttgtcaagagttttatgacttcatgatctatcgtacaatattaatcctgctgcagtgttattaagtcatttttcatctcccctcaaattaatgttgacgttctattactggatttgttcttgtccccagattaaaacataaaggaaaaaagccttccctgctgcaatattaaaattaattgtagggtaagcagtacctagcttggtgaagtagattcctgctggaaaatttataatgggaatttatttctctgctttctatttgttcttgtgcacaaaaaagcacaattggaatatacttctgagggcaccaggagaacatagcaaggagcagggggtacatttaaagtactgagtttcctaaaagggaaatgaggaatcagtggtctgagcctaaggcaaccatacctagctggtagttccagcctagaggctgatagggatgcttgtggtgatagatgtataggtagaacaattttggctgacttaggatggtattttcttcataggaatagcgtgtttcttgtatttcaagacatttggggcacttaaacaaaaactacaacatggtgaggtcaacagttataaatcacagtacgaccttgttcaggactctggaatgagaagacagctgttatctttgtttcagatttggactaagtgatgctgttctgtgaatattctcttttaaaaataactgttttcacccatattgaagccaggatcatcagcttcatgtctgtgaccactgtagtgagatcttagggtattgtgatttttggtcatggttaggtaggtgctttagaatgctcattgttactgtgggaggatcatggaattctcagtaagttttgttataaattctaaatttaaaatttgtaatatgtaaatatatatgtgtatgtttttgatgggaaacaccaaaatatatagtgtttgactctgggtggtggcttgtggggaaataatattatttaaaaaatttttccttgtagaaggtcaacatgagttgtgtaaaccgaagagtgtctgagataagtctcaatttaggaagtttattttgccagggttaaggatgcacctgttacaaagccttggaaggtcctaatgccatgtgcccaacgtggtcagggcacacacagcttggttttatatattttaaggagacatgatacatcagtcagtacatgtaagatttacagtggttcagtttggacaactcaaagtggggagagggcttctgggtcataagcaggtaaatgacagtttcattcttttgagtttctgattaaggtttcacagaatacgccatttacaaggatagtcatttatgccttagtctggcttagtgaaacaatagggcaaaggaagcaatcagatgtgcgtttgtctcatgtgagcagagggacaactttgagttctgtcttctgtctgtcctttgtccacaaggaatttccttgtgggcaaatggtgagggaggtatgtagctttttttttttttaatctttgtatgtatcttatttagggatagaataagagtcaggtttgccatatgcagttcccagcttgactttttcctttggcttagtgattttggggtcccgagatatattttcctttcacagttgtgcaataaaaatgtagccaattatatatatttttatatttgtaaatgacataagcagtggagcagccttctagagggtgaaagatgatgcaaatatagtcatgtgtaacaatgtttgcatcaagggcagaccacatatgcaacagtggtcccataaaattatagaggaactgaaaaaactcctattgcctagtgacgtggtagccatcctaacacaatacattacacatgtgtttacgatgatgcttgtgtaagtatatctactgtgctgccagttgtataaaagtatagccagtacaattatgtacaccacatagtgcttgataatgacaagaaatgactatgttactggtttatgtatttattatgctatctatccttagagtatggtatttatttttttaaaaagttaactgtaaagtagcctcaggcaactccttcgggaggtattccagaagaaggcagtgttgtcactggagatgatagctctatacctgttactacccctgaagaccttccagtaggaaaaaatccttgtggaggtggaagacagtgatgctgatgatccttaccctgtgttgacttaggctaatgtatgtgtttgtgttgcagtttttaacaaaaagtttaaaaagtaaaacaaaaaataaaaatgttttaaaatagacaaaagcatatagaataaggatataaagaaaatatttttgtacagctgtacattgtgtttgtgttataagctaaatgttaatacaaaagagtccaaggttttaaaaattcagaagttttataatataaaagttacagtgagctaagtttagaagtagaaggaaaaaatattttaaacaataaatttggtgtaccatgtgtaccgtttataaaccccacagtaatgtgctaggccttcacatttactgaccattcacttacccagagcaccttccagtcctgtaagctgcctgcatggtaagtgtcctatacaggtgtaccagtttttatcttttttttttttttttttttttttttttttgagatggagttttgctcttgttgcctaggctggagtgcaatggtgtgacctcagctcactgcaaccactgcctcccgggttcaagctattctcctcctgcctcagcctcccaggtagctgggattacaggcatgaaccaccacacccggctaattttgtatttttagtagagatggagttcctccatgttggtcaggctggtcttgaactcccgacctcaggtgatccacccgccttgacctcccaaagtgctgggattacaggcgtgagccaccccccacccctggccccattttttatcttttatatggtgtttttactctgccttttctgttttcagatatgtttagattcacaaatacctttgttttataattgcccacagtattcagtacagtaacatgcttatacaggtttgtagtccaagagctataggctataccatatagcctaagtgtgtagtaggctataccatctaggtttgtggaagttcactctatgatgttcacacaacaatgaaattgcatttttcaaaagataaccccattgttcagcaacacgtgacttactttgggcagtgcaatgaaaaaagctgaaggataattatttatttcatgattgcatcatccttcactgtaggtgattccatcatttttcttttttgggttatagtctttttgaaagcacagttggatataattgatgagtagtggtaaactatctggatgatgaaatgttaacatgtttcaagatataggaaaaataagatcgctaaacttccataatgtgtcttatatttataaagtgagtctattggaccaatatggtaattgcaagatagagcatgaaatttcttgcagtgactcaaaagtataaaggtcatgaaatgccaattcttacaattagttagaactgctgagaaagaaactaaaacaaaaattgagtcagatgaactaagtgttaagagctttaaaggtaaaactgtccaggtttcccgttgtacatatgagaagagggagtatattatcagtggcagagccatgggttggaatgggggctcagatgtgcagtcttagctttcacattccctcaggtggtactagaaagcaaactaaaaatttgaacaacagtcactcccttgtgagttcctctatagttgatggtaggatgtgaagatggtactttctgaaaacatttaaattgtatatgattacataatttgaacaaagcagtgtatcagtgctaaaagctagttggcagaaacttttgtcttaaaagtgatttatttaaaacttctactgaagcccagtggacttctacattccagcatccaggtgtccagtactctcatctataagagtgagctactcgtctagaggctaaggcaagtttcagctagatccagctaagctggtctgaactagtggaatgagccagttgtagctgttgtcattgcatctcccttttgagactatggaagcctaggacttagtctgttaattatcagagaggtcattgctgtatgtgttacgtgttcatggggctactgcagcagttatacttttttcagcagtctcaaaaagttgaatgtgaaaaatgtctgaaaaaattaaaaagggatgttttatttctaattgttcaatgatataagacttccagtactttagttttagtttctctcagtctttagtttattaaataaagatctataaactaggcaatgagtgtttattgagcatcaggtatgtaaggcactagaggaatgtgatactcaagggaattcttttataaaataaaatttcagctgggtgtagtggcatgtgcctgtagtcacggcttcttaggaggctgagataggaggatcacttgtgtccaggagtttgaggccagcctgggcaacgtagcaaaataaaaataaaataaaacaaacatttctttgtaatgaaataactcagtttaacaaatactgatacattaagaacctaggctcatggctgtaatccaagcactttgggaggctgaggcgggcagatagcttgagcccagggattcgagaccagcctgggcaacatggtgaaaccctgtctacacacacacatgcgcctggtggcacgtgcttgtggttccacacacacacacacacacacacacacacccccacacacgcctggtggcacgtgcttgtggttccagctactcaggagactgaggtggaaggattgcttgagcccaggaggttgaggctgcggtgaaccaagattgtgtcactgctctccagtgtggtgacacagtgagaccctgtctccaaaaaaaaataacaataagtaaagtttaggttggtgttattacttaaggttcacagtgccaccaacatacaaagcacatgtagttgaaaagtaaaaagaggaatagataaaggagaattaagttagaagaggtagatgagacaggagaggcagatgtttgtcaaattgtgaagctatgtggaatttgcttttattattctagtctctttttatgcctgaaatattttgtaatctcagatctatccatccatctaacaagtctttatcaagcacctcctgtgctaaaagcattttgttgctgtcccaagactgaaacagataaccagctctctcagggacatttgtattttaaaaggaaaacacaaaagtagacattgtctgcagatacgtttgatttggcctgcagtgttttcaaagtaggggagatgtcacataaattctgagtttgggttctctttacaaaatataattttttttttctttttacatttctttgtggctctggttggcaggagttgagtagatattgcccattagactggcaggtatccttgagtttgccagtctaaactactgcctgttgtcctgagcctagcttactttactcacttacattacctgccttatcctttagacatttgagtttgtggtctgttaagtgactgagctctcatgggattcaccagctgttacctaggtgagtatttgaatggatttttggggtggtggcagtggttgcatgttataggcaccagaaattatgttcagtaagccactaccagtacctgctgtgcaaagaaacatcttccttggggagtgaagaactaaccaccagttttcttgtgacatttgttggtttttttatccttagtttagtggataaaaataagcgtttaattagtgaaaacccgactacctcccaaccccgtctgtccagctttatgttgacctggcttttaaaatcatttatgtatttattttcgcattttcgcagttcatttagtcttctttctctatttaggaaagtttaatcattatagcaaaggatgagtctctgaagaagggaggattgttatattatttaactatccatacttaaccaggaaggagcatattttcccctcattaagaagcctaagtattaaaaagcaattaatactttattaaaaccacagttacaccaacctaataagtgacaactatgtcagtggaaaaaaaaaatctagaatgtttactaaatgttccaggcacagggaatacaaagataagtaagacatggactcattcagatagcccacaacttatcagtgtcaaaatttacatttcctgaatatagggcaatgatttatctctgagaattaatagccttgaaaatatttaagaatatttaggctggagtgggactttactttgaatcagattgtgttacctgctgtaaagtgtgaaatttaatcccagttctagaaaacattataaactcagaacaaaggagtggagttagaagtgagtggccagtggaactctcagcatgagagaaattcatttttgtgatctgatgagtcagaggttgcgggtggtgatgttcagaggaatacatttctagattttggaaaaaatgattcagttttgaatttgctcaagaagtcctcctagtaacaatatctagcatttctttcaattggtgagtattaaccaaaaatgtttacaatcaaataagaagttagtagtaggcatagaattcattttatagaaactttagaccctggagtgaattattctgataaagatgatgatacctataattgtgtgtgttagtgggactataaatctgaatctataaatctaaaaatgtagtaggcatctcagtgaagtgattgtaccctttcaaatggttgttccaactcacctgcagaacctttgtaaactttaaataccctggccctgccccagacttagtgactctaaatcttaacccctgtgtaagcactgctgttctgccacagaatttctgagatcatttgctagcactttgttgaatcaggatggagagaggggagaggagcaggagccagatactcaggttggggtgacatgccaattctcctcactggaaagtggcacagatgtagtgaccctcggtcatggtttgtttggtctcagctgccctttctttagaaagttgcattattactgttggacatgccttcaaaatgaaatatcctctttaaaataagctcttttgaatagatttagtattttccgggaataaattctgagtttctcaggcaagtccagaactaaactaattacttgcatattcttactcttacagaagcatgctttaaaaactgctggttaaagttattgcagttagaaggaaatattgtgtgaattaaattttttaaaaaaagtttttaatgcttccttagaagaaaatattaattttgccaataagtagaaaaaactggaagcaaagttcctatagtaacgttatctttgcctttacacagctgcattattattaccccattggcctgtgtgattaatgctttttcctcacaactgtggaagcacataggattctttctgtatcactgcatatgaacttcaatgctgctttcctagtaagctgtgtaaatatgtggtctcaatatgtatctccagtttgacctttatgcttttactcctgccaaactttgtccttgctgtggtatctcactacatctattgcaaacttttcctcatctgccagaaatgtcattgctctaaaaatttttattttgtctttgtatctcgcaattcctgacattatgcattattttcccccatgtagttcaagctgttcattttctctcagtaaagcttctgtttataagcttactgttttttgttgttttgcaaaattaaaatatattgcttcctaaatgcttatttggctccctgtctttgaagccagcctcattctgagttaaaacaaatatcttacattgatttgtcttcatagttcttctggttcctcttgttcctgttggttatttaaggatgtggccttaacttagattcttagctcctcctttcctccctccttccaacattattgaatatttgctctatgttagggactcttttggtctccagaaatagagcagagagcagcttcctgagtggtgtgcttgttcgcatgtttttttaagggtctagttttattcattccacaaatatttagctgaattttttttttttgagacagagtcttgctctgtcacccaggctggagtgcagtggtgcggtctcagctcactgcaatttccactcccggtttcaagcaattctcctccctcagccttcccagtagtagctgggattacaggcacctgccaccatgcctggctaattttttgtatttttagtagagacagggttttgccatattggccaggcgggcctcaaactcctgacctaaggtgacctgcctgccttgacctcccacagtgctgggattataggcatgagccaccatgcccagcctagctgaacatttaaggtataccaggtactatcctagcatagggatatagcagaaaataaaactggcaaagtctctatcttaaaataccttggtttgggtggctaaaacaataaatttattcctcataatactactgaaggctgggaagtccaagattacatgctggctattgttgggttcctggtgaagaccctctccttggtttacagacaccttcttgctgtgtccacatggcagagagagagagaaagagatcagctctcttgtttctttttataagggcactgatcccattcgtaagaactctaccttcatgacctaaatagccccacaagtcaccactttctaataccatacattgaggaataggctttaacatacgaattttggggggacacaaacattcagtccgtagcaatagataaagagcaagccacataagttatctggggaaagagtgttaggcagaggtgacaccaattgcaagggccatgaaactgggagtgttccaagatgggttcaggaacagccaagaagccagtgttggctggcacggtagtttttgtgattttagtttttgtgattttatttgcatttaaatctggaatccatctggatgttaatgaaatgaaatgctgtttctagaagaaggttgttgaagtaatactctagaaagttaggatgcagagccagaggcacagtgctcacctgatctgggacatggagcagttttctcgaagagtttcaagaaaagataccataacggagacgagccttgtctcatgcttcttatatttatcctctgggaggatttcgttggctgttactggtatagcccaggacagtggttctctaactttagggctgaatcagcatcatctggagggcttgttaaactatagactgttaactaagtaagtcccacctccagaatttgactctctaggtctgggtaagagctggagaattttcgtttttagtaagttttcaggtgatggtgatagtcctggacaatactttgagaatcactggcctaggggttctgagcttaagctctggaatgagagttttgcattcaaatttctgttctggtatttactaggctatgatttggggtacttttgtgtgtatattccccctcccctcaagccacagtttgctttctttgaacccagggtatgtacttcctagagccactgtgaagactaaagagaaatactgtatttgaaatagcacataattgaaacctggcaagtgctcctaataaatatgagttgctggtgcttttactgagctctctttttggttagagtgtgtctgacccagtgctgctcaataaaaatatgtaacataattttaaaacttctagtagccatataagcaaaatcaaaacaaggcaaaataaatgaataattttaacacaacatacatgaaatattttaaaatataatcagtataaaagtattaaggttttaaaatattattttctttatactaaatcacttaatttggtgtgtcttttgtacttaagcacgtttcagttcagaccagtcacattttaagtgcttaatagccacatgtggccaatgacagctgtttcacatggtaccagtttaaccagcactcttcctcaccctttcctcttggccacctccattacagattcttagtctaattagttatagacgtggaagtaagcttgttttagttaatgcacaaagaatgaccccaggcatggcaggcatccttgacaggcttttctgtctcttaaaagttcagtcagggataagagtttgtctttgtgggagtcagttttcactaaggatgtcatgtcacttataacccaatgtcctttgaaagatctctttttttaagttctgtgggtttgaatatttcccactggaggagggtctctggaaacctcaggagtctaaggaataactccgcctgattcttaaaagctagtcacgtgtgctaacattggtttccagaactcagcgtcttgactcattggacaggcattttccctctgtgtgtctgtggagactgttgtgaaggaggatccccttaggatttgtgattatttttattttattaatttaatttaatttttttcatttttaaaatttattttattatttattatttactttattttctttgagacctagtttcactctgtcacccagactggggtgcagtggtgcaatcttggctcactgcaacttttgccccccaggttcaagtgattctcctgcctcatcctcccgagtagctgggattacaggcgcctgccactacacctggctaatttttgtatttttagtagaaatggggttttaccatgttggccaggctggttacgaactgctgacctcaggtgagccacctgtcttggcctcccaaagtgctggggttgttgcaattttaataaacagggaaatttcacttgcccctgtgtttctgcacagtagcatatttcaaaggcttgtggtgtacttttgtcttcagttaagtattcatttagcaaatatccgagtacccactgtgtgtctgtcagttttcttacgcttttacagaccctattttggagtttcatatttttcagtgattgttttttaatcttttagcttttatattataagctactcaatgaaatcctaccagaaggagttttggttattaaacttttgtatttgttcaggattcttttgacatttaacccatttgaaaataaatatatgaaatgttaagatttttttgcctgtggtgataaatcatgtttggtaatacctttaaatttataaatggacaatgtgatttgcatttttttgaaaatactttattcttgctgactggctttttaaaaaattgattgggacttttcttgcaacttatgtaacaagtttgggaactgtgttgtttcttagactaggcttttaaattcactcacccttgaagggctctcttttgaatttgtatttctaggtagtatttcctatgcttacaaaaaaaggaattttttgtctttgctgcccatcatgtatcagcatttaatttatcttttgctactgagagaaaatgatgatttgggtgtgtttggcaatagaagcaaaacctagtatagtgcaaataaatgaaaagagtggagctcccacaatcattcttctcctctatcaactttattgtttaaaaaggttcaaacctacaggaaagttaaaacactagaacagtgaattcctatgtatctttcactgagactgagcagttacttgcatttttccacgtatgctttccctctcttcttctccctttgtttttttgctgtcttgtagctggttgcaaacattgacactccacccttaaattcttcagcttattctccccaagaataaggatattattttacattgccacaatattaagaaatatacctaagaaaaatatcaataattccataaaattgaatatacagccccattcaaatctctttaattgcccctcaaatgttttttattgtagttttaaaattaatccaagattaggtttaagtgttttattatgtctctcttattttcatctacgctggttcctttgacaaattttggtttgtttttttgtttttcctgtcatttttttttgaagagtctaagccttgatcaaagtctgttttatacagtgtccaacattctgcattcatctaattggtttcctcacaattcactttagcctaaacattttttggcaataatactttattagttgacatgcatttgttactgcatcacattccataacatcagattgtgcttctcttggtattgccatgtttgatcatgtacttaagttgatgaccaccagatgatttcattgtacacatacatttttccatctgtaattactgtgtaatctggtgagttcaatctcacgtttggattaaaatttttatcgttaagaagtgtctttttaatctagaaaaaaaaacaggttatttaatagcctatgtcacattttgtttttgtctcctttatgtgacatgatgaaaccatagagctaaaaatacaacctttgctgatttctgttcgcctttaaaaaatgattttattttattatttatttatttatttatttattttgagactgagtcttgctctgtcacccaggctggagcgcagtggcgtgatctcagctcactgcaacctccacctcctgggtcgaagccattctcctgcctcaccctcgcaagtagctaagattacaggcgcgtgccaccatgcctggctaatttttatattttcagtagagatggggtttcaccatgttggccaggctggtcttgaactcctgacctcaagtgatctgcccaccttggcctcccaaagtgttgggattacaggcgtgaaccactgcacttggcctgttttatttttaaagagactgtttttctccaaattattgataacatgaactgcttattgttaccaataaagtatgtgtgcacgtgtcatttcctttaaaaactcaggaatttaaagtaaaaaaaagttttctgaaatatttcatagcttgcctttatcttactcagatcaaaattgtcacgtgataatgattggcttaaatgtacttacattatacaacacagtagtatttttgttttgtttatttagcatgtaactctaagttctttaggctctttgtgatattttcattttttgcaaagatactaaaatccttgaaaaagtgaatgttaccagtaaagataaatcgttatcgaactaccattccaacagagtatatcataggaccggtaaaagaattggatttctaactttttaaaaaaacgatttttacatttgcttactagaattatgtgtctgtagttcaaagaacaagttcatggagtgtgtgtctgtgtgtgtgtgtgtgtgttttggcttctgttacaaaaaatatgattacttaacaattataatgttatgatcctgaagatgatggagtcactgtaggaaaaatccttcagtgtcttccataggacagcagcttatttcgcctccatagtggaccaaggaactgacaaaacactcttttgtttggtttttatttttcttagaatggcttctactcacaatcaggttaggcagaccacctggtgtctgcctgtgaatggggatatttatgagcagtctgaagcagttcttaagtgtccacttctttgatagagagagactgcttattccaagctcagacattacttttctctcagaaattgcctgccaacacccccctcatagtagaatgactaattatgagctgcagtcttaacatttttcattgttttgacgttgtatgcttggcagggtatagggtagctctttacttcttcaggctgtctatatttatcaaatacagtgtagatgcctttataatattaaatatgtgatttgtaactcttactctccaatttctatcaataaagcacagctgcttagttacaactctggctggattaagcagtttgttttattttgtggctcactagagtaatttgaaacaatgaagatttaccaaggatataaggccagatttttgcaggtgctgttgtgtgttttgtaaacaaacattcatctttagtggctagatatcaggcaggtccccccaaatttctggtgtacactagagatcagcccagatgtttcttatccggggtgggggtaaagagagggtgaccctaatgatcatgctcaagagtgttatgtttggctgatccagtggttctgactgcctttgttccaggcagtgtgtagcagtttaacagctcctttgaatgtgttagtgaatgaatgagagagtaaaagttggggataaaagcagaaaggtggtggcatgataatactggagaacctgcgtgagcatattaattatatgggtgcagtatgccatgtcaaggcagctgctgactcttgacagatcctattaaccccatgtttttttcttcttcttttgaggtgatcttcttagtagaaatttaattttaacctctttcttaaaataaggaaaactaatcttgggtgtcagtcacattcataattgtaggggcaagcattttagaagaacttaactgttttcaagcactaaattctcaacctgagttgtcttcagcaacctaaggtattaatatgtctaaagagcccggtctcttggtttcttgtgcacgtagtttttgggtttctattaatgaaaggttctggaggttctagaataaaacaggtatacccttttggaaattgcattattaacatgcagtgatcattatttcttcaccatgttgttggaaaatttaattttgcagtgggaataaaaaatgtttaagaattcaattgatgtttattaattgttgcctatatatgttatgtactgtgcctggggaggggaaatacaaagatgagtaaagcaggacctcttccttaaatgaaattttagtttttaaaaagccttttaatgagcacaaaaagccctttagtgagcaaaacaaacacagttagtaagtaaaatgagtgcatgtgattttttttaaaggaaactatcaaattattctaaatataaaaattttaaacgaaatttaaaacagtgagacttggccgggcactgtggctcacacctgtcatcccagcactttgggaggccgaggcaggtgtatcacttgaggtcagaagtttgagaccagcctggccaacatggtgaaaccccatctctactaaaaatacaaaaaaattagccgggcgtggtggtgggtgcctgtaatcccagctactcgggaagctcaggcaggagaatcgcttgaacctgggaggcgtaggttgcagtgagccgagatcacaccactgtactccagcctgggctacaagagcgaaactccatttcaaaaaaaaaaaaagagactcttatctttcttatcttgcagaagaaaaggaattttaagtgcagattttcaatggttataattttccaacaccagacaaataatgaacacaaaatatatgctgctgtaagattatattgatagtctcacagtatttctcttcagcattattatctgatcaacacatatatgaatggaatagtaaaacttaacatttatcatacacttgttatgtacttatttcttttttattatcacaaaagtataagtgtcctcaatttaaatgaggatgcacagagattagtaaccatcccacagttaacagaactaatagtttagcagagcctagattcaagccaagcagtctgatcttttatccaacatttcctgagttcagttattcttagctgccccttaaccccctaataggttttttttgttttgttttgttttctgttgagtatggtttggaagaacctgcaaaactctatctaaaatgaagggatacattaacttttcttcagactaatattgtaagagaaaaaatttaaggaaaaatttggttaatttaattatctaaatcattttctgtatattttccttcaggttctttatatatatgcatatttttgcagtgtataaatatatttgtaaccttatattctacaatatgagacatttcccatgtttctattttgttttccaattattttgaattgttgcatattataccattgacctaatttattcacatttgctcatcttttgggattgttttggttgtttcagtttttcattattatacataacatagtaatgaacattttctgcatagcatatttttcttctcttgaattatttttgtaggatacatttccaggagagtcacatgtactctagaacttcatatgttagtttgtgcctggcagtgcctttattatgtgaattaggtagggagaagtaaatttgcagaataaaatgtgttatattccttgtaaagtcatttttgcattatccagtcattttgcatataaatagtagaaaggggtttagttatttatactgttttcttatttccattggggaaagtaagaattggggagatacaggcaatattaaattagaagtgctttaacgtatcagtcttcttcttcggcatagtcttttagttcctatattttcaggagtatggctggtatatgattccaggccctacaaagaaaatgagaatggaggaaagaatagcattgtaatgatagaagagggttaaggaacacctgttgactctgatgataagaattatgatggatttgtcattcgtacagaaagctaggaacttagctcagatgcatgcatagtgtgagagacaagactcaaataaaaatacacaggtagttcatatcactagagagccccaagctagtttctacttgaagttaagacagccactgcaaggagggagggatagctgttggggtaagcttgggagcactgtgaagcacttctgtggtcccttgtgctcctgggtgaattaactggaggtgctttgctttcctcatagagggccatgaccactgtttcattcatcctttgaatcctagtgtatacagtgcctgacacatagtaggcccttagtaaatgtttattcgatttagtagaattcataggtccgtcagctttgaaaagagtggctagcacatgtgcaattaaaattgtgctagagaaatagaggattattgggcagatgcaccagtttggtgggaagagactttggtgacttcagtggataggtagcagaattggaagattgttcaggaagaagggatggtgttaactgctatattgaaatttcctttgaaaacttaggttcacagaaaaacctgcatatgaatgtttatcatggcagctatattatgatctccagaaaatggaagtaactaaagatgttcttcaataggtgaatggataaacaaactgtagaatattattcaactgtaaaaagaaataggctgtcaaaccacaaaaagacatggatgaatcttaaatgcaaattacaaagtggaacctgattcaaaaaggctgcattctatataatttcattagtatgacatggaagatggaaaactaaagtgatagtacagagatcagtggttgccatgagttcaggaagtgaggaggattgaataggtgaagcacgggggaatttttagagggatggaactattctgtatgatccagtggaatagtggctacgtgacagttgtcaaaacatacagaacttttgcagcacaaagaatgaattttaatgtgtgaaaattaaaaagaaaatgtttaggagatcccaggatagaatgcagaatgttttaaaaacagactattacagatgtatgaaacatctgtaatgaggggggcgggagggggagagaaaaaaatgctgaactaagtaaatttggaagtaagtgaattctgaaagactaaaggcaaaagaacctgcacctgagtattgtattctagctgatgaagttgtttttcatgggtgtacaggttaacagttctgatactgttatacatgtatactggaattgaccaaataaataaatggatggtggaagccagatttctcattgttggggtgggtatttacagaagagtaaggggaagaggctagaatggtccatgtggtaatgaattagagaaggatatatcagtaatgtggatacttaatgtggatacagatggttacatatagaaatatttacagagatgaatgtgtacacagattggtatacacatatatttccttgctctgtctgctgagagggcctagatgcagcaaacagtgattatatgtagcacctagatcctggtttctaataaccattctccaatagaagcaaccagggctcttggagaagtggtcagttctaggactggagtaggaaatatataaattgagctttgaacatattatagtgccaaaaagtaaagtgctttaaaaaaccccacaatgaagggggcatgtcagagggacacaggagccagctgaagagctcccagtggcccaagctggaaggaactatttgaacaacaaaataaaatactaacaagttgtaacccgaaatataaaataaatatccatgagtccatactgatatataattagtgatagataactaaaagagggagaaagagataaatttgccatgtagcattccaaataatttatgtagctactctgccattaaggagcaaggggagcctgactctctgttccttaagtgtgggctgtgctgtgacttccaagtgtggaaagggagggaaagtaactttaatggagaaacctgacaaacactgcctcagccaggtgatcaagattaacatcagcagtgataattcatattgattgcatatacccttgatatggtgtgatgagaatggcctctgtgatcttcctccaatcccattaatccagtttaaccatgagaaaaatcagacaaacccaaattgatgagcattgtacaaaatacctgaccagtactcttgacaaatgtcaaggttatcaaaaacaaggaatatctaagaaactatcacagctaagaggaacataaagagacatgacaactaaatctaatgtggtgtcctggatgagatcctggaatgggaaaagaacatcaggtaaaaactaaggaaatctgagcaagtgtggactttagttaatagggtgtcaatattggctcgttaattgtaacaaatataccatactagtgtaagatattaatgataggagaaattggctcctgagtatatgggaattctctgtactatcctggcaacctttttataaatctaaaactattactaaaaaataaagctttatagattccattgattagaaggaaaaaataaataaagcttttttaaaaaaggaaaatacttctgggtggcacaagtagaattgcttttacttatccccctattggagtttaaacaatttttaaaaaaataaaagcaaattcagataccaaacaaaccaaaaaacttactgtgatgatcctgagaggttttgagatgatgttgatctcagattgatattgatcatttgcgagacccatagcaccttccattaattaattataaattcttctcatctaattctgaaattgagaaactgtatttcccatgccctccaaacaaatttgtgaaagagcgaaaatttcatagatcctgactgtatttattagttcattcttatactgctaataaagacatacccaagacagggtaatttataaaggaaagaggtttaatggactcacattttggcatggctggggaggcctcacaatcatggcagaagacaaaggagaagcagagacacatcttacatggtggcaggcaagagagctcgtgtaagggacctcccctttatgaaaccatcagatctcatgagacttaacttatttactgtcaggagaaccgcctgggaaagacctgcccccatgattcagttacctcccacttgtccctcccatgacacgtaggaattattctctagtaaaacaataaattagatcaaggatgctaaactctgtattcacctaatatatcaatatttagactaaaagaaaagactaaaagacaaaaagaaaagatatcagaccaacagccataactcagttctcttgtgtgtaactactttttactcctagagacaaaggagttgtctttacttttattccaaaatgagatttgggtggggacacaaccaaaccatatcactgactgagtcttgcgcctaccttctgcttaatgcttctttctttttagaagtagaaatattcatgaatgagaaaattataggcactggaccttcctctgatgcactgaataaagctcagagttcgctctaatcacacttgaaggagaataggttgaagaatgcagggtaatttagaaatgcaagaatgcttgtatatccttttactaaggagatttttaaaaaatcttcaaaataactctgaccacccttagtgtagaaagtattctaactcatttttattcattcttttaaataagttactttctcttgacctggagtaggacagtcccaacttccagttgaataataatcccctagaaacaatgctttgttatttctgacactggttcactgctctcctcttcacagatccattactactagtgtttgaccttctggaaggcacaaggtgctcctgaaatcatagttaggactgggaactgaagggctgatgcaaatgtatcttgtaagacagtctgtgttctgttacaaatgatctccatcctggtgttctttcctgcccagttcatttatttttcctaggatctttgcacagagcagagcaacataaactctattacagtcttatcttttagtgggcttttggccaaaggttcagagctctagaatttagaattactttttacttcataaaatcacagggttgatgttagcactttttttttcagccattaattcatcccttggtcatatgtaaataaactaaatttgtatgatgtagttggtggagtgagatgtctggtttattcagcttggaaaacctctttcagaacatggataaacatgtatttgtgcattcccatagcttccggcaagctctgtagagaaggtcagaggaataaaagtaaaggcaactcctttgtccctaggagtaaaaagtagttgcacacaagagaattgagttatggctgttggtctgttatcttttctttttgtcttttagtcttttcttttagtctaaatattgatatattaggtgaatacagagtttagcatccttgatcaaatttattgtattactagagaagtacatttttaccagtgaaaatacagtcaagtgtgaacattttaaatgcagaaagcctgagattttgtcctattcaataaaacggctgaattatagaatactcaagagatgttgttttccttaagaagatatactataaatattcatgcgtactaagcctatagaaacataaactaggcttagttcaacaataaatacttgcaagctcaatgaagacataatggatacaaagatgataccctcaggaagcttatagtttagttctaaattacactactgtattttcttttcttttttttttttttttaaagaaaacagtttaacatcaaatgtttcccaggtttactttttgcacagtgcatacagttttgggaaaatatgtggttacaacacgatattctaggccagttatgttggctcacacctgtaatcacagcgctttgagaggctgaggcgggcggattgcttgaacccaggaatccgagacaaggctaggcaatatggtgaaatcccgtctctacaaaaaatccaaaaattagcctggctcggtgttgtgcctgtagtcccagctactcaagaggctgaggtgggagaatcacttgagcccaggaggtggaggttgcaattgccactgcactgcagcctgggtgaaagagtgagaccctgtctcaaaaaaacaacaacaataaaaacaaaataaaacaccctatgatagtccacaatttgttcgatgctactctagatcatcctaaaggaaaaagcaatcagtacgacaccaagtctttagaatttcgaggattggttgatattatctcccagtagatgagagagcagatcttattttttttctgtgagcagattcgctggcttcatctgggccttccctatgctaagttcaattattgatattttctttttaaaaagccacataccttgctaacacgagaagagggctggggggaaaatgccacacttggacagaatgactataattatcaaaaccagaaggccatcaacgttgcctccaatgatggtaggcaaagaatgttacttctcatctttcaggaagatgacaatgatcttagttcgttggttctctatattcagcccctcatatagagatttgttgaaaggatccacagttcagttacatatcttggtaacagtttagagtgacccaacgaaatctctgcagccatggttacattttctttatgtgacgtgatggcatagctcactgaatgccattcttccacatgctgaactaaattgatctcataagtgtgcttctgactttggatgcacaaagtgtaggcctgaaatgaaagctattcctgggatgcactgagcaaataaactgccatagtcatctgccccctctcctctataccgctgtattttaatttagtttataataattaaaacagcttgtacattgtattttattataaatgcaattaatgaaatatgagtaaatgaacctttagtattaaaaaccatccataatctttttttttttttgagacggtgcctcacttttgtcgcccaggctggagtgcatcagtgtgatctcagctcactgcaacccctgcctcttgggctctagcaatcctcccacttcagcctcccaagtagctgggactacagtcatgcaccaccacgaccagctaatttttgtgtttttttttttttgtagagacggggttttgccatgttgaccaggctggccttgaactcctgagctcaagtgatccacctgcctcagcctcccaaagtgctgggattacaggcgagagctacagtgcctggctagtccagaatcttaacattgctatttgtatatctttttccttctgccttcagggaacccctcaatcactgcttattactgtgagtttgctctaacctgctgccatcaccttctgtcgtccgaatgaaaaaactaattttttcttgatgactctaatattgtttgaggggcaattcttctttttctcagcttttctcattaatgttgttatcttttatatgaaactgaaggatggccaaatcccattatccagctatcctgggtcagctttctaggttttacagtggtcccttggaggattttaggagtcctgtattttaaaaatttggtgacatggggtttagtgtagaagatgcagagaggccatgggaagggattccagtttgtatcccagaacatggatatattcaggttgagatcttgtgattgtcaaaaactcttgtgtattttgaaggtgatttctgatagtacatatttggtagaatcttaccaaggaggcatttgatttccaacacgtttgctcatagcattatattgcttgccttggtgataccgtcagtgttcctcctctgcaggatttttatttcttttaaatttttcttttcttttttctttctttccttttccctctcccttcccctctcccccttcccctctccccctctccatccctctttaggacagcagtgtcctgatagagttaacacacttggaagtgctaaagctgtctacacacacacacacacacacacacacacgaatgaataagtaggtcttcagattgaacggtattaaatgtaacaatattttcatttatactttgatcctatattttctaaattttcaataatagaatatgcagaatataagtttataatcttcagacttgaatttttagcccaatacatgatgttattgtagagtaggaatggtatggaaaaatgaaatcgagagataattctcaacctttattcttaatcatttaaagtcagaatttttgtctcttccattaaatgtctggctataacacagatcatcatcatgtggcaaaggtatgtcagactgagaaagagagtggcagttcttttggggggctcagtaattagagcttacctaaaacccaaaatgttgaactagaaaatcactgtggtctcttctgattctaaaagttggtgattttcttgacatcacaaattcatgcagttgcgtgtgtgaatagtgagatgttaaacctgtaacaagaagagatagatcttcttcagtgagataatcagcttctgggtggctgagaagtttttatatgagtaagatcaaaaatgagagtctgctcagcagatttgcagagagtctctgataaatttctttagtgccatttcaaaccccaggagctccacatatgatggttttatattgggctctgttatgggcatattctatatctctactctcactctgcagatctgtcgaagcatgttttgataaagagtattgaagtctcaaagatgggttttaatatctttaccaaaggatggcagacattgacagatggtttctaaggatagttccttgcaatcaaatcttatttatagtgccagtatataaaatgagtataggtggtgtgcattattacattatcaataaaaactaacagttgatttccactgtcaatggcatctgacttttctagatcagaatcatgtaatgtggtagaaggagctcttaagtaggattgacaagcctttatctatccttccctctctgttttgagcacttgggcaagtcatttgagctacctgagagactgtttttagaatgaatcacttttcttataatgatggatttttaaaaatcacattaatttattatacagttgttacattctgcatggttaataaaggatgacttgccaagagaaatcttaatttcatcaggtttctagaacagtttttaaaacagtattgaaaacattactatgtttttatacttcttcactgtgtatgaggaaaagttgaccacttgagtgttgttatcaatgtacactaaactagatgtacagttcaggggacatcagcacatatatggacatttggcagatttcttgagccaataattctggtccttctcttttaaaagttcttagttaggtaaccacagataattgaaccagagaagtcgtctcatggtgtgctaagtaaacacagatgaagatagagccagctgacttcagcaactcttctctgcatggtgtgtctctgagacttacattgaagatgtataatatgggttacttttacttcagtttcttgtagttacagcttctgcatgtatcatgccccagaaaaaggtaatcatcttcccattatgacatgcagtatacaatttatagtcttttttgtggggaaggagttggggaagaaagtgagtttaatggacctgaggtaatgtttaataacaggatatgtaagttaaattgaccagctgttgtatgtctctgtgtttgctgtgatagaatttgggatagtgagaaatttcacactaattttattcacactaaacaattctaattgtttcttttttataaaaaaatgtgaaatttgcctaattaagaggctgtcctttttaaattaaatataaatttggtgttcttctggaactctgctgtttcgagtgctttttgtcctcattcagtattattaatgcaagacaacctgcttgcatgcagctaagcatggcttctttctcttatgtataacacagagtgggcagggtgtacaaaactcatctacatccttctcagaaaacttctgtgtaacactgccatgtgctaagcctacggaggtgaggaagagggttttttttttttttttttttttaattgatggttttggctcaagctttggagggacgaagaaatggtgtggattctgtgaaatcacaggatgtctaagttccaagggctttaggaattgcctcatatcgtgcgtctaaatattgcacccctgcccctcttccagtccagactcatccgagaggatcagcacaattccattagtaaatgaagtcacaacttggggattgatggggataattaataaaaagggccacaagtggttccaagtgctcctgcagtcatacacacacatactctgtttagcatcccgagttctcagagaaggaagaggtgtggagaagttatttgaatttgttagttctcagatttttttatcagggtaagcagtttttaaaaattaaagagtgaagagaaagtgatggacatacacttgccaacttttattcatttggacatttaaaaggaaaatcatcaccatagagttataaataaattataacaaatgtaacaatatagcatatatttagctttatgaaaaactgatattgtccttctcatttaactataaaaatttcatcactggctggatgcttggtggctcatgcctgtaatcctaacactttgggaggctgaggattacatgcctgtaatcctagcactttgggaggccaaggcaggaggatcgcttgagctcaggagttcaggaccagtaaaactccatctctacaaaaaatacaaaaatttgtccggcatgatggtatattcctgtaatcctagctcttgggaggctgaggtgggaggatcacttgagcctaggaggtcgaggccacagtgagctatgattgtgccactgcactccagtctgggtgacagagtgagaccctgtttcaatttaaaaaaaaagatcacttagttcgttgtgtaggatttaggaattgctaatcaagtagttataattaacttgaagaataatttaacagtatacattttaaatttaaaactatggtattagcctatatcagctctaagtgaattcttgcctgatgcaagatgtgattcctgcacagccacagaggggtatttttaattaatttaggctcaataaactaaagaagcttttggaaaatttgaacacaactgagaaagcaacccacatcagtttccgtaggtactcacaaagctgggtggtggtgtacattggttatattatttacaaatacaatttttgggagactgtggaagggataacttgaaatcttgaagaatgatttagggccttgttacccaaagtctgatccagggactagctacattaatagcacttgggagctgctggaaatacaggcctcaccccagacctgctggatcagaacctgcattttaacaagatccccaggtgattcacatgcatagcaggtttaagatactgatttagagtacctttctgaaaacaagggtttcagttaggtaactttcacatagcctttgccttatctaattaacaagtgttccaaaaccaggattattagaataaataggttgttgagaatagcaattaagactagccttaaaaaaaggtagtatagaaaggccttgagacctgcattaatgataatatagcttataattagcttatcaattaaatatgcatggctgtatctaaagggcttgaaaactgtttttaaggtttttcttttctatcttgattttatatttaggaaaacccaggtaaactcacaaatagaggaacatttttttaagcaggaaaatatgtaacaatttttgggccaaatgcttaagaagtgagaattttgaaatggaaacaaaagttggaatctgtcttagaagtaatctactccaccccttctctcccagcagtttgagtgctctatttaaagctagaattttgagcatgagaacgccactgtggacaacagagagattttctctctctctcacctcttctctttctctccttctatctccccctccaccaccatctctctcatcttcttccctttgtccccaccccattgcttttttctttctgcttttcctgttccctatccttacgcaggattgttttactgttagccaggttaagtttaagcttcttgaggactttagtactgaaagacaatggctcacttgtaagacctagttgaagagtacagatttagatttgttcagtgtgctgtgatctgtaaaaaaaaaaaatcacaatgggatttctactaatggatatgtaaatatataatcattccttttatgcttacatccagggtttaattaatcctttggtaattaagaatcccttcaaagtttgcttgtgagcatgttgttccgaccagctattagctcctatactaaaattggttgccttgcagacctgtgttatcagtaataagcacctcaaaagtcactcaggaggaaaaccgaatggaagacctgagcagagggaatcttcattgtatacctttttgtgtcttttgaattgagccctttgagtatattaactaatcaaataaatagttaaataaaatttaaagagaaaactttctaaactttttcactatgagtgtgtgatctctgatgccaggtactgttttgtggaaggggagaaaatactaggtttcggtagcatcttaacaagtgataaatgcttttggctttatttctcactgacatcttgtacttctggtggtgtatttcttctttctactgaccagcaagtaagttccaaaatactgctgaatatcaggttagaagagagccagtgtttatttcccaccctgcagtcttcagtgtaaatatctgaaaatggttatattgggagagacaaaaagatcttccaaatctctcttatacatctgttagtctacaagagcttgccaaaactgtattctgaacttttacaggatcctgctataacccagcatacgtagccaccatccagattttgttttaaaagtaggtgtggtttaatttatattgaaggaggtttcccaggaagttcctgggccagattaggtctcctccttcatcttaaactccaatagaaatacagaaacctctctgctttgatctgaatatgttttaagagacaatgttatgactggtggttaccgttgcattttaagttataaacagtatgtagccacttgccagaattaacaaataggttagagttacattacattcttttgaatctgaaattgatattttatcacttgttttggcctttttgctgaaatgagaatttgtggacggtgggggcgcaagagaaaaaaatgttggttccatgtctgtcaggtaactggcagagttaaattcctatggcatatttctggtcgcaaaaacatcactaaatgtctaaataaagaccaaaacacttctaacattgaatattgacataaatgtgaactgtacatatatttaagacagaaactaagcacaagataatatttacccagttattccagctcagggtgccaggtgagaaccagccctggacagggcaccatcccattgcagggcgcactcacagtcactcattctggaaccgtttagactcatcaatgaacctagcatgcatagctttgggatgtgggaagagtacgcagaaaaaaaacaggtgtgcatggggagaaggtgtgaaccatatagacagtggcctcagttgggagttgatttttttccccccttaccatccttctaatgaaatgatgttgaaggaaacagtgttatttgaggagccattgtacaggactttaactgggattttgaaagtttatatctaacactgtcattttgattagattaattcaggtttggtgatatgttgcttgcttttgtcttcagctgttaagtcttttcatgccctggtctatgacaaacatggacctgttttctgtcactatcattttgcttttacgcccccaaccttttttttttttttttccgagacaggatcttgctctgtcacccaggctggagtgcaatggcgcaatctcagctcactgcaacctccgcctcacgggttcaagcaattctcttgcctcagcctcccgagtagctgggattacaggcgcctgccaccatgcctggctaattttttgtatttttagtagagatggggtttcaccatgttggccaggttggtctcaaactcctgacctcaggtgatccgctcacctcggcctcccaaagtgctgggattacaggtttgagccactgcgcccggcccaacttttttttttttttttttttaaagagatgaggactcactgtgttgcacagcctggtcttgaactcttgggcccaagtgatcctcgcacctcagcgtctcaagtagctggcacttacaggtgcatgccaatgactggctcattttgctttttctaaaaattcatattaatggatgtatacagttgtgtctggcttgtttcaattcgcataatacgtttgggactcattcatgttgttttcatgtagtttgttccttttcattgctttccattgcataaatttaccacagtttgttgagctgatggatatttgggttatttccagtattggagtattttaagtttctgtagacctttgagtacaggtctttgtatgaatgtatgcttttattttcttgcataaatacacacagtagaattttggggttgtatgataaagtacagcagctgtatgcttaactttataagaaactgccaaactgttttccagagtggccgtactgttttacaaattcccatcagtagtacatgagcgttccagttgctccatatccttgccaacacctggtgttgtcagtctttaaaaaattttggtcattccactgagtgtggaatgtagttttaatttgtatttttaattttaatttgtagttttaattttcatttccttttggtttgtggatttgtactttgtggcatttatgctaaaagtaccaaggaggaagaaagttgtttttttcttcagattgttatcatcttggtttgtaacttgtatgttctcagaacattatttgattctccacaatcagtagcacaattaattttatattaattggttttgtagttgtccagaactctattacacttaaaacgtgatcaaatactataaattattatatcatttatgatcacacctgatcaattaagaggattcggggaaggtaaaacttcatgtaaatctttggaaaatggttttaacctgtttctcagctaattaaagaatacgtagctatatttcttgtcattctttttttggaaactataatatgaaagttcaaaatataaaaaagatacttaaaattagacatttgatagttgggatatgttatagtactttgaaacaaattctgtaatagtattcagaattgagatgtttagcacacactgcgtcagttatgttaaatggtggggatggggtgtggcaggcagtagtggaatgtagaatgctgctgtatgctgtgtaatgtaagcatctccgttcctagtggagaagttgcgtcgtgttctcaagaagcacagagggagacatttggtaaagtaccaagtagttgaatgaaatacagtacatagcagataaattttgtatatactaacaaatcagtagctatatttgatatcctgggtagccgtatttgatatccaaactattaacacttcattaccctgaagagcttcctcctttctttttgatagtatttttttttttttttttttgagtcggagtcgtgcactgtcacccaggctggagtgcagtggcgcgatcttggctcactgcaacctccgcctcccgggttcaagggattcttctgcctcagcttcccgagtagctgggactacaggtgcgtgccaccacgcctggctaatttttgtgtttttagtagagactgggcttcaccatattggtcaggctgatcttgaactcctgacctcgtgatccagccgcctcggccttccaaagtgctgcaattacaggtgtgagccaccatgcctggctgatagtaatttttaatctttatgtgatgaggtgtgcaggtccagaaatcgtaacatgaatggcagttaaaggcctttgagaaagtaggggagggtgatggatgcatcagcctcggccaccctctagtggctgctctgaccatattgcaacttcagttgatcctcttaagtgtacatcaggagggggaatggctgaggggcttgttgttttttatacaaaattcttttttgtattataaaacatctggagtaatctagaggaataacttcagtaaggagttaccttaaatatcaacattggttatttgggtactaggattatggatgattttattttcataattatacttgagtgtattttctaaattttacgtagtcaactttttgttctaagtcagagaaacagaaaggaagactcactgatcacctctgtgtgccagacactgttatatatatcattcctaattcctaatacacgaatttgagttacattgattagtatatacaaaatttatgtcctgtattttcaacttcacttggggctttaatggaacactatcattcgctaacatttttgtggcacagacttcttgctgatgttgtttaccagagtgtcctttgattctacttcagtcttgcctagtaaagtcatctttctcccttaatgaatatctcaccttctttcgggaccactcaccagtctgtgaaccttcaaaacaaatacattccatgttcttattcatgttgacatatgtttgatatagtacatactgccgtctgttgtagttatttgtgtgtattgcctatttcctagctttgcatcctacagccccagaacaacacatagaaagcacacagtatttgcctaaaaccatatattggaagcttctacctgcctcagtttgtgatgtaatggtatttgacttattttaatcagttgcttggcattgtagcacattttcctagaaccagtatttcaaatggtgtgtaggtgcctaagccctgaaatactggttttaaaacttagccacacatttaaaaactggagagttaaaaaaaaaacaaaaaaaacctccaatgtccaggttacacctcatacacgtggaatcaaagtatttggaatggaagccaggtatcagtatttttaaaaaagacaccccatgttatttggatgttcagcaaaagttaatgaaccactaccctatttaatctatactgcatgggtactaaagttaaactcctgacatttaaagttttgcttttggggaaaatacttttctcaagccagatgcaagaggttttgatggcataagacctacagataactaacaggcttatttaagcccaggtatttattgttaaaggaggtatttgtccaacttactctcaaatagttcccaaaaaatgtttgcaaggggagagagagagaatgagaatggtaaagcaaatgggggcaaaatgtaaacggttgctgaattctataaaggctgtatgggattgactaatattagtcgtgcaacttttttgtaagtttgtaaaactttttaaaagttttgttaaaaagagagagagaatttgttaacacagataaatcactaattggtgaaatagtagagatttttgtttgtaattttactttattattattattattatttttttttttttgagatggagtttcactcttgtcgcctaggctggagtgccgtggcgcgatcttggctcactgcaacctccacctccctggtttaagcgattctcccgcctcagcctcccgagtagctgggattacaggcacctgccaccatgcccagctaatttttgtatttttagtagagacggggttttgtcatatgagtcaggctggtcttgaactcctgacctcaggtgatctacccgcctcagcctcccaaagtgctgggattacaggcgtgagccaccatggccagccctagatttttgtttttaatttttaaaaatattggagtgcacagagtatatctggcttcaatcatctcttttcattcatgttgctgtttgactgaaatcctctttctcctggcggatgggattggcgggtggtcctattttctaaagggaggaggcatttcctatttaatcttgaggatacagggaagatggtatagagttaagcatcaacccacttctctgtctcttctttttgcctcttctttctgcttcattggcacaaaatactgtttccattaagatgcttaaaagtgatgcaggtgcagttctgcaaatttagaaaataatcattcgttggaagatacgttagatcgtttaattttaacctcctgctttttaccaatatgatgactaaaccaagactggtagatgtaaccttatactttatttaaggtctacaaggaggaggagtatatattttactgtttctcttgttatctagaatttaacatgggatatttacctttagggaaatcttttatattataactctgccctggatgcttagttagttaactgtgcttttgtagtttctttaaggattgtggctagtaattatgaaaatatactaaatctcattactaatcagagaaatgcaaattaaaacaaaaatgaggtaatttcacaccattttattggcaaaaattaaaatgtctggcactgccaaatgttaatgaggatgtgtgggctctgctattggtgggtgtaagaattgaatactgccttcatgaacagtttggcaatatttgataaaggaggcattccttttggcctgacatttctaagtctgtattctggaaatgcttgttcaaaggagtcaggtacaagagtattcatcatagcagtgtttatgttaatggaaaacttagaaacaagccaactctccagcagcaagtgaatagattaattgtggtttgttcataccctagaacactatgcagctattagcaaggaatacatctcaaaaacatggttgaattaaaaaacaagtttctgaatgatgtgtatgtatgacaccattatataaagttgggcaacttgcaaaatcttgtgtttgtggatacttatttgtagaaatagtattaaaacatgcattggaatgcaaaccctgaaccaaatttaggatagcagttacttctaggaaacagagaagggtataggatttgaggagtacacacagattttcaacttgacctgtggtgttttctttcttattaaaactctgaagcaaatatagtgaaatgttaagattagacaaagctagctagtgggtgcagttgttgtgttattctctgtaactttctgtatatttataaaatacatgattagatacattgagggtagtatgtttataatgggccatacattcagtcaccagtggtaacatagaacagcagactgtgtcttgcagatgagacctaagacagtagttccttagacagtagttcagaacttaggttttggagtcaaatatacctggattaaattacagcttatccacttgttagccatctgactttgggctttagtgtgcacatctatgaagtaacaatcaaacttacctcttagaggtgggttgtgagattttaaaaaagtatgcttcaagtaatacccactcaatatatgatagcttcatttagcctttaaccacctagattaaataattcttgtttcaaagaaccatacttcagagaaccatgggacgatatgttacaaatacaatatcgcttcttttctgtatgactggcataattaaaagtttctaaaaggcaagtccatgccagaacttaagagaacacactggagttatattctgtactgagttccacctacaaacttaattatgaaagatggttgaggttaactttgttattgtgctttcctcctggataagcttgctttttaaaaggaaaaagctcctttaaaaataggttcagttaaacttacaattttgcagcaacctcaaatcctcactcttaatggatttgtccagtgaaaatggtaaacaagaacacatacatggtatgtaaaggtagatataggtacaacaaatgaaagtatattttcctggactggaaaaattcctttttgcaaaggttatgtttttgttgatccttttcttgattttcagtgcagaattactgttaatatattttaattgacctttgagagctgtcttagggatctctagaaatattattaaatatattcataagccaggctcagatattcataatccatagcgaggaaaactcttccttactatgtgtcagaaagagaagaaggtagatgacctctctcccccaaatgtcttgaacttcccttttctaacctggcattgcttgcttgccttctgaccaaattcatcacattgggaagtggaagtatacattgctatctgatgagatttcattttaaaagttctccccagtgaaagcattataggcacttcagagttgtgggtgtttggcaggtgtctacagccaaggagagtgagggaaaagtgtttcaagcccagctgtgtggtagaaatggagcatcttcatccagcatctcccagtgaattgatcatgtgtggaaacaccagtccaaaaggtaactcacagcttatggagggaccagaagctttggaataaagcacaggagaaggaacccatgtgaggaagttgggcaggagctgtttggcgttacagttagaagcattgcctttccattccacgatgacttcaactggtatttgaagctagttattagtgtgcccagtgagccatgcatttctgaggtatctcagtgtttttaaaataaagtctgaaatcttgatctgcttagttccaccaaaccctgttcaaattttctgaaggcactttagcagagcttgtcttttcattttgtgaatactaaactgtaaacaatgttcttaaagcggtaaagggaatatacatttttagaatttctatatttgatacttgaaaagttgggatagaggagagacctggtgtttgtgtctcactggagagggaaactcctgctcccattaaaaaaaaaaagaatcatatatttctagatgtatatttcagtcttccgggaaactccctttacagtttaccttcctaggcaatgatacagacctgtttgttttatggaaatgagtgttaactatattttctcaaactacagaaaataatattcatgttattcgtgtcagcattcttgatctctggttttgggtattgtcccctcccccaagtcttatctcattctcaaaagtatgccttttcctaggttcccagaaaactacttataatttgcccttccctcctttttgcggactttgaggatcagctcccttttgcagttgttggtggactaaaatgacattatactatcacagttgaggtgccagttatcttaatataatatgagtttagcatgtttatatgtggcttttggaataagatgggtcaggtaatatcacctgtaacctgactcctatttttataaaatggtcattagcctcatcatccataatctttattataaaaggggcccactgatactacacattcctttagtatcttctcatattaataaatgaagaacattttagttaggtttgcattttgaaatgaaatacaaagaacctaaaactattgttttgtaatatatcacaagtgattacaataaagccattatcaggtaacgttttcctctttacattctattttcaaaacatataacgttttatttttttaaacataaaaacatactaagtttttgaaggggaagtacacacattccacagaatttttaaaaggtataagggtatacgctaaatctcccacctgctcctgatccccatccacacatttatactcattttgtttttcatatttacacctctgctgtgcccttttctttctactcagaatttcttggaggtcatttcgtatcggtaccaatgctcattcttttattgtggctgtatagttttacattatactgccatttattaaaccagttctctgttttggagtatttagattaccccctcctaggcttttactaaaacaactctccagttattatttgtgtatgtagggtactttgtacatgcaagattatatctgtaagatcaactctttgatgtagaattgatgggtcaaagtgtatgtgcacttttcattttgatattgccaaattgccctctgtagaggttgaaataatttacactcccactggcagtgtttgagagtccattctcctggcagcagagaagaaactttttatttttgccaatctgatagacttttttttttgggacagagtgtcactctgtcactcaggctgaagtgcagtggcgccatctgggctcactgcaacctccacctcctgggttcaagcaattctgtctcagcctcccaagtagctgagattacaggcatctgccactacgcccagctgatgtttgtatttttagtagatacagggtttcaccatcttggtcaggctggtcttgaactcctgacctcgtgatccacccacctcggcctcccaaagtgctgggattacaggcatgaggcaccacacccggcctgatagatttgttaaaatgatatcttattttgctttagtttgtatatgttgaggttgaacatttttaatacacttaaagagtaattcagatttctgtgaattttgtgttcatgctctttgtccattttttctattagactttgggtcttttttatttgtgggagcccttttcacattaagaaaatgagtccttttctatactgtgtgttgcaaatattttctccaacaatttgtcatttgatcatgtatggcatatgttgaaatacagaaagtttttatttttacgtagtcaaatatattagtctttacttttatggcttctggggtttttttgggtcattctgaaggttgtcccttagaaaaatttatgttttctttaaatgcttcttcggtttgctttttatagttaactaggcttatgtttttgatgaaagacatcttaaacattaatatcaaaacaccattttgtgtttgttttttgagatggagtctcactctgttgcccaggctgtagtacagtgtggcacgatctcggctcactgcaacctctgcctcctgggttcaagtcattttcctgcctcggcctcccaagtagctgggattaccggcacatgccaccacacccagctaatttttgtatttttagtagagacggtttcagtatggtggccaggctggtctcaaactcctggcctcaagttatctgcccgccttcgtcttccaaagtgctgggattacaggcgtgagccaccacacccagcctcaaaacactattttggccttctcataatgcctttgctgtttaactgcaggatgggcctgcatggcatagactgtagatccaggcacatgggcaaatcatagctttgttacctaactgctgtgtgagatagacagattaatgtatctaactttgttttctcatatgtaaaatgagaataattatacctgcctccagagtagttacgagaattggaagataatgtatatattaattatattcttaaagcacagtgttataatttataatccaacacacattagttttcttccttcatctgacttaaacatcatagtgatcggaaagataattaaaaatttttttttaagtagaatcacttggtggttaaaaaaaaaaacatgtttcaaattatctcaaaaaaatactgtgctttagtaatacttttgtattaacaaacaagtctccaacataactctatccctctatttattgcattatttataaataaatggtagcatttgctttccaaagaggagacaactgctggcttttgtgttaaagcaagacaactatgtaatggcatgtggataaaaaatatttttaaaattcttcctccttaaagggaagtttaggaaaatacatctccttattttgcctctctccccattacacagcctgatattgtccagattgctgtggatcttctcaccaaatgagttttgtatctctaagttaattttctgccagaatcacttcaggctgatgaccgtggtgtttgtgtatccattaagcacactgccaggatatgtccactactttccacctctcgtattaaacagctgtcagcaggtttacatagctactctcttgctctgcattaagtgtagggagccaaaggatgctatgtaaaatggtctataaaggagttacatagagctggcttagaaatcacagaagataaattctgtcatcagctgggtcaaatttattagtgttttatacttatatgaacagaaaatatatgaaaggaaatacattttaaaaattctgtttcttggttaaccttttcctttcttcatttaacaacctccaactagtaaaattcaacaattcagaaaaagcacatattggaggagtcttgggtaagaagctctcattaaagttgtatatagcaccctgctgagctttacaattggttttgaaatgaaaatctgttagattagagcaaacattatcccagctgccgcgataagtaatgtggagaagattaatgatttgtctatgaaagccagtgagcattaaagtctgctactgtgccctttttaaaaggtgcaggtgagagaagaggtaggaaagaagggaggactatgctattcatagctacatgtttatcttcttcatatgagttagtgattccctagcttttttttcccttgataaaaccaaggaagctttaaatttcaatgatacccccaggactagaatttttcattgactagggaaagtaaggtggaaccggaggaaaaaaacactgctcttatgtaacattgaaggttctcccttcttccaatcagcaacgaaattttcttcctcttttcatggaattaattgcagtaccataatctgtcttcttgtggtaaatgtctgaagatatatgggtgaaaattagtgatggtagagttaatacttttcctcttcacccattgcatgcatcattgaaggtaaaatagagcagggctgctgttatataaccttagatttcctggcttggtagggctgtccaagacaattcctgctttccccattcagcaagtgcccctgttttctgagaccttcagtgtgaggcagggagagtggcaccagcaccactgtgtgaaaatagtgccctgacagagaaagaatggcttagatgagtatttaggagaccatcaatacttaaatataggtttatatatcatagcagacttacagttttattagcacaaacctaatcttgtgatttggaaatcaagtctggtattggaaccaaagttgatttttattgttgtctttttgaattttggtatcctgtaaactcttgccattcaaaatgtgctccttatcacctgagagcttgtaagaaatgcagaatctcaggtcctgccccatgcattccaaatactaaatcagaatctgtattttaacaagactacaagttatttgaatgcacattaaaatttgagaagctccgatataaaccatggcctgcttttctaaaatcagcatctattatacttttcctcttttccaaagtaggcaagaaggctttaaaaataaaaaaggaaagaaaatgctttttgtttcaccaacaggaagcctgatcatgattttaatgtcatagcagtgccatgttttttgatgctgtttgtgcatcttcctggagacactgttttaaaatgcagctatttcttcttaatccttgcaacagaaataagtcagctctttgctggtcttttaataacaacagccaccatttattaagagtttgctgtgtaccacacgctatacaaagtttatacagtgctctaatccttaaaataccgtcctcttcccactccatttttcaaatgaggaaataggcccaaataattttaatgtgacttgcttaggtcatgtagctcctaagtattaatggggtacagacttgattttgtttgagtctaaagactttaaccttgcttttctatccctttaccatttggtcagaatttatctaagagcagataggtaaattgtgtaatttctactaacttgtaatatgtacttaactttaggattaccattattttgatcctgcagggcacagcacaacttgattggaacagccttgggctggagtaaggactcttagtatagttcagccactagctgtcttgatgactgttttgttttctttcctttttctcttgtaaaggcaaggaacgggtatgtgtgttgggagtggttagctttaaggacaaagaatgcatattctttgaaaataagtaaaatcaaagttgctactagaatgtactattctttgtgaattcatcaatttgtaaaaattactgggagaaaaagcgtttggtaatacctttcaatacactctaaccatgaatctataaggctacaaggagctttcagaagaaagctagccagacactgaatcaaggagggttttatccttccgataggtttttattcacaaaacctctctagagaaggagctatgcatgtgtgtgtaatatgtattttaaggtagacattaccccttttcattgaagacagttgatgtgattgaagtattattcccaacagcttagcatgagacatttaataacattttaagacatttcaataacaacatggaagttttatattttaaaaagatttgagagatcaaaaaatgataagtatatgaagtaatgcatatgttaattagcttgatttagccattccacaatgtgtatatattttgaaacaacatgttgtgtatgactatgtaatttttattggtcaacttaaataagatttgaaagttttagaatctagaatgtcctgcctctaagctacctgtaatctgactttttggcataggcaaggaagaaacttttcattttggcatgaggaaaatattcaaatgtaagagcagtttcatacacctatagacaaatgtcttttacttgtctggaaaaatccagaacaattcaagaagaagaaatagcttttacaaaaaagtgatgtataataatttaagtggtatttccgcttccttactcagtttagtctctgatacgtcctatcactgtctaaattactccattattaggggaaaaggccaatttttaaaagcaggttgggtgcagtggtatgtgtatgtagtcccagctactcgggaggctgaggcaggaggcttggttgagcccaggaggtcaaagctgtagggcactaagattgagcctgtgaataaccactgcacaccaacctgaacaaaacagtgagataccgtctctttaaatcaaacaaacgagacgaaaccaggttactactattgaccaactgtagaaatcactgggttcagtattcctttctttaaaaatgtatgattcaacccagcagttccaatactagttattgaaaattcaaaacaggtgtataaaaaagtacatatatggccaggtgtgggggctcacgtctgtaatcccagtactttgggaggccgaggcgggcagatcatgaggtcaggagatcaagaccatcctggctaacatggtgaaactgtctctactaaaaaatacaaagaattagccaggcttagtggctgggtgcctatagtcccagctacttgggaggccgaggcaggagaatggcatgaacccgggaggtggagcttgcagtgagctgagatgtgccactgcactccaggctgggcgacagagcgagactccgtctcaaaaaaaaaaaaaaaaagtacctaaacgtgcatgtttgttgcagcactattcacaatagccagtaggtggcaggcagcagcctatttcttccattggatgaatgattaaataaatggtggtatatccatacagtggaatattactctgccatgaaaaggtatgaagtacagatgatacatgctacaacatggacaaacctcaaaaacatttatgtcaagtaaaagaaaccagacacaagaggtcacatattatatgattctatttgtatgaaatatgcagaataggtaagtctgtagaggtagactcagattggtggttaccaggggcaataggagagggaatggggagcaattgcttaatgagtatggggattccttttgggttgatgaaaatgttttggaactagagagaggcaatggtcaaacaaagttgtaaatgcactaaatgccactgagttattcactttaaaatggtttattttatgttctgtgaatttcactaaagtagaaaatacatatgtattgttcattatttctcctttggttaaatcctttaatatatctggtatccattcacatgtcacatgatcattctgagagctactcttctcagatttcacatgtctagtagatgttaatattggatccattcattacattcctttgttttagaaatatgtttccattttctgactcagggcttaagctgctgtaaaaatggcaacattaaaaattcatttttcctataggaattcacaagtcacatactcttattaagggacattactcaggagagacaaaggtctttttttagtcacatcaatactttttcataattactggtggtactttcacctcttaattagaagtggtggtttgtttttatccccccttttttaggaggcacaatatccaagtaatttaagtggtatttaaatggtatggaagaaaagataatttctctgaatttttatttttttgaaacttgtattaacatcagagtcattactacaaaaagtatacatgaagatattgaatcttgtgaactcctttttttttggtctgttttgttcttagtgaaatagttatgctgaattagtggtatttattactataaaacattagcctttaaacagaagactagtttggcaaatagcttgcttactcatcttttggccagtctcattcatccatacagggaatattattcagagatataaaagaatgaagcactgatacatgccacaacatagatgaattttgaaaactttcatgctgtgtaaaaggagccagtcatgaaagactgtatgttgtatgatttcacttatatgaaatgtccaaaataggcagatctacagggacagaaagtagattgttttgcttagagctgccggtgggagttgtctggaaagtcggaagggaatgagtggtccttgctaaagggtacagggtttctttctggggtgatgaaaacaatctaaaattggttgtgatgcttgcacaactctgtgaatatactctgcctaaaactattgaactattgaattgtacaccttaggtgagttttataatatgtaaattgtatctcaataaagctgttacaaaaataacctattacttaaaatataaattattgacaaattctttatcagatccatttctaaaccaagttcttcagcaaacctcttaatgtctctgtcccctaaatacacttacatccagtttatactggatcatttttatacttgatatattgttttatgacttttcttcataaatcctgtttctctagtcccaaggtccagaactactccttcttttgccgtctgttttagcactgtgatcaggaaaacactaactatataaggtctcagaggatgattacttagccttgacattctacattacattatggattctgctagcatttattatttgtattactttaggattttttttttttttttttttttttttgagacaagagtctcactctgtcacccaggctggagtgaagtggcaggatttcagctcactgcaacctctgcctccaggttcaagtgattctcgtgcctcagcctcccaagtagctgggtctacaggtgtgcacccccatgccccactaattttttgtatttttagtggagatggggcttcaccatgttgcccaggctgatcctgaacttctgagctcaggcagtccgcccaccttggcctcccaaagtgctaggattacaggcgtgagctaccacgcccggccaatccaattttaggatcttatgtggtagatattatggctctttgcattttaataaccagagagagagagagagagagagagtgtaatttaatactaggtatctccctcaaggtttgggacactatttgggaagcaaatttagttttatttcctgcctgcacattagctaatttactctttacagatgaaattccaggtctaagtttttgaatcaattagtgtttactaagtaaggaatagatttactgactttttttggtggggggagggcggaactaagtaaattcctattccgttccctaaatattttccccagtccacgaagagaggtcttcaagagcctacagggctctaaggacacaggttctagtgatggatagtgaacagttagctccaagtgaaatgatgttgtcttggggttacaaacatgtttgtctctcaaaatgaggaatagttacgagagtagatgatagtgattttcttgcgtgacatcctacctcttgctttttaaaatatttctcccaaatatgaatttggcaagtgccttttaaatgccttattgtcaacaaatagtctcattcagtacatgttcagaaaccgcatggtggatttatggaatctttaaggtccttctcaaaagaaccaaagagctttgactagcctatcgagataaccttttttctaaggttaccttttccttttgtaggtatattttagtctacaacttgcctttctaaaggcatcttttttataatagagcatttgtaatagaatatattgtttagctgccttggaattaagtctataaaatatcaatgaatgtactaaggcttgaaaaacccagtggtatatgtgtgtaacttatctagctttcagaagctcagagagagtagcaaggaatcaaagcaaaattttgaagaaaaactgttcttcatggctggctgcctcggtaggtataaaatattaatatttgtgcaaaaggcggatgctctcagcagaggctttgaaaccaatctggatgtcttaggcagatgggaggtatggttgggtaagtggaagactgactcagcagaatgtctcagggagcctgcaactacagtttgggtaggaacacaactaatttcatttgagcacaagtgctcctgaagctcatgactgccctgctatggagcctttcttttgtttctctgtaatttgtgcagggactgagaagacattgctttttctgaggctgggcttaaaggtggttagccggcattccccagggcattgtttgctcttgtcaagttgtctgctctgtttaagagagcacatttgctacaagaatatttggaatttgtcttcagtttcttatatcatggatggttcataagtctcccttcagccagtatcctagaatgacaatcagttccaagaacaggctaaagcacttccttccttttctctgttctgtagtttgtgcctcatattgaaatttagttttaagagtactcatgttatgtggcatacttgtacaagacagtgatgtatatgagttagaaaacaagtctctagcttgcattgttaattttgagtagggtttataggacctatatgttagtgtagtagatatattattaagagaattttagatacacattacaccaaattttctgtgttgtattacagtttttagaaatactctattcccctcacattatctttttttttttaagtgtcttatcacaaccttggtaaattacaaatttgaatgtatagtggtctatattccatgcttgcttgtatttattgtctagtcaagatgtccttgttttgaattaattttctcaggcaactgctgatctgcttgattagatccaggggtagtgtcccattgcgactaaagtctgcctgacctagggtactattgtagtaaagaatccacttaactctcctttgcagtgtagcaacaaaataagctcaaaattaatgtgccagtgagtaaattccaagttgtagctctttaccttggcttgaagtgattctgtggggtcttggtgtggcttctggttatcatggatacatttcctgtattctatgtagaattctattacagagtatagctaggtgacttggctttttcctttctttgtgaagcaaggcatggtgcagaatagtccattccaaatcaagctctattttttgcttgtaagaaattgttttaatgacttctgattaaatgtgttttcagtgaggttgaccttgtctctcattacagaatcatgtctttctcgactgtcttgattgaactttacataataaccggtggaagaaaaataagttagtagaacccaaatattcagtcttgggcatgcacagctattttagttttatctgaactctcttaccttgataaaatgaaagtttgtagaaaagccatttaaaagtccatcaagcttctttactcatcttatttaaatagtacagcttataaaacacttttgaaatgtctccatcaggccatatctacaaacgagtacgggtgggtggcccttctttctgactgctgatctcagggtaaccagaataaattgattatacaaattttcagcctttggatttcaggaagaatagctattctgattttcgttttatgttttgactttatttctactaaatcagtttctgtattactaaataccagcaagcaaagcattttttaaaagttgggtaatgaaatgtcttccttgtgatttcttttctttctcttaagtattcatttggatctctctaacaccagtgaaacagcacagcatttatggttgtaattggcataatctcaggcaatgactaaagtatggacacatagccaaaacatataaagaatacctacatattaattgaagagacattccccctcaaaaaccttatagataaataggcaaaaatttgggtactttaaaaaggagagatattcataaacacatgaaaaatatgtgtaacctttagtcatcagggaaatacaaagaaaatatgaagcgttggtgaggatgtgaagtaacggcaatcctcatgcatttccagtaatcgtataaattatcgtcatgtattttatctttgcatatgctttaaacacacaaaacattgctactatgtttgttttaagcttttactgattagagcaaatacaaataagaaaaacataaagtttatatttgccttaaattattctgtatttagtgcttttcatttctatgtgtagatccatgattctgtctggtatcaaatttattctgccttgaagaactttctttagcatttcttgttatgtagttctgctggatatatatatatatatatatatatatatatatatatatatatatatatatagcctgagaaggtcttcttttcatgtctaatctatcttttatttttctttccttttcctttcctttccttcctttttttcctttaaaattttttttgttttgttttgtagagacagggtctctctatgttgcccaggctggtctcacactcctgacctcaagtaatcctccccacttggcttcccaaagtgttgggattacaggcatgatctactgcacctggctgtaaatatatgcatatatttttaccacagtaagcactgtttttttctcattataattcagtttgggtattttctatagctgtatcatcaaaacatacaaaatatagagcaattcacaccagtacttactgtggtaaagctcaccatatgggacaacagagaattggggaacaatcataatatagctaccccaaactaaagtattcagagaaaaggacacatttcattccaagaagcagtgataagaccagcaactgattgttcaacagaaacaatgaactccagaaggcagtaggaagacatctttaaaaggggagaaagaaaacaattgtcaagttataatgtaagcacaaggaaaataccctgcagaaataaaggaaagaagacatttttatccaaacaaaaaccaagggagtctatgacctacaggtctgcattgaaagaagtacaaaaaaaaagaaaaaaacttcatgggggtaaggggatgccagacaaagtggtagaaggaatggagaacagaggatgaagtaaaattgttgtttaaatgaatgttgattgtgaaaactaacaattctagtgtcttctggagttgaaaatagatgcaaaaccacaatggatggcagtaacataatggaaagagggcaataaatggtgcaaaagcttgctagggttctaagttgtacctgagatggggtaaaagtaatttaaataagaatgtgatagatcaaggatacaaccagtggaaagagccaacctttcttaaggttacgtagccaagataggacccaggtctttctgtatccaaggtgctgcttttttcactacgtagttttttgtttcttctccgttcttggtgctactacctgtttgtttgcctctgtatttgggtcccctctttttcaaaaatacttagttactctgtaatcacatacctggattttgctagaagtttctttcaccttctgactcatctcctcaatacttaataaagtttcagattcatcttctatactactattgtcattaagccattctcctgatcttcagcagatctatgttttatgccttaaacttttatctgtgaccccactatgctcagccattttcttactttgcccttcgggaaacaacaaactccctttagcatgttcagtcctgtcctcaattcattatatacttgcaagcctgtctcagttatggcatctttctttcgtgctggaggaaagttctcagactttggagtccagtagacttgagtacttgtatcctgactctatcacttcctagctttgtgattctgagcaaatttcttaacctctaggagccttagcttctccaattgtaaatgaagatattaataattataaccgccttaaagttttgttggttaattgagataacacttaattgcccagtagagtacccacgtagccattttaataccttttaatgtatctcctttgttatgcatatgtagactccaacttacagtttcatattctgcccctccccccccgccccacgctgtcccagggtcttgctgtatcacccaggtccttgcagtggtgtcatcatagctcactgcagcctcaatctcctggacccaagtgatcttcccgcctcagcctcccaagtagctgggactacaggggtatggcaccatgcccagttaatttttggatttttagtatagatgaggtctgggtcatgttacccaggctggtctctaactcctgtgctcaagtgatcctccctcctcaacctcccaaagttctggaattacaagcgtgagccaccatgcctggcctgtatgctgcattttttaatgtattatgagcatttatctatgttactataagagtgctagtaatactattatagattactgtaatataatcaatataatagttacaagatttatattttatagcaaagataatatttgaaaatgttcttaatggtataatcctaggctaaaaggacgtattataatttaactattttatcattgaatatgtcagttgtttgaaagtttcaccaatagaaataattttgtggagaacatttttgtcaagtctttgagacagttaagttgtatcagaaatgtcatttgaactctgctcagtggtcatggagctgtgataggaagtgtctttagtgtcagagcagattataggaagacatggacctcattacccaaaagagaataaaactctgagcacctactttacttaaaatgtactgaagaactcttgggaaaggtagaggtctaattgttttcaaagggcatttgataaatatcttcatctctttattaaaagctaacattaagagcagctgggaggagttgattatctaataactgtggaggggaatggtgatcaagcaaagcacaaaagagtccctgaactttatttagctgaagttgtgcctgcacagtagatgccatgtcttatcttaccatgaacgtagaaaacttctttgcttataattagcatttcattgatttgagtggtgtgtttgaaattgaattattattatttattcaaatctaggaactaaaatgtaaagataagttttggttttgtgtgtatgaatgtactatgcagagtccatgttgctactctgtataagacccaagccttgattgcctccccggaatgctaatacaaaggctgtcatagttactttgtgggctaaagctgtatcctttaggaaggcagtgagaaacttactgaaaaaaaatggaagcctgctagctgaaaaatttaaacacattaaccaaaatggctgcaagtaaactcttatccaagagctaaattcctgagagctgtttgaaataatttatttagacctgtaagaagatcagaaaggggttggatttagtttactctctctagaaactaaacatcatataatatagactctcatctataatgagaagggatgttgtattcaggaataggctggaaaatattaatccagcttttccaatcttcattatttttttaaaaaaggaaattttgcctttctctgtgtaaatcaagttgaaatgtttctctagctagagttgatgtcattgcaccagccacttgtttgacctagttaatagaacttatatttattgcaaccttcccctcgtcacctcattttaagacaggggttcacaaggaatggcctgcaggctgctttaaccaggtaattagaacagcatgtgtgtgacagctagtagtttaaagcagtaattcagctgtgtctgaaaagattattcacctttccatttactcatttctctatttgtactgaattttacatgccaatccacagttttctatgtcagtgcctataattgactgtacttgttacataattagcaactgtgccttgaattgaaactccttctatcttttgttttactgatagccaagaagcaggtagattttcatgttctctctgaaagctttcagggatagctcagtcagtcagtcaatcacagggtatctctatgacaactcttgtgacatttatttaatggcacttggcaaaataattaaaattaatagcttatttaaacaagcagagttaaagctttgtttaaaagggtacttactgtttcaaaataaattttattttacaaatgacttaaaattctagaatttaaaaagacttctaatgaaaaaatattttctagcttgtgcattgattttctaaccttttgtccatttagggatctgaaaaaaagtggtagtacaatgttgggcttcttaaacagtgatttcctcagctttttaagaaaagcctattatgttttacattcagtttcatcttttgtgtgaacttaaatgtgccagattgcatctacagtgtttttatttagtggggcaaactagtctcttccttttctctttgtatgaagcttttaccttctccacctctactccaacccatgcaagaaatggagatgttaaaatgcaagaaaataatgcagaataagaaaggataaagtccattggggttggcctaatatactgttgctaaacctgctttactgaaaagccgcctgatatattatactgggatgtatcaccctttgatagttattttattaggaaaaaagtatttgcatttccagttcaagatataaggagcatctaagaaagaactactgcaaagccagcagagggagcacatcatgtgtttgctggcttgtcttgaaaaatatgcagtatcttttgaaagattcttgaccaatgtaactaaaaataaacaagatcattttttccagtgtggcttcaaaattaatattttaaaaaggggaagaaaaaaagattctttgtcaaaagctgataatggatcttctccccaaatagggacttctaggcattttaaaaagttgatctagacaaaagaggaattaagttgagtcctcagcaggaattgtagcttgttcattgaatggtatttattttcccataggcctttttgattaatacttcaaatttgacttttaatttgatacatacaattgttctcataccacttcccaaaaagggttttatttttatttttattttttctaagtatggaaatagcagcacataagaaggttcctattacatgtataggattgttgatggttgtcttgcttctaatttgtgctgttaaatagtcacagtttactggaaatttaagtttttacacttcctgggcctagtgtaaagttgatttcctgttgagctttcggggttcataaatataggcctgcttttctttcttggtggcttttttgatgcatgggattatggaagttttatacatgcattaaagttctttttccttggtgaactatagctgaagtgtgtaactcgagagcagtaagaaatacttaaaagtattttgcttaagaaaatatcttcacatgtgacatcccgaatcttctattatgtttctttactttgcagtctcattttcaaaatatattatcatagccaaggcatttttctctaaacttctttttaacaaagggttccctccttatgctgctctaattttgcttattcaggacgtgtctcacggtttctaagcaaccaagataatacatatataataattgtgtattttagctttgaaagtcttaaaaataatcctcaaaaagggagagagggtgatttgttttcttaggtacccatgttctgagttatcaatattgtttatatttagacactgacgaaatagtaaacttaggttgcttaattagcatatgggagatcctcattaatgtaattctcttattgtacttaatacaaattcctgccttttctttttctgtaatatgaactgttgtgtaagcagtattgagtcattcaagaactcagcaaacaccactaatctaggaaaggtgcagattctatctcatatccatgttttaattttctagaaattgtttagggtgggaatttctagaatgctggtgtgtggagcttggttgaccttctaggtgaaaaggccatttagttaaaattatttaaagcaaaacatttaaagtctctggaaattgtcctaagggcacacagcaaatggagaaatactttcaataaagtctactaaatctcagtaagaactggagaccttgtggcatttgagccacaaccagcttccatccattacctctcccagctccatgttatggaaagtctcctccaggagagtgcagccaagaattcagggtcccctctctcccagactcttgagtctgttctccctggctaaagacaggacagaataatatattccctgaaatgtgatagcagtttccaagcaccacatattttcattagtaaagggtgaaaatctaactggctaaggaagcttaagcactacctttgaccagtaagaagtttatgtgaacccaggggtgacccctaagaagccaggctgaaagataaaaacaaggaaaaaaatctgagcagggacatcagaagctgcatactgcagggtaaataggcttcacagaattattccagccaagccactaaacaaacaacaagcaacaccagaacagggataggataggagaggaggatagagggtacataaccagacttggttgtattatctaaaatgtccagttttcaacagaaattcatgcagaaaaactagaaagtgtgaccacctactggggataaaaacagaaaacagaaattgcctttgagggggcccagatgttggatttagaccaagacttcgaattataaatacatttcaaaattaatgtaattataagtaaatataaaagaggtatgattacagactcatcaagtagagattatcaataaagagattatacaaataatccacatagaaatagagacttaagaaactaacttgacaagcatgtttttaacatgtaaatactaaatatatgagtatatattttttattaaaaatctttttctttcaaaaattttaacagaaacagggtcttaactatgttttccaggctggtctcaaacccctggtctgaagcaatcctcctgccttggcctcccaaaatgttggtattacaggcatgagccaccatagccagtcttaaatacatattttaaaaggtaaaccatctgaagagatattcagaaactgtaaaatcagaatttatcttatatatcagtactttttcatttagttctgcttattttatgtaacacaccaagttgcttcagagtttgaaaaatgtcatgttctaaataggatctaaactctagtcatatatcctgccaactcaacacattctttgagctactcaatcttttagtgaatagagaatagatatcccttggccatgtctaccttagaacctcttaaaggtttgtaaggtataatgaatgggtaagtacacacaacgtaacataacaggccatcagtgggaaatatttttagtgttatttgagtgacaaccaattcgtggtgtagccttcttattgtctccctgatgtctgatacaagctggcaatcagcagttcagtagaacagaatttctggaaagggtagttgagttgtaaattcatgtcagagttctggttttaagagaagtatgactgctaatttaacaagcattataatcaccaatccgtcaccatttcagaggtagatgcgtatgtaacttcttgataaaaatttttccatgactcggattgcgtgtgaacttgggtgactgaaaagcatttaattgattgaaaagcatcagctaacaggtaaaaggtatacatgctttaatgtaggtaaagcaaacaacttattcatgcccagagtaggagacataagcagcacttccattgggatggggccacacaaagggtgcacatccacgactaactccttgattgggctgaagacttcttgggccctttaaaaaggctcacctttatcattctaatgaaaggcgggcgtgtaggttatgcgctgttctggagaccagccaagtggatgcctgttcaccaagtagaaataactgataacaatcccatcatattcctgaatgtttactgcaaagttgtatgaatcaaagattaattttccatgctgcacatttttaatcctttcttgcagtgagtgacttttccttcacatgatcttggtatgtattatatatgagggggttatgtggaagaagaacgtgagctaattagccaaagaacagagagattggagggtaaaagcattaaggagccacactcagctccttcatggcagtctgcgtgtagggcctccagggctgctgtgcggcccagcaagtcagtcttcaaggattaatcagctggcccgaggcctctagtctttcacatcttctcctgtccttctcttagccattgagatattgaataccctaaaagtagaagtagctctgttagagagctttgttaccctctagcatgttgacgatacattttgcttcctcctctgtggtaaaggcagagatgatggatgcagtgcagccttttgattgcaattaaaaaggagattctgcttagcatggtggtcaattagctctttatgaaaaggattctgaccttttatttcatacagatatttaaaaatatgtgagccttaaatgaatcttagcaactaaaactgaaacaaatgtaccattttaattgggtttggaaatactgtacaagataaattgtttataaaatgagatatttttaaatggcagggttcaccttaggcccccaggaggatattctgaggcagggtctctaaagacattcatataggagaatgaaagtcgtttcccccccgctttggtgctttattttattttttttaagagagagaataaaaagtttctggcatgagatggaagattcagaattgtcacctctaccttttcatggtcagtagactttcatagtcatttgtctttaccaaataactttagtcttcagatgtttacatgtcattttagatgcaaagatctttgaaagcaaggcataccaaaaaggagctgaatctatatcatataagcggcttggggcagcactatctctcagaagctgttggatcccatcctgaaacctggttcatttgaagctcaagctaactgggatctggctgttttgcttttgagaagtaaaactacggaggttgaagtaaacaggtttggttttaagtatcagataggttggaaataaacctagatcacatttctcaatctggaatcaccatactatactgttagtgttccagaatttctcaagtttgagaaaccttggcctaaaggagtttgccagttatctcttctctgtatttctttgtgttttgttaataaaattttaaaaggtattgggtcttatttctacaaggtatgtcttattcctcttaaaatctgcttccttactaaaggacaatcttaaaggaccgtaagtattatttggaaagaatgagatgatctgagggtgtatagaatctcagtgttttgtctcacatcaatgatttttagcaacttgaagattaaaattgttcatagccagctttaaaacatacctaaggtcatggaatgacctaattggccactttcttcctctttaaccttttctatacacatttgtgttctgggttgtaaaggatttataattttccccaggatttgcctcagaaggagacacaagaggagtataatgtattcataaggtagagtagtagtcagaagataaaatgcataaattagatgcatatgtgtcagcatggatatacataaaaacgaattgaggaaaagctagttatagtgtaagacatgcagtacagtaccatttatgtaaattttaaaaatcagtactctgtagtgcatggaaaagtataagtatgtggtctacaaggagacattccagagtcatgatattggttgtgtttacagagcagaaaagcactagggaggagaaccgtagctttattaataatacttaaaaatttttatatgcattcatatgcataatgcaaatatgactaatattaaaatgaattctaaatggtggaccaagtggttattaggcatgttttctgtgctttgtttttaatatttttgaaaatacatgcttactgtgaaagaaagccgactattgttcagaaaacaatattattcttcctcattctctcacctgaatattattactcttaaacttatgcatctcttgagacattggggagagaaatggattaaaaactagaaaaaaaacactgaaaaattttatttttgtacagtcagtatataaagcatagtactttataagcctgcattttctactttttttcgttgtctgtatgtagatacctgcctcagctcttaaaggaccttctggttgttaacacttacagaaaaggttgtagtgactattcttgcatacacatcttttaaaatttttaaaaattcattatatatttttcaaactttcaaattgtggtaaaattcacttaacataaaagtactatcttaacaatgcttaactatacagctcagtatttttctttctgtgactggcttatttcacttaatattcttaaagttcattcatattgtagcattggacagaatttccttgttttttaagattgcacaacatcctgttgtatgtatatactacattttgtttatacattcatctgtcagtggacacttcagttgcttccatgtacgtatctttttaaaactttagttttgatgtgaagtacagcatttaaaaacataaatcttttaattttgatacaatttcaaacatatacagaaaagcagcaaaaactaatacaagatctccagtatgtcctttatacagattcgggagttgtttatgttttgccccatttgttttattctgtatgtatgtttgtatgtacacacacccacgtgcatatttttctgaaccatttgagcataagctgaagacatcaagccttttaatccttgaatattttcatgtatactaagaacaaggacattctcttaatttaaccacagtacaattatcaaaattaggaaatctaatattgataaacttctgttatctgatccacagtctatattcaaatttcatcacttgtctcagtaatatcctttttaaagataactattccctgctgccgcctgtgcccctccccctgccatcaagttctaattcatttctggcatttagttatgtctccttagtcacctttagtgtgtgacagtcccttagcctgtttttgtttttcttgacctttgatattagtaaggggtatgggccagttattttgtagaatgtccctcagtttgtgtttgatgtttcctcatgattagattgaaattacgcattttagggagcaatatcacaaaagtaatgtgtgtctgtagtgcatagtatcaggaagcatgtgattaaggtagtgtgctcatgtctctccactataaaattcctgcattcccttactaattagtaagaaattgtggaagatactttgagactatataaatgtccttttcttcatggaaatttcacttactagttttttttagcatctattgatgacttttgttaactgcataatttcttctgtgtttattagtttgctttccactgtaagagctttttcttctccctcattcttaaattatatcattataaacccatggatttctattttatttagtaagctatccattactaatttctattgttattactattattgatgctcagattgtcccagatttggctcctgggcatcccttcaaactgatttctgttttgtgatgtcaccactgtttttttatctactttttcttcttcttcttcttcttcttcttcttcttcttcttcttcttcttcttcttctccttctccttctcctcctcctcctcctcctcctcctcctcctcctcctcctcctcctcctcctcctcctcctcctcctcctcctcctcctcctcctcttctttcttcttcttctcctcttctttcttcttcttctcctccttttttttttttttttatatgagacagagtctcgctctgggccactgtcatccaggctggggtacagtgacacaatctcgcctcaccgcagcctctgcctcccaggttgaagtgattcttgtgcctcagcctcccaagtagctgggactataagtgtgcacaccacacacggcttttttttgggggggagggggagagacagggtttcaccttgttgaccagtctggtcttgaactcctggctgcaggtgacctgacctcagcctcccaaagtgctaggattacaggtgtgagccactgcctggcctaatatatatcttttgtacttgttttgttttccttaaaatgattttcttaaaatagaatttgctgcattaaaaaggttatgcatttaaaacaatgcatggactaagtaaatcacacttttggccattttgaggaggaaaataaaagtatgcatgtcacatataactccttcttgagcttgcttttttttttttttttttgagatggagtttcgctcttgtcactcaggctggagtgcagtggcgccatctcggctcactgcaactccacctcccgggttcaagcaattctcctgcttcagcctcttgagtagctgggattataggcgcccaccaccatgcctagctaatctttgtatttttagtagagatggggttttgccatgttggccaggctggtcttgaactcctgagctcaagtgatccacctgcctcagcctcccaaagtgctgggatcgcaaacttggaccactgcacctggtcgagctgctttttaagacctctcttttaaaggaaattttgtcattattggctctcacaagaaacatatgcaagaaaggaaggtaagaaaaacaagagtatcttttcagtgccattcaggactaatagttcacaactatctgaatggttgaactaggtttatagggtgtattttcaagaatagatggttaacaaaatagatcatttatattaagtaataaaaacctacttgagaaagtcatagattagcgttcatggtgggagacgtttcccttttcaaatcagacatttctgtatgtttctcacttgagctcctgccaaggatgcccaggacaggttgatatcttcccttctgtgcctcactttgctcggataaaaaaataatgtattagatcattggtattataatctttttgactacagcctacattaagaaatatattttttattgtgatctaatatacacataagtgtgcataataaatatatattacaaagtcagaagttttataagagacagtttaaccttactgtgtgtagtgcatgctgatatttccttttctgttgtttctctcatctcgtcttgtcttgtcttgttttttccttcttcctccctccgtatctcccttttccctttctactgccaccctgtgagccaccatgcccagccctctattctgtttatttaaaatgttgctaataccattgaccttgattttaggttaaaaaaaaaaagaactcgtagtagatttttgcctctcctctctcctccccctctcctctgctccccttccctctcctccctttctcttctctccccttctctcctatcccctccccgtctcttctctcccctccacctttttcttttagcttttctcttttcttcctcccttcctccctccctctctccttttctcccctctccccttttctcccctcttcctccttcccctcttcccccttcccctcttccccttcacctccttctcttcctttccctctcccgctcttcccctttcaacatggtcttgctctgtaacctagatggagtgtagtggcatgaccttgggtcaccactgccttgatctccagggtccaaggactcctcctgcctcagtctcctgagtagctaagactaaaggtgcaggctcatgtcaccacacccagcttgcttgcttgctcgcttgcttatttatttatttatttatttatttagagacgaagtctcactgttgctcaggctggtctcaaactcctggcctcaggtagtcctcccaccttgacctcccaaagtgctggaattacaggtgtgagcccctgcgcctagcccaagtagattatttctaaaagcccttcatctacagaattacatgagtatattctgtgaaactatttttaaatgacacaataaaaaaaattctgggacaaggtctgtcagggccaacagtcaaaaataacagcttctcttgtatacgtaattgtggccatctcaacaaaaactaatccaataaaaaagcattccaaagtctttaatctgttcttctgaatacagtcactactagtataagctaattttggtgtttttgttttctcctttaaactgacccttttcacacttttccttacacccatagcagtacactaattactgtctttggtgcatttatttctggccatgactagttaatggagaagatttatttaatttaaaaaacatattgctggattttaatttggttgaaagtaagtctagttaacactcttacttttttttttttagattggcagggtaacgtttttagtttgtctgaaatgaatgaaattggtcctttggccatcttgcagaagaacttgagcgcctgagtgctagagccacagttcactcttgactaggcatctttaatgtctcagcaagacctttgctgcagagatggtaattttccttgtcgctcttagttttagtttttctttctaggaaaaaagatgaatggaatctaactatcgaattgataaacagtattaaaagaggaattgggaatgtgctgcagcctttcttgacatgctagtttttcccttgagtttgcactacagtgtttttcacatacagagctaagcgaaatggtaaatcactttcatgaaatgggagttttggggctgtttgtgcggaagatatttttgcgaagatgcaaaagtaattactgtttcttttttgagccagtctttttagatttgtatgatttctgctgagacaattgaagtataaagtgttaaggaaattgtactgcttttgttgtattgtagctagcctccaaagcgtcttctgttgatttttgtctgtggtttttcaactcctcctgtttttagatctgttacttagacttggcatgtcttaccttaaaacctgtttagttatagctgtcatctccccatgtggaaattcttttatttatttatttatttatttatttatttatttatttatttatttattgagatggaatctcactctgtcgcccagactggagtgttagtggcgggatcttggctcactgcaacctccgcctcctgggtttaagcagtcctcctgcttcagcctcccaagtacctgggattacaggtgcatgccactatgcccggctaatttttgtatttttagtagagatggaggttttgccatatttgccaggctggtctcaaactcctgacctcaagtgatccacccagctcggccttccaaagtagtgggattgcagatttgagccactgtgcccggccattcctatgtcgaaattctaatacattagttgatatttcttatgcatgcattctttgccttgaaagataaaatgaaataagaatctaatcatagttccttatataggaattctaatgcagttcatgtaaaattttgttcctaatttgatatacattttttctagcaatttttcttccttttaatcagtagtcttcacttaaatattgatacagatataaatatatattatctcaaatgtttatgaaatctcccacataaaataagattatggtattttatttaacactacctctttctaataagagtagttgagtaaaaaatatcatatatagattacaatagttttctttttaaaatgatgatatcaggacaaagggaaaatacagattgagtagtaagaccaagatgaggaatttgaacacagaaatccatatataaacatctatataatcattaaagacagtgcagattgaaatctgagcttcctagggatcaaagcaaaaatggaaatactgtgtaagcagttcaaagatcattgtgttatgaactctaaagtggttagcgagaagagtagcgaacagtgttctcagtaacagctcttcaaaaagtgttttttacatggctttttcttacaccatccctcattatagaagccaagggcgttatatttgaaaaataagtaccggtgatgatgactgaactatatctcattttccttttgcccatttgtcagaattaatggtaagcaccatctctcagactaatgcaagatctaagcctaataaattgcctaaatgagaaaaaaaattataaaggatttttgatctataagacttcctattgagctgcatggaataagagtaagagataatgggagttgtcgtctacatagaacttgatcgtttaatttgtttagtgctatctgaaggaatttgcctatatcacatgctattaaatatttgaaagataatttcagaatggataacttctgcctcttccgctgttccattcaagacataattacccatgcttgcaagtgaagtaaaaagcatattcccaaatgaaaaatatttctaaaatgtgttagttatacccaatttcacttgtcttaagtgaaatttagacaaaccagattggattaactaggtatgaggcagttcattcctaagaagggctttgtaataatttgttttctctgtttgatagggagctataaataaaaaaatttaatacattgacttagtaaccggtgtccatttgagaatcaggaatgagcctgactcgtaatcagtaaaagataaaaccaacatgtcgtggtcctattaatttaaaacacaaaattttgagtcagggttagattatctgatattttataaagaacaaggattttagttgcttggaaatacagttgtttcagacaaaactttattttcagtaagccagtatctgcttaatatggttttatggcattcatacactcagatttttattaacgctattacagaatttagtacagcctggtagaaagttcagttgataccccagcccacattgtctagtaatcagcagctgggaaaatcagagttagagctaaagtgtactgatctagtattataattagtaatggctatatgtttgaaatacgacttctggccaggtgcggtggttcacccctgtaatcccagcattttgggaggtatgcggatcacttgaggtcaggagttcaagaccagcctggccaacatggtgaaaccccgtttctactaaaaatacgaaaattagctgagtggtggcacacacttgtaatcccagctactcaggaggctgaggcaggagaatcacttgaacacaggcggcggaggttgcagtgagccaagatcacgccactgcactccagcctgggcaacagagggagactctgtctcaaaaaaaaaaaaaagaaaagaaatattacttctttcaaacccaatctgactttttctttggcccttttggtctgtgatctgtgatgctttgcagaatatagtatctttattcctttatctgagagggaaaatgtgcctatatgcatatacaatattgcatatagtttaataagattactcaaaattacatgcaaaagttttctgtgcacacacactatgaatcccagattattgtccccacatatttggtgcccctcccagtgtgaggctcatacttccctgtcctgatcatcaggctcagctacgtgacttcttttagccaataaaatgttaatgaaaaatttatttggcttttatgaccagaaactttaagagctgttaggtggttccatttctcttttccctttgcagtgataccagcagtgttccattaagggccactccttcattctgggttcctggaatgaagatacgtggagcagagctgctgtctaccctcagtagacctataatgtgatcaaaacaaataaaccattgttataaagcctgtagattatagggtcattcgtttttgcaggtaaattagcctaagctgactgataataagaaccgtaggttaagaagatctgttccagacctaggtttttgggttttttttgttttttttttttttactttttgtgtgtgtttgtttatttatttatttttgcgacagggtctcactctgttgtccaggctggagtgcagtggtacagtcatggctcattgcagcctcaccctccctgggctcaggtgatcctcctacctcagcctcctgagtagctgggactacaggcgcgcaccattatgcctggccaatttttgtattttatgtagatacagggtttcgccatgtccaggatggtcttgaactcctgagctcaagctatctgcccacctccgcccctcaaagtgctaggattacaggcatgagccaccatgcccggccccaacatttttttattggtcattaaaaaatatattcaggccgggcgcggtggctcacatctgtaatcccagcactttgggaggccgagccgggcagatcacgaggtcaggagatcgagaccatcctggctaacatggtgaaaccccgtctctactaaaaatacaaaaaaattagccaggtgtggtggcaggcacctatagtccgagctactcgggaggctgaggcaggagaatggcgtgaacccaggaggtggggcttgcagtgagccgagatcgcgccactgcactccagcctgggtgacagagtgagactccgtctcaaaaaaaaaaaaattcaatgcctgttttatgaggggcagctgcattatctgccatcctcacaacaatcctacacaggttttaacgtttttgcagttgaggaaactgaaataaaagtaagtaactttcttatggtcatgcagtttctaagtagcttaggcaggattcaaacaggtctgtctgattctttgtgtattatacctctaaactttcctgtttgttccttgcatttatttcacatatatctgatcaatcatttctttactgatatgcagaatcaataatgcagttttcaaaacttttatataataagttcatttgtctctgtttaaatcaagggtcttacatttttggctttcaaggcacagacgtcttgtatttggaggtttttattttttttacatttgaaatcacatgcctttaggtgagacttacacttgccagttagccacaatgactagcactccctgttgtgttaggccacctaacttcacacattcatgatacccacctggtccctgaaaactttcgtatttgtatccccaggattggcttgttagtgtacattgttaatgaagccaaagacttcgctataattcataccagagaaattattttcattgcattagtctcaagctagcaactttttaagaagtcggaagaggaatagcaatcatggttaatccaagatttactatatgtcaggcaccgttctaagacttccacatgtattatctgatctgcaaaataactttattaggtagatagtattattattctcatttgtagggagaaaactagagcaagagaagttaagtaacttgcccaaggttacacagcaattaagaaatagagccaggatttgaactcaggcagtctggttacacacaccctactgggacagaggatatgtaggttagttgtgcatgagcttttctcactagtggagaaagcttttgtatcagtagttgatagccttaatatggagatagataccttttaggaattgtgaattatataaacatcatgtattctgataccttggattcactggataaaaattagtcagttagccctaatcttgggaagatcattgtcatcttctctgaacatccccctgatatgctttaatagatgtaagaagaaagtgttagtaagcccatcatttcatccttcaaaaaaatatatcttagaagtttgaaccactacttggtcttttactctttgggaaagagattgactctcctcgctcccccacccccacccccaccccctccccctcacacccaccccgtcttcattcaccacttttgagtaggcaattaatttttttttttttttttttttttgggggagacagagtctctctctgtctcccagactgtagcacagtggtgcaatcttggctttctgcaacttctgcatcccaggttcaagcaattatcatgcgtcagcctcctgagtagctgggatcacaggtgcacgtcaccacgcctggctgatttttgtatttttagtagagatagggtttcaccgtgttgcccaggctggtcttaaactcctgacctcagttgatccacccacctcggccttccaaagtgctgggattacaagcgtgagtcaccgtgcctggccaagaaggcaattcattctttgcttctttttccccttctagagatggagttttgagatgttacctaggctggcctggaactcctgggctcaagcaatcctcctacctcagcctttctagtagccaggtgatatggtttggctgtgtccccacccaaatctcatcttgaattgtagttcccataatccccacatcatgctggtgggaggtaattgtatcatgcgggcggttacccccatgccgttctcgtgaaagtgagtgagttcccatgagatctgatggttttataaggaacttttccctgtttgcttggcacttctctcctgccaccttgtgtagaaggacatgtttgcttccccttctgccatgattctaagtttcctgaggccttcccatccatgtgaaactgtgagtcaattaaacctcttttctttataagttacccagtcttgggtatttcttcatagcagcatgagaacggactaataccctgggactataggcgtgcaccactgtgcccagctgacattcttaaaatataacatattgtatttcttgaatttaagctgaacatttgcaagttttatcttaagggaaaacgtgtctcaaaagttaatatcaccactctaagttgaatttactgaaacagatgcagtggtcagcttagtagcagagcttaaatgaaggagacctgaagattggtggtgtgtgaccctggtaggagatgatgaggctgagaactgagtagaaatactcagggagtattgagggagtatttaggggtaggaatagccccttaagtcaggagctgcctttgtgaatagagggaagcaagaacgaataggaccagattgtaagagcatacataggtgggcaagagcagtcccaccaccgctctacccagtcccaccacctaggcttttcccagtcccaccaccatcctctccctcaaaagagaggtgcagtgggaattatttttttgtcttttctcctgtcacatctgcatggtaaaatgaaaggctaatagcattaggactgtggatacaattatagaaataatcagtgatctaaaaaggggggtgctaacctgctgtttttgctaatttattcccaaatacttttctacttttctattctgttgtcattgaagtctttatgggacatttaaagccttaggtctggggtaaaatattgcagcctccagcctctccagcagttacgttcatgccacttctgtgccattggagtaattcatgaatgacactaaggactaatggcttgaggggaagtctttagattataccaaggatcaactgtaaacaaagagaagttttttgttttgtttttaggctccaacttgcctattttattttgtcagctttacccagtttttccacaatatgccaaaccctatctgtaattttgatggctgaactgtatgtatatatgcgcacacagcataaagtgcatattttgttagaactagattaatgccacaatattcagaaaacttctccctgtgttttcaaaaaattgacatattttgtggttagactgaaatgaggtaaatgtacatgttattgtagtactaatggattgttagatatttgctgtaatgttaacagttaatttatgccctgtaaatgaatattgaatatgaaacactgttacagggaaaactgtatagtctgcacaataaatgctgtataggaaacaagccttactccaaataattttttttgctagttcacacctctgagtagttggctctataggtgtgaagaatctagagaatgtataatttcagtgataaactagattataaagtaagtttaattgctgaaaagagtaagctttgccagcttcatatattctcttgttgcctgtttttgcaagacacatttcaggatatgcttttgggagccaatctaatgttacctgtatttgcctctcgtaaaaatcttaagctttgtgatttaaatctaagcaagcaggaagtgacttgagagaccttgtaagtcctgttaggaccagttatccatgatgaataataaggaagaaatttttatatgtgtggggataatttatgaaatccaaacatctacttattgacagggtgcttaatatttctcctgtaggtaggagcactcttgcttcctataaatacattttgtagcaatttaaaatccattttaaattgtctgtaagagaattaatatttttcaactttgtgtgttcatcagtatccaatacgctaaattcagcaaatttatattatgtattatgtggcaggcattttgctaggggctgaggcacactgtgaataagacattcatttatccaacaaatatttaataaagtaccttctatgggtaatcttaaggacttcccttaggaagtagtgcttatattaagagttcaaatatgagtaggatttaccaaggtgaatatgaggataaaaaaatctcccacgtgtcatgattaaagcactccatgttgaccgccgggcgtggtggctcacgcctgtaatcccagagtgattacaggcacgaggctgaggcagggagatcatttgagatcaggagttcgagcctggccaacatagtgaaaccttgtctctactaaaaacacaaaacttaggtgtggtggtgcacgcctgcaatcccagctacttgggtggccaaagcaggagaattgctcgaacccgggaggcggaggttgcagtaagccaagatcgtgccactgcactctagcctgggcgacagcgcaagactccatttcgaaaaaaaaaaaaaagaaaaagaaaaaaaaaatagcacttcgtgttgagaaagagcatggagtgtctgaaaaaccaagagcactggagatggctaaagcaaggagagggagaggaggagcagtggcatcaaatgtggctgaagaaatagctagtagctggttctaagttctaagccatggttaggattctggatctggttgtgaaggcaatgagagaccattgaagggtttaggcagggaggtgatgttatcagaatttgttttcttacaatttttttttttttttgcaatcattgtggttgctttgtggagagtagatcagactgagccgagagaggacacaaagatttcaattaagatgttatcgagtctgggcatggtgtctcattcctgtaatcccagcactttggaaagccaaggcaggcagattgcttgaggctggaagttcgagaccagcttggccatcatggtgaaaccctgtctctactaaaaatacaaaaattagccacacgtggtgttgcacactggtagttgcagctactcgggaggctgaggcatgagaatcgcttgaaccgaagaggcttgaactcaggatgccaaggttgcagtgagccgagattgcaccactacattccagcctggatggcagagtgagactctgtctcaaaataaaaaagatgctatcaaaggaatcttatagatgatgatggcttagactacagtggtaatggagaaatagatggattcaagagatatttaggagttgtaaatgactagaatggtaatttgggggatacaaaattaagaagggagaatgtgaagttcaagataattcctggcttctgactattctctatgtgaatgttgatatcatctgatgagatgggaggaagggcagaagacaaggtctatttttttttttgaggtattactcaaattgcagattcatggacataaatagggaacataggataggagtcatttatcatcattaggatatatacaggtagaggtgtgtgtgtgtatattgtatgtatatatttttaacttatttgaaaggacataggctgagcatggtggcttacacctgtaatcctggcactttgagataccaaggtgggaggatctcttgagcccaggagtttgagaccagcttgggcaacatagtgagactccatctctatcaaaaaaaaaaaaaaaaaaaatttaaggtagctcggtgtggtggtgtgcacctatagtcccagctactcaggaggctgaggtgggagcgtcacttgggcccaggaagtcgaggctgcagtgagccatgtgtgtgccactgcactccagcctgggtgacagagcgagaccctgtctcaaattaaaaaaaaaaaaaaaacaaggaagcacacaaaaaccgtgcagtgttattcagtctgtctattctgagatcagtgaagagagtctgattttttaaattaataaaaataatttttgaaagagaaaaaaataataaaaataattttttttaaaaaagaagatagtctgatttttaaagagaaggaatcgccatgagaggttgggtgagaatctgataggtaaaggcgttttgcttttgctttttaaagaagctagaagataatattcatgaaaggacacctaagtaaacttagccacattcaatagctcacaagtccacataagctacaacatatgcataaggtgataaggttttcatagtaaccaagtccataagtgcattggttcttgctaactcctgtttaaacagtttattcttgctgaggctgttaacccagattaacatccaactaccagaattttattaagattttaatcagaaggctagaagtctggtttatgaattggctggctactaatggctttgtagctttttaaaataagatatttaagttttgcggttgagatgggggtgggggacaatgcagctttagaaaactagaaatgtttctatgaacggaagctgtagcctattatggacataaattgggtggagaggggatggtgagcagaaccctgttctgttaaaggagacctttatacagtgccttatatgaaccaaactcttgagatatgggaaatgaatttttatttttaagtggattgagaaacaaaaacccctggcaaccttttccattttttaaaatttgactacttgaaacatgaagtattttatggtgtgaaataccaaactaaagcttctggtgggtgcatggatttgtaatctgtgatttatagtcagatggggtttggagactgagaatggaaatgtgggaaccagcagtgtaccctgtgcaggctgtgagctgttaacattttgggaagctgggaagtggttgcttcagtggtgcatgctgtagtgggaagagcacaaacattaagagtcaaataaagctgagtctcaaaccctagctctagcatttgttaaggagggagcaggtttgcccagtttattttgagggctaaatgagaaaatgaatgcaaagcccctggcagagtgcttgactcacaggaggcgcttaattcttagttcctcttctacttcgaatttggtttcctatatacccaactttagtgtctacaataaagatagaagccttattagtgagcccaagtagtcctaatgagtaagttggaacaagtgcagttgaatttctcatctctacttactgattatgaaattagaaattcacaggtattaagcactttatcttttagaaatgccgacccacatgatgctaagagtacccttaaagacacacaaaacagtttatgaaaggtttaaagtaacaattgataaatacttttaaatgtaatccagtgatggactttctgcaggaaagcattggccacttatttatccagttaatgtttattgagaaccattttttgtcctggatcctgaataatgtaggagactgacaagtgaacggatgattcttatataccatagtaagtcttgtgctatgggaaatcacagagtgctgtgccaatagaatttgataatacgtaccaaatgctgtaaaaatgtacgtcctctcttaccagttgatatacttctatgatataacttaaggaagctcaatgaaatcttgtttataatagtgaaaagttggtaaatgaaaacgtgtaacactagtggattggtttagttcatgtatctataaatgaatgagaccacgtactcattagtgatcacccatttatatttgacaaagaagaaacagtcatgattccttgctaagaggaaaaaaataggttatggaacagggttaaaaagaattaatttgttttcaatgagagaaaaagtttagcaaaattaccgaaattctttctaaatattttgaagaaatcattctgaaagacgtattattgtaataatctagaagtgggattgggggtctaagcatcttgccaaatcagcattgtacatctgaaagataaacaatggggcatgtgcatatcaaagggagtattgcatagtggctagatagggtgtagttctagagagactgcccaggttaatgggcttgtgaagcaggacaggacaaagtgctttcacagtgctcccagtattttaagtgcattttgtagtaagaagattgacgtgtgaaaaatcattctgaaaacagtggagaaaactatgccagtgagtatgtgggtagccagtccctgggacttcactttgctagcaccattaggtcactttatcttctggagacattccatttctgggtactaaaggtttcaagcatatctttgttgagaaattatttttccccttagatgataataaggtaagttgccaagatttgggctgctgttcactcttaacagtattcccattaaagtgcaaacgtttttaaattcagtttttacaagtaacagtttgctttggaaaagctttattcacataaacctctctcaggctgacaactttattcaagacaagtttaagacctttggatataccattaactaacttataaaattagttattcctaagtttttttctcatttagagaggtgggtaagcttggagacttctagttttctcatttatatgagaattataaaatatatcaagggaacagaccttcactgtgtctgaatcagatgcagtggctgtttctggacctttcatctgcactgctctccagtgtagaatgatgggaggcaggctctgtgcctcatattttgttgtttacttctttacatgtaatataaatctgttccccttcattttcagagtagacttctgagagtttctttctttttggcagtaatcagaagttggatgctgggtggttcagaaagaaaggcctaagagaataagaactgtgatgcaaatatcagggccaaaatgaagagataactcttacttagtgcccctttctttaagttaggaaaataccttttctttttaattctgtcatttgttaagtactcatgtgctaggttcttcatgtacattatcttatttaatccacattttcctgagaggtataaataaccacctccctttgttttacagaaggcctcaaaagattaaagaatttgcttttagctatatgcccagtaaatagccaggtcaggatttgaatccacgtcgtcactctaaagctctttgtattgcacagactttggcatggaagttagaaaattctaactcagtttctggtgagttgtagtaattttctcagctcttgcattctctatctgtaaaatgagaggattgagctgaatttttaaagccattacaggttgtaacattctgtgattcctggattctttttcagattcaagtagagaatatatagagcttctactcctctctttgtgagcagccagttgggtttgtatgttagccaaatgatgttatgacaccatcaccctgtgcaggtgtagaaaaggcatagaaggagtatgggttaaaagaaggtacactgtgtcaactgctgattcctaaaagaaaacctgaagtttttgaactgccagttcacaaaagagaacttgaaagtacctgagcatcaaagtagcatggcaagcatgggctggagagtgtgtgggtgggacctggtattcataattgtctttagataccaacatccttcaccttcaaaggcttattgtgcctgagtgagtaagtttctgtgtgtgcatctgtctccaggcattggggattatgctagatggtacagtgatgactcagtttcagttctttcaggatcatataacatttccaattaaatggtagacagatggttatgggagggacacaatgattattgacataggagagctaatgagattacatgacataaaaaagaagtatcattattgcagtatttttattccattgatatagtacctgtttcttgaaggtgctatacaaataacactgagataataagccatttttaaatgtcaaaacatggaagaacaagaaagtggctaggagaaataaatacacagaaaagaagcagtgggggctttagagcactgatcaccttagcagttactaactggctacattcattgcactcactagtggtgctggaaatggctgggggcttgacatggaggtctctttcttgggccatcttggtgatcacagtgccacatcctgtggttgtgattgaagaccatgggctttgttgtcaaatggacctgtccttgctacttattagctgttaacttagaaaaaattacctaaactttctgaacctcaatttctttatcattaaaatgatgttatttataccttccttgttagggttttcctgatgattaacataaatacgttatacacataaaacatttagttcagtgcctggcacataataaacgcatcataaatgctagctattcttacgctgagaatatgtcaaaaggtaatgattctgatgaagttatagagtatgatagcaacacttccctctggttcgaatgctatgtcaagttgtaagaatcttgtacttctctgaattgatataataaactataatctgtacttcatagagtagcgttagatttttaaaatatatagagaataaagacaataatcacactcagatacctaccaacagcttaagaaataaaaaattacagaacaagatagaagacccgtttttctccttatcccttggcctcaaagagataatcactgtccgaaatctggtatattatttccttgaatgtttttatcttgtaattattatcattcatgtatccataaacaatatgcggtattcttaacatattttaaatttttatataagtattattataccgtgtatatctttctgtagctcacttgcttttctctctcaacattctttttgagatttttctattatacttgtagccttattcatttaatcactgtagagcattttaagatcaattttctgttaatggacattacctgtctttggatatttttgtgtgcctctcaccatcataccaccctccctcaatctgagatttaactgctattctgaattacgctaatattcaggggctttgaaaaggtttaaggccacaggcgctgtggctcacacctgtaatcccagcactttgggagactgaggcgggcagatcacctgaggccaggagttggagaccagcctggccaacatgatgaaactctgtctctacaaaaatacaaaaattagccgggtgtggtggtacacgtctgtaatcccagctactcgggggctgaggcaggagaattgcttgagcctgggagacggaggttgcagtgagccgagatcatgccactgcacttcagcctggccaacagagtgagactctgtctcaagaaaaaaagaaaataattcattctctaattgttggatacttggtctttgtatgcttattaattattttgtgtgagcgttacattaaaatcgtcccctgtaggaaatttgtcagtttctcatcaatataaccatttttggtttaagtacagttggcccttgaacaacacaagtttgaactttgtatccctgcttatatgaagcttttcaaccaaacccagattgaaaatacgggatgctaaacctgtgtatatggaggaccagtatttaatatacgctggttcagtagggctgactgtggaacctgagtatatgcgggagttctgaaaccagtcccctgtgtatactaagggacgacagtattttgtggctttggagaagcctcttttactattttataatgatcctcttcacctctaataatacttttgacttaaagtgtacatattctgacagtactctagccatagtagctttctgttcatcctctcctctcccctcccgtttttctttttctttccttttcctttcttggttcttttttttcctcttctcctctccctctccccctcccctcccttttctcctctctctgctttctctgttcctgtcctgtcctgtcctcccttccccttgccctgccctttccccttccctttccccctctttctttcttactcctggactcaagagatactcccaagtagctgagactacaagtgtgcaccaccaccctcagctcattttttaaaacttttagagatgaggtcttgctgtgttgcccatgttcgtctcaaacttcaggcctcaagcagtcctcccgcctcagtcttcaaaaatgctaagattataggcgtgagctactgtgccctgcctgttcatttatatttatttgccaggtacatttttttttatatacgattgtgttatacttgggagattggctacaggactcccctgcatataccaaaatctgtgcatactcaggttcatcagtctgcactgcagaaccatcgtatatggaaagtaggccttccatatatgatttttgcatcccgtgaatattgtatttttgatctgcatttggttgaaaaaaatccacgtgcaagtggacccacacggttcaaacccatgatgttcaaggattaactatactttaacattttgtttatcctctcatatttatgtttttagtatgtcccttgtaaattgaatacaactggacttcatttagtccaaatattctgccttttagctgataagttcagtctgtttacatttattaccattactgacatatttgtacttatttctaccatcttattatgtgttttctgtttactctgctgttttctctgctgcctttttccttatgacctttccttctgaaaagtttgaaaaactattctttattccctttttccttctgattacccttaaatttttaacatgcgtctttggctttgcacagaatgttaaaatcagtatgtttgcattcttctgaataataagggaccttggaaaacttttaactctagtaccttccactaatcttaaacgtttttgaccagtgttttactcccatggttttttagtcacccagatcagtctttattattggtgttgttgcatttaatttttgtaccaacttccattgttttctaatcctcagagactgtgaactccttaattaagctcgttttctatttttcttcagattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtaagtgtctggcttctgaggggtggtagagagagcagcttaagaactttagatgagcatcttggtaatgcctgaccccagaaaaaacagcacttcttttaattcaagataagtgtccacatacaaggcccaagctcagcaagttagagaataagtttcagccattcctgaagaaatagccttttataccgtcaaagtacatgaagtttgaaccagtctagagagcagtggctctcacctatgtctgcacattagaatccactgggggtttttaaaacaattttaatctttagcaccattccctcgttctcatttaattgatctggagggaggcccagggatctgttatttttaactccgcagaggatttctaatatgcagcaagggaccagtaagggattctaaccctaaaaccctaatttaggagccttagattgaagctttacctctgtcactaactgggccttgactgtttctaagcatttaactgagatagcactatacttcatagaacataggatgtttaaaggaaggaggagatggtattactcttctgtaagtcttcagtgttggaatgctattatgtaggttagaagttcactgtctacttaatttcttttttttttttttagatactcactctgttgcccaggctggagtgcggttgtaccatctcagctgactgcaacctctacctcctgggttcaagtgattctcctgcctcagcctcctgagtagctggcattacaggtgcctgccaccatgcctggctaattagtagaaacaggatctcaccatgttggccaagctggtctcgaactcctgacctcaaatgatctaaccaccttggtctcccaaagtactgggattacaggcatgagccaccatgcccagcccattgtctgcttaatttttataatgtcataatatacatctctttccctccatcccccatccctggcggtatgtgagatatacatctcttttagggcacaaatatagttgatagtatttgttgaaaattatagggatattatgacatagtagtttttgccttttaaaagctctacttggccaagccaggaggattgcttgaggccaggaatttgagaccagcctagacaacatggtgagactcttgtctctaccaaaaaaaaaaaaaaattagccaggcgtggtggtgtgtgtttatggtcccagctacttgggaagctgaggcaggaggatctcttgagcccaggagttcagggttacagtggactgtggtcttaaccattacactgcagccttgtgagacctggccttttttttctttgaaagctaagttgaaatttagtatttcaagtttcatgaatatctagaaacacagtaggttagaatgttctgtgttctgtatactaactttggaaaggttagcagaaaacaaatatttatctaaatctgtcataaactgctatatttggtaatatcgagaatataaaataagcaaggtcatagtctttgtcctcaaagaatttgaaggggaaattaaatatatttgttgtagtttatcagtggttatcaaccaagagtgatctcccaccccacagccccagaacatttgataatgtctggagaccaggaatgctgctaaatgtcctgcatcacataggacagtcctctgcaacaaaaaatcattcagctcacgataccagtaatgatgagcttgacaaaccctgatacatgtttgcatacacccatgttggtccttatgtattaaagacagcaactgttgaagggcattgacctactgaggaagtggtggtaaagatggatagaaggtggtgaagagacatactagacagagtagaatgagctgtggaaggaaagctgcatggagtttctcaatggcaaatgactgtcttagggccatttgtggaagagaatgaaagacaaggctggaagggtaagttgtggccaagacatagaggctaaatgtccagctaagctatttggacttgagacagtagccatgtttttgagcagaggaggtgatattattacagttctttggagaagtaaccttggttgtattgaaaatggaaaggattaaacaggaataacattgcaaagaaagaattttttaaatattataacttattgaatagaggccaaggtgtagaaatcatataagaggagaaaaaaaaaaacggtgaaaatggtagtggtcatgctaaggcagtagattttgttttgttttaaaaaatcttttcaagatcatgtacttactgaggagttgatgacagctgtggcctcttgtcctagaaaaatatacaccatccatttatacccaattttgcataaaatttctctacagcttattatggcccttgggttaagaactcctggtctaaggaaaaagttggtcaggatctcatctgatggaaactggattggattcgtgcataccaggatcgggccaccacaaatcaattcaagccaccaaaatgcatgtgaggctgagataacagtagctaccatttattgagcactttgtatatgagacattattctacatgcatattttctcattgtttttcgtgataacccaatgaggtagatagtgtcattatactcattccatagatgaggaattagacacaaaaagattaagtaatttgcctgtggtcacaaacgagtagataccagaaccaggattcaaatttaggcatttggcttcagagttcatacttttaatcagttaattcacaatgtgaaatacaactgtcatagagaataatatttgtgtgggcaagaggaatgctttctctccctgtcattaagatatgtggaaatccacatcataaccaagagttacttgccagtttaggccactgtagactgctatgggcttttttttttttttttttttaatatgaataccttcagcctgattaaagatgtctagttctactagcttcgtttcctttctctctcttcttggtgacatcattgctttgaaccattgtatgtttctcttagacttatactctctgaagctaatctctttcctaattcctcaagtttctacagatctagggaaatgagatttgccagttggagatatggtgatgacttaagtttgtattgtgtgcaactgggcaggttgagttggagctcagaggagtgaagtcaagattggcttcatccacatggagatgatagtttaagccataggtgttaagtgaggttgccaagagtgagagcaaagaaaagcagggagggctgggcacatggctcacgcctgtaatcccagcattttgggaggccgatgcgagcagatcacaaggtgaagagatcaagaccatcctggccaacctggtgaaaccccgtctctacaaaaatacaaaaattagccgagcatggtagtgcgcacctgtagtcccagctactcgggaggctgaggcaggggaatcgcttgaacccgggaggtgaggttgcagtgagccgagatcactccactgcactccagcctggcgacagagtgggactctgtctcacaaaaaaaaaaaagaaagaaaagaaaagcagtgaggataaacctgtgagtgaaacttctgcacttaaggagcaaaaaggatagaggaggcaactgaagaagtcaggaggagaatgatagtgggcaaggtcacaaaagccaaagaacgaatttcagtttagataataataatgttagctcacatttatgaaacatttgctatattctagacattcttcaaagttctttagatgcggtaacatttaattttcaatatagcctattagggtaggtgcttttattatacttgtttttacagatgaggacattaaaacttagagaggttcattaactttctgccctaagttatagagctattgcaaggcagtgaagcccatgctcttaacacatgaatttggatctagagcctatgctttcagtcactataagatattgtcacaatattatgaaaatgctaccgaggctgtaaactgacaaagaggcacttggatttggtgatcataagagggattacctaaataaactatttaataaactgtttcagtggtttgtatattcatttagcagtctttgctgagtgtctgctgtatgttagacactaagttaagtgctgagtatagaaatgagtaagattaggtctttataaataaggaggtcacctttttgactacatatgtctctccctgggagtctggcttgttctccccaacaggtgcataagaattttggggtggaaggggggaagtagctagtagtggttaacaggcatgtcatttgcaaagctttttcaggtcagctttgctccctcacctaggttgaaagcagctgtgctagagtgaggaagatgtgtgccagatttgggggttgagaatatggcgtaagaaaagtaccttgagtttgttaagagctgtcagggtggatgctttaaaaatcaatgggagataaagtgattgcctagtagcagtgaagacccaagtgagacactaaacagcctgatccatctacatcttgcaaattttttaagctgtgatctaccaaggtgacaaaggatggcggaagaggcagcaggagattgcctatgttgatattttagtatcctcaagggaccagaatttcatctgtgggttccttcttagcttctcctgaagagatgtggagaagtaagatgtagcagttgttggaaaatgaatttgggatgccaaatccaagtaccgtgaaatttgtaaactatttagtagttatggatccattgttattgcatagagctagaagtgctacattttgtttggggcttgtggaaggttttattattttttttcctaatgtacaagaaaacagatgttgcttaaatctactttcaccttcttactatcaacatgaacttgaactatgaacatatcaacagaaagtggtgagagtctgggtacattttcttttgaaaagactgcagatagagcaataactattgacaaaagtatgtaaaacttagaaacaggactaatttttacccaaaagaatttcttaatacgcttccctgcaggtaaatgaagcaggtatctaaaagctcttaagtgatatttctgtatctgaacataaacatatgtctccctgtcccaaactgtgtgtgtctgcagaagagtccatggagcttagccgttggaagccttttccaaaaatatgtaaacaaaattcaaatagtgactaaaggacttgttacagcatttaaatgcgatagtaatggtaacggctcacaacaagtatccttgctaagtaccaggcactgttccaagtaccttatatgcacaatcatccctcattatacacaggggattcggcgcatactcaagtctcacagtcagccctgtggaacccacttagtgaaaagttggccctccatatatgtgggcaatacttattttccatctgtatttggttgaaaaaaatgtgcatctaaatggacccacacagttcaaactgctcttgttcaaggatcaactgtattaacttacttcatcttcataattaccctgtaaggcaggtacttctattttatccatttcacaggtgtgaagatggaggcacaggatgattatcttgcccaagatcacagagcactctggctccaagggcctgggtctctgccaccacaccatagctgccattctctatcatgatttacgatctaaaggacattgcatgcaaattaggctatacagtggaaggtgtgttggacaaactcttaaaaagaataaaacatttctttctgcttttgctactgcctatttactgttctcccagtttttagattttttctgagggagataaagtgtgatttgtagttaagttttttgacccaacttttgcagagagaaaggataatgccaggttgtagttagaacgctggaatcagttgttttgttgttctcaagtacaggcagatgattgctcacaagatgaggaagtgccctcttagctctttatacaagtcagcttttctgttgttatgcttttaaaggcctgagcatccctatttatgacctgtttggtaacatgatgtgcatgtctacctgagtttttggatttttcttcccagtcccactagcatattgaatggaaatggaggtgtttggggggtcatggctggtctgtctctttctaggcaggagaggaagagaactgatacctgctgctagggaggattaatggcaagaaatggacttgttttcaaatagtctgatattctaaactagcagttagagagtacctatctcatacaaaacagtcttctaagctctgtggaggtacatactaagaattaaacagcaaccagctcttacataaaactatagtttacaacaggggttgacaagctatagcctacaggccaaatccagcctatcatctgtttttatgctgcccacaagctaagaatgatttttattcttttaaacaactgaaaaaaatcaaataaatattttgtgaaatgtgggaaatacatgaaattccaaattcagtgtttataagtaaagtttgattggaacacagccccactcatttgttactgtattgtctgtggctgcttctgtgctacaatagcagagttgggtagttgctgtggagacccaatggcctattacagaaaaagtttgcaaaaccctgttttacagagttctttgatacacatgttcctagaatcatcttgacagtgtgcagcataggtagggcaaatattctccttcctattctatagatgaaaaagggaggtttagatagtgaccctccttaagtcccaagagagggccacaactgaactctgggccttttgcatctataatacgggactctggtttttttcctgctcttgtctactgcatccacccaagacatacttttgttgtagtaaaataaaatatacagaaaaagtgagaaccatattaactggcatgttagtgaggatttttaatgactaaagcttcgtttccaggtgctgactggattttcctttaatatgacactgattcccaaaatagaaatttcagaacgtactccacctctggttaaattaatttggttgaacacagatttccattgtttccttggaaactggtttctggtgatatcgtagctccctcagggatatttaaaaaatggtagtgccttttaacagatgtccttgctagactgccccgggtctttgaacatccattgggcgtcattggctacatatcttcatttctgtctgacaagccttaatctgttccctggaaatttagtatcactgccaccaagcggctaaacttctgatttgtttgtttttaccaattaaatttctaataatctctaaatgaaaccagtgttccctttttcagactatgcctacttcaggaggccagatattgggcaaaacaggctggtttcttctagtaaagcatttagaaaatattgcctattaaaaaatattttatgacttcctgctgggctggttttaagtgaaatatggtggggagatttatttacagttctctgtgtgtgtgtctttctctttgcttttctctaatgaagctcaaagcatcaggccatttatcagagataattatacaacagatggagtttttccgatatataatagtctcaaagtggaagattctttcccataatgaagaatgcccaaactttaaatgtctcttttgattttaatttaacggtgtttttttccccagtgcatttattcattcatcccaaagctggttctgcaaagcatgctgcttttattagggctgtgttctgaaaagattgatactttgcagtacagtataataatgtacagttatatgctatattgaagtgaagagccataatttatcaaaaatcaatgtgtgagatcattaagttaatctctgtcaaaatacaggagttgagcagttcagcagtgttttcttatagaaattctttctgttccataatgtcagttggataggaacttgtttaagtactggtagtatcatctgaccttccatttgtagtcaaaataagaaccagattaaagcaaaaccatgatttttaagttattcattttctggcttgcttttctttttcaaaacttttaatcctatttttaagtatgcaagtaaaacatgactacattctcaatttttgaattacaaagacacaggtttagatagaatagaacatgaaaatattctaacgtcaccaccatcaatcaccaccacccaattcctactttttacagaaataaccgctgtttattcattatgggttgtattttttctatgcagctgtgtacatgtttacatacaagattttatcttggctgggtgctgtggcttgcgcctgtaatcccagcactttgggaggctgaggtgggcagatcaccaggtcaggagttcaagactaacctggtcaacatggtgaaacccccacctctactaaaaatacaaaaattagcctggcatggtgtcaggcccctgtaattccagctactcggggggctgaggcaggagaatcgcttgaacccgagaggcgaaggttgcagtgagccgagatcactctagcctgggcaacaagaatgaaacttagtctaaaaaaaaaaaaaaaagattttatttttatataaatgacagcatactgtatatattgttttataactgctttttaacttaatatattttagagctctttccaagtctacacatggagatctgccttactcctgcataatattctatattgcccttactatccttttctctactctcttctctggaggttgtttttaatatttcactattatgagccatgtcaagtaaacagttttgtacgtggctaatggtgcatatgttatttttccatgataaatacatagaagaggaactaacaagtcagagaatatgtatatttaaaattttgatttgcatggcaatattaccttccaaaatgactgtatgactttatattcctaagaatgatgtttgagagtgattgtttaccacagcattaccaatattaggtgggttttttctttgtttcttcttctttttttttaataagttgggcaaaagaatagctcattttaacttgtgttttccagacatctcctgatagtgagattcagcattgttttatgtgtttattagcaatttataagtctccagtgatttgcctatcagtgttgttctttgcttatttattttttattagctatttttttcttactgatttgtaggaattcttttatatatatatatatatgtaacaaattctggataagtatttgttacatatatgtaaaaaaagaattctagataagtatttgttacatatattgccagtttcttttggtatgttacttggcttttaattttcatttgagtgccttgtattcattagaattttttaaactttaagtctgttggtcttttgtcttccagttttctgtctttcttagaaggctgtctgaatcgtagagttataaaaatatttttctatgtacatttaatactttcatggtttatctttttctatcgttagctcttgagcccatctggaatttattttgtatttaaggcatagagatttacctttatttttttttcccaagtggataaccagttatgcaaaaaccattcattgaatagtcctagtttaaaatgctaatactattacataaagacatagatctgttcctaggctctttattttgttttattggtcaacctgtatatttctgaaactggaatatacctttatagtatgtatcagtagcttctgatttggattatattgaatatatagatttttttcagaataattgacattttaataaacttttgggtcttctcataaaggaatatagtttgtctttatttattcaaaccttcttctatgttcttggcaagagaatgtcatctctctgcacaagtttagagactaagcaccaaattagcagaggctttattttatgctactttgctctgtcccagaacacctagcacactgctggcatagtactcaataaatggttagtgatttaaatatttaggaaaagttttgtttttaatttttcttacttttagaaacctactttatgtgttttgatacattaaagaagggacttctcattgcctgtacctgatttttgaatagctacttaattttttaaaataattttctgtaccatacagtaaccccaagacaaagcaactcaaaaaaaggcagtgtccctaccagattttgaaaatttggatgctttgtggtggtaacaattcatctcagacttttggaataatgagagtcattttctgtttctctctctctctctctctctctctgtctctgtctctgtcttcagtacaaataggcacttgcctgttgtaaaataaccatttttgctcgttggtatttatcacctaaatttccctcttgaagattcccacttgcaagagagaatactagcaagcttttaatactcattttcaaaagtcccttaagaagtctgcagatctgaaaggttagtttcccaaaagattacctcagtcacttgtgagattatacagttactgatattcaaactagattttcaagcaacatcatcactgtcccccctgcccccaatatggatttctttaaatgttcgtattaaattaaatgctctgtccttctctgtgaaagtaaaggtcatgtaaacaaccacacttcacacagctttagctcttgcactcgtcatatttttattttgtgtaggtacaagtaatatgtgacactgtgctgattttaaattaaatctaagctttatttatgacaaaaatgtttggctgaaaaaaaaacataatggcatttatgtgaatgtgttgaagcagccattttaagcttacataaatatattttaattgtgcttgtgaacttctttctgaaaattcagagctgccaatgccaaaaaatgactatgtaactgtacattttgtattcatggcctctgttactttataaaccatctcactttttgatccatcaaaaagatgattctttagatttaataaaaacaataagatggcaccttagtgaggaatttttaaaattctgaaatatcagtataatcccttcactacacaattaaaattgtgacattttcaactattagttgcaaagagagatcctattattaagacctgacagtgttcacttctgcctgtaaagcaagacagttggactaaggtaatttctgtttagtgtcactcatcatattccagctgtggtacagctagctatgggaaaggctcagcaaagaggcagaagagaagggcaccggtgttccaagttgtttttacaagtccacgcaacagtacctgtggcctgaatagatgtctttttttcattagtcctgaagcctcttaggaagaacatgcaccagtcatttccctttctaaggaaagtgttgcagccttttttcagtagctgctgcaggctgagatttatgagaatagtcttgctagctgaactatgtttgaaaaaaaaaaaaaaaagctcttccagtgctgagtggtgtctccattaatgttgttatgagaatcatgcttgtgttgatggtaaaatgcaaatgatgcaaatctagaaatcggagttgagccttagttaagcctgtaaatagtcaaaagtgaagcctaaattggagaggtgacagcccctaattttgtattcgtattaaatatgctttgtcacaagagaaaaacaaaacagtgtctaaaattagtactgattttattagccaggtgatattttgacctctaataaaatggggattattctatttttatccccaagagggtgatgatgtcttagaatgtcactgttaatcgctgttggactttatcacattttgaagtatcagtggtaagcgtttgtcagcatcttaacatatggaaaggtataggattctaggtgagagattacatctgaaaaactaaaattgaacatatttaactgcttacccagaatcctttgagagttccatgaaacatgtttttactcttcttacatacgtagcagaaatggaatgtcttggtttgaaattttgactagcttattccactatcccttacctttatttacttaaatattcacattttgttgagactgggaaacccttttactgttatttacacttagtacatcagttggtttctgcaagactagaaataagtcagttggcacgtaaggagtatggggaaattggatcttatattaacctttaggttcactggttctataccagtggttctcaaatgtggtccaaagatccatagaagtccccaagtccctcttagggcatccatgagatctttccttttccaactacatatttatgtaatagtgtgctttcttcatattcatataaatagattaaatacagatatagacatgaaaatccaagtagcttcctttaagccaggccactctcattattttttaagttgcagttatttttcataaaagagtaagtttttatgttgacatctaattattttaattttaaatgaaaacatttttgtcaagttataatttcatatgggataaatatcaatgatgtaagatacataaaaaaagtttcttagtgtccttagtaatttttaagctttaaaagttctcaagacagaaaatactagcatgaggactaccatgctagtaaagaagttacagaagaaaagcttggagttagcagaggttggttcatgaggctaagaaaagaagccatctccataaaagtgcaaggtgaagcagcagttgctgatgtagaagctgtagcaagttaacaaaaatacctagctgagatcgctgatgaaagtgactacactaaacagcagattttcaaaatagcgaaaataaccttctattggaagaagatgccatccaggacttacaggaggaaaagtcagtccctggcttcaaaggacagtatgaccctcttgttaggggctaatgtagctggtgactttaagtggaagccagtgcttatttatccttctgaaaaatcctagggcacttaagaattctgctacatccgctctgcctgtgttctgtaaatggaacaacaaagcctggatgactgcacatctgtttatagcatcattcactgaatattttaagcctactgtatagacctactgctgagaaaaagattcctttcaaaatattattgttcattgacaatacaccttgtcacccaagagctctgatggagaggtacaaggaaatttatgtttccatgcctggtaacacagcattgattctgtagtccatggattaaggagtcattttgagttttaagtcataattatttaagaactacattttacaaggctatagctgccatagatactgattcctctcatggatcggccaaagtaaatggaagatcatctagaaaggactcaccattctagatgccattaagaccatttgtgattcatgggagaaggtcaaaatatcaacattaacagaagtttggaagaagtttattctaaccctcatggatgattttgaggggttcaagacttgggcaggggaaataattgcagatgtggtggaaatcacaagaggagtagaattagaagtggagcctgatgaggtgactgaattgcaatctcattataaaactttaatggatgaggagctgcttcatatgattgagcaaaggaaagtggtttcttgagatggaatctactcctggtgaagatactgtgaacattattgaaatggcaacaaaaaatctagaatattacataaacttagttgataaaacaatagcagagtctgagaggattgactccaattttaaagaagtcctgtgggtaaaatgctgtcaaacagcattactacagagaaatcttttgtgaaaggaagagtcagttgatctggcagagttgggtttttttgtttgtttgagacagagcctcgctctgtcgcccagcctggagtgcagtggcgcaatctctgctcactgcaacctccacctcccgggttcacgccattctcctgcctcagcctcccgactagctgagactacaggcgcccgccaccacacccaactaatttttttgtatttttagtagagattgggtttcaccgtgttagccaggatggtctcaatctcttgaccttgtgatccgcctccctcagccttgcaaagcgctgggattacagatgtgagccaccgatcccggcctcgttttctttttttaagaaattgctgcacctaccccatttttcagcagctaccaccccctgatcagttagcagccatcaacattgaagtaagatccttcactagcaagaagagtatgaatcactgaagactcagatgatcattagcattttttttagaaataaagttttataaaattaaggtatgtacattgtttcttggacatcatgctgttgcacacttaatagactctacaacatagtataaatataacttttatattcattgagaagccaaaaaatttgtgcaactcgaactttattgccatatttgctttattacagtggtctggaaccaaacccataatatctctgaggtatgcctgtaattgtttaggggagttaaggtggagtggtaatacgattttgttgagaaagacacccttattagcaaaatagataagctaccaattgcaacttttgacccactttgaaaattcccttctcgtaaattactaatttagatttaaatagtgtgaaagatcatgcactgagttaggattagaacttctaactctgggagattaacacttagattccttaaaaagttttgtaaatggtttaatttggaagtttcatttggagaaataagagggctattatctgtgtgttgaagaatttctgtaaacttagattccaactcactatatgtatccttgtttttaattgatggggcttttcaaactcaattatatagacagcctaggtgtgtcctttctgattaaaacaattcatgaatcccaggtttagggtgaggttggagattagggttttcttttctgaagagattacttttcttgtgcattctactgtgtacctgatacacattaaatactgtcaattctttgctattttaaatctccatttgtatattgaaggtaaaagaaggaatatttaactgctcaagaaatgtagattgtttgaattttttgaagataattttacattcttaacatggacacatcaggaaacagtgcagtttgtttcactatctccattgcatagattttttgaggtttattttgtcctttttttttttttaagaggaatcctcatcaagaaattcttgataagatatcctgaatctctctctgcccagggaggcttaggaggaaaaaaaaaagatattctgaatctctacagaagggagagaattgtagccctttaatttgttgtccagaattacctttagaactgtgagcctggaaaagtgagatgctgcaaaggtaaacaatgtacagattatgatagagtggaattgacaagctggttaaaaacggatgatgcatttttaattagcctacagtgcctttagttgataaaataattagatacttttatgtaaatgtcatgttaagtaagaaaattgaagtgttacagatctacaaaaggaatggctatttttgagtattaatgttttacagttactatgaaaggactgatagtagaatatttgattattgtgcttctggcaatgtttagctgaccaattccgtggtagtctatttttttctaattgatgtgctgttatttgtgttgaaggtttttagcacatgattaactgcagcaagtgagggctagtggaaccagaagccaaaaataaccagtcgtcacagctattttaacaaaacttttcagagtagattgttgatctctatttcaagattaagaagaaatggtatttttctgtatttactcagctgtggattttgagtgcgtgaaaggctaaatgcagctatcctccaaaccactgttcttgacttcctccttgagttgtagtcttcaactagccgatgggattgaccactacatgagtaggtagccctgggttttttgacatgctcagtaactctataggagactggaaaaatataagaattctggtgcttcactttgaaatgtgtgtgttgatagttaatggggtatctttatttacttctgtttttgcaggttacagtgaagtgagtatgcagatttgacccatgtcttcaactttatagggctgcagtcagtactctttccccgggaaaatctactaccatattgcaaatgctgtaacaatttctacttgttgggaatacagctgaagaatatagtttcatggcttttatgtggaattgcaaatgtgatccatagtgctgcattatgtatgacatctttaatacaagaatagaaacatccctagaagaaaaggtagaatattcactcttctctagtcacaaaccagttaccagaggctttattcacatgcaaactccaaactttaaattgttgaaacttgacattttttaaggaaaaagtcctctgaatgtaatatcaaatgcaaaatgttagtctgttaataaatatctccggataatgaagaaacttgaaaaaattcagttaatttgctttagcaaaagaaagcaaaaagcatttatgatgattggctaaaagttatttcaggttggttaatcttgatatcatctggctcagaatcccaagaacctgttgtattaagcaaggaactttgtaatttttttagacattaataaacccaaactcagttgccactgatacaggctagaagataatggttttaattgttctgtgcttagaaatacatctattgtcccaacctcagtcccggtcaacacacacacatacgtactacatttatctatagaacccacaatcatgaagaggctttctcacctttttctttagttactacctctgtctaccctgttgtttggaaagaagaagaaaggtgaaaaatgggagccaagtttacagtgagtcatggggacttacgccagccacactctccggcattagaaagtccagagaggaactttgacccttaatgtcaactctcaaaactattttgtttgctgcaaccaaatgttacccatgttatatattttgttgttgttgtggacagaaacctgaaaacattttctgtgagtggcccttaatttcctgcattgattttaacagagttgatttggaactacctgtaattgtgtggatgacagcgcaattagtgtagaatatatgtgtggtgctgacatgttcctgttctgggttttaaagtgtttcataggttgtagtttgccagaccaaatttaactctaagctctctgtttataacattgcccaattatcaaagctgggatatattattactgccagttactcttgctgtcaatttgtcttggctcaactatggttccatttgtactttactgtaatatagtgaatacattggattaggttgttagtttaacaagctctctggagaacaccttcatgatgatgcatgttgagatatgctaggaagccttaaagtttatttgcagaaacctacagaaatgtattcactagaaatttttaaaagaataaactctcaacctaaagacaaggtaaagattctcttatttgataatcctctagaacatatgtaaatatgtgttaattcatgagtctcagccagatttctttagggattttgatttgacagtttctcctttcttatataattctactggatgaattattttatgtgctttaaaaaaagcattttgttagttaagctgttacccttgtgcactgtgcagctcatggtgttatgggaacttagtgatcttggccagataccgagttaggggtaatcagaaattagaaatgactggactgttaatatttacattgtgctcagctggtttataaaagtacactaacttcctcctatgtccaccccaatctcttacatcaaaatttccagggtcagggcttgggaacttgtattttaaaaaatgatccccaggactttctgggtgttgggaatgttctcatattttaatctatggttgttacatagtgtgtatgtgttaaaatccctcaggatgtacatttaagttctatacacatcattctaatattgcattctctcaaatgttacaccctaattttaaaagttcctccaaaaaaaaaaaaacaccacatgttctcactcataaatgggagttgaacaatgaaaacacatggacacagagaggggaacatcacacaccagagcctgtcggagggtgggggtctaggggagggatagcattaggagaaatacctaatgtagatgacaggttgatgggtgcagcaaaccaccgtggcacgtgtatacctatgtaacaaacctgcacattctgcacatgtatcccagaacttaaagtataatatatatatatatattaaaatatataatctgttactcttctgattaaatagttcgcagtagtcacttaatgaacgttattaagcattcactgtctatgtagcaatgacccaacagtagataacagtgtgattcttgatccttgggaacataaaatcaagtggaagagaaagtgataatacataatataaagttttatggtttatgacatctttctgtacagatgattcatcaaaagtcgcttattggcagttttactatttccatttttttgtttgttttgttaaagaaaccgaggatcacttatccaagattactcagcaagtagggagtagttgtcagactttaactcagtcttctaaaaagcctatacttttccagaaataagaaggcttcagttaacaaaaacaaagaacccttacatggaagcagaagttacagcattttatggagctatagaagccagtccaggagggtttttgaggatgttgaggctgtgttagctttgcatgtttctcattgtctcttcttgttccctgttttcatgtcgcagtttaccatttgaacctctggaattttagtccattacactttatctggtgaatgtggcatttgtagaaaaatgttcagttgaaattactctgctctctggtctgcctttcgaaactgcaatttattcttgcctcattttcaaattcttgcatttccaagtaatacaagccaatgatgaatgttctccttcctcattacatatagcctttattacctgtttcatgttctttggcactcggccactttctatctagctatttattgctgtcatgtattgttctgcatttatgtacagaagttttttcttttttttttttaaagaaagattatgatctccatgactgtgtggtgacacatagtaggtatttgctaagtgttctttgaagtcagcagtgcacttacttggttttttcctcttttaaaatttcccatctgtgtcttcttacactcactaagggttgttgctgttatggccttgttatagtaaagagtaagctaagagggagctccttaggtgggctctccaagtccttaaacccatgaatctcggcactatacactctaggaacaggtctcagagctctttcatctttccctccttttcagtgagtaaattaaatgatatgaattattgttgtaggagatacacaactctgccaagtaaccatcttttacttctgctagtcacagtcacctggggaccctttttaaaataaatgtgtaacatttgcctatgtgtcctattcctttatgatcaccactgcccatcccagggcatgtcattggggagtgttggggtatgtatcaatatcaacctcagaatgtgttgaaggtcttgattttgcagaatgaaattattgattttcaagccttcactcacccaacaactatatctcttgcatactcttgaattatgcttatgcatcagatctctgggcccaccaagattccataaagggcctctcgatatcatatttcttataatgaaactagatattcttccttggtcagcaatgctttctttatatatgaaaatgattcttatttcttctgacaagcagtttattgtttcttaaggccccctccccttattatgtaaggctagtttttcagtaaattccaaggtagagtgactgctgagaaaccaacctaagagagagtactcttgctcatcgttctgtggaagattgcatctccccaaacttgtgggtaatttcctctcacccagatctgaattctaattaaatttttattctttaacttgttaacattatgtgagactcggctgttttttttttttttgtgtgtgaaaagcatgttagaatgtagaaagactatgcatctctgtagactaaattgctgaactaaaattaggtccttagaattaacccaccaccaccgtctttcctactacttctcctcgttatattttcaggttgatcttttcctttttaaagtttctctttactcaggaaagcaactatatgggcatgtaaaggatgtgtcctgactgatgcacctgcctttctgtttctaggtgggccatgcacagacacagctcatgtctcattaatcacaccaacaaaaagatcctgtggtacaggtatgtacgtcattcttatgtgaattcatccttatttgaattcttcacagaagttagcaactggttctaacttggtgtgcttctcagggtactctgatttcttccgtcagttgtgaggtgatatgtgcttagtattcacggcggagtgtcagcagaggtcagaatgatgtttttggggagtcagattgactgagtaaatgcagctagatccaagaaggtggacatcaaaatatacataatttctaatatctgaagaacgttattaagacacaacagaaatgcagatcattgcccagtttgtagcatgtaactaatctgagggccaagattgaaattttaatagttttaatgtagaaaatcagtgttttaaattgactattgtagtatcctactatttttggataattattttctgtcattcgatttaaagccgtggatatactgaaatttctcttctagatgcatagaatcccaaaaacatctttgtgcatctgtgacatttttattaaatatgaagtcatgaatcttgtggctctctaaagagcagtcagaatgcccattgttgccttcgcctgtagcttaatttattttaagcgatatttgccttttctaataatgctgtctgctatttaaaatatctcaaggattatatttggaagagtcaaaataattatattgtttttctaaaggtcacagagtatttttcataacttaaaaaatccttgtaactccccagcagaagtagcacaaactgtttccatgtacaaacttaacactgcaacctcagctcctttaaatgctcataatttgatgctaggcctcagtcaggcccatgtttgcatagtttcaaagtaacatccaggcactgaattctaaggaactcagttgtactcttctcttccaaatgaccagctttgaggtagggtagggggtgtgagatagtcttggcatgttcttatccctcttgtgcccggttcccaagctccactaggtagagtagatttcttttttttactgaggtagaaaagagctgtgcctgaagtgagatagaccatcctgattttagccagcgggaagtcagagagccaactacctgcccactccagccagaagcttgaaaacattcagtgtcctttgatttgaggtccagcacttcaaatgcacagtactttagtcttttgtttttccttccaatcttggccctcagagaaggctttactgttaagcactaccactatgttcaggtagcagtcaaggagttgaaccttgaacacactgggtcatcctgagaggtttgggaaggagactcatgtactcagatgctgaaacaagcaggaaactctggtgaatatcatttacttgtgtccatcttctaggtagatctgtttcctcctctctgatcctatactattttgtgtatctaaaactaataatgatatttattgtatgcttactacattgccaggtattattctgtatattttatatacatggtaatttaattttcagaacagttcttcaagatagttattatttttcctcttttacagatgaaaaaaatgtaggcactcataaacttaagtatattttctgagataatattgctagtaagtgatggagccaagacttggacacggatctttaagacactaaagcctgcgctgttttcccctatatcatgctactgcttttcacattttattgtaattgtttcttctcctaaccagactgtggaaaagcagactgttgaatgaaatatggaaaaaatgaaacatatatttggaaatatagcatacactaaagtagtttgaaaatgtgagttctaaaatcacatctggtttcagatctaagcttagccacttaccagttgtgattttaagtaaataagttaacatctcaaaattttgttcttcatctgtaaaatgggatgataaatctctcaggtttggtgtaagaaaaaaataatatgctcacctaatagaccttcaattactggtagtttccatcatcttaatgaggattatatctttatagtgagcacccattagatggtgttgataaatacatcaatgagtattttaggcagaaagaagagtaaagtagaagtactggcattctttgctgtactcagttttattaactgattttatattgatcacgttctttgttacatgtcagtattatagtggcagttgaaggtggtaatatttttagatctccgttagtgaaatgacaggcattgagctctcagtcatacctttgtaggccttcgttgaggtgaatacctacctcttaactagaaaaagatggagaatttcttgcttggaaggaaattaatgcaatgtccaggtcatctcctaaaaagcctgaaggaaaattgagatttctcagcaatggacattaaaggtcatcaagttaagccagctgtacttcttttcaagaagactgttctgtgccctcttaggctagccagactgcctcagccttaaatattggccctgactctaaaggacagagcttcctgattttgagaggtaaattgaaatgatttattttgagaaccacaggttgactgtctttgtctccatctttctctgtgtcctgcagtcagcaggttgcccatggtggggatttcaatcatttttcttctgaaccaccaattgttattgttattttgctggaatgttctttgtagcctttatgtctaggctcttcaagttaggattcatatctatgacatgtgctgtacagtgcttctactgtgaggtagtctcccagacagaaaccacatgggccttcaggcatagatggtcagtaaataattactttacagtggtgtcatttcttaggagacacagagtgagaccttaagtgagatcttacctacctcctcccatccaatctatccatacaaggttggacctaaagcagccttgagcttaataatgatgtgtgttagaacaaggatactgagattagactaaggtggttctttaagtcagccgtctctgacaaagggcacacaatgtactgtctgaggtgtgtggagaaaatagcaaaagctctttatctcagccttaatttatattttgcaaattcactttattatatgtgtgtgtgttcatacatatacttttatttatttatttatttttattttttaataaagacaaggtcttattatgttgcccagactggtctcaaactcttgagctcaggcagtcctctcgccttgacctcccacagtgctaggattacaggcatgagcaaccgtgctcagcccatacatgcagtttataaacagcaaatacacacacaaatatatacatattaaaggtacatggccagttagataggactatgcagtttaaaaaggttaatgacttcttcagtaaacagatcattttcttcttagtactttgaaaattagctctaaggattagcattagacccattattatgtggtttagtaagtgaagacctcagtgattgattaatcagtcaccatttgtatttcaagcaattactgttttgatcaggtgaagggtattgtcatattttagaggtgggcagcagtgtagagtggttggtctacaactatcaaaatgagagaggcagctcttttttaagaaattgttttgtgatcactgtgagtctacgaagcagattgcaaaaagtagctgtagtagcaaatgaaagatcagtttgtctttgtgagatagatgggaaagacttttctttatatgatggcttttagccagacagaattattaacagttaaactcattgtaatctttagattaaaaaaaaataaaaaagcaacacgatgatcattttggtatttaaacagagagaaattagatagatgaagggtgtgtggtcgttcccactccaccccacccctaccatctttgtagagttctaggatctccacagtcaatgaagagttgaaaagtactgccaagtcctaggttgcttttggttagaatgtgtgagttaaagcacatcataccttcagattactagacagagtttacatttcttcagagctcagaatgttttccacatgttcccttgttaattctcacaacattcctgccaagaacaagtattttgtgaaggaaagagatcactttccttggcaacaaactacaagaagattcccttttgtccctcatcttttctaaccgtcaagttataccttcagctaataaaatactgtaaccggagttacagtcatctcctttaattttatttggaaggtatttggatatttagctggctatcttcatgacagtatatttttatgtttaaagtgggcacagattcaatgcaatccctatcaaaataccagtgacattcttcacagaaatagaaaaaaatcctaaaatttatatggaacaacaaaagacccagaatagacaaagctatcgtaagcaaaaagaacaaaactggaggaatgacattatgagacttcaatttatactacagagctatactaaccagaacaacctcaaactggcataaaaagatatgtagaccaatggaatggaatagagaacccagaaacaaatccacacacctacagtgaactcatttttgacaaaggtgccaagaacatatactagagaaaagaaaatatctccaataaatggtgctgggaaaactggatactcatgtgcagaagtatgaaactagacccctgtctctctccacatacaaaaataaaatcaaagtggattaaagacttaaatctgaaacctcaaactatgaaactactacaagaaaagattgggagaaatatccaggacattggtctgggcaaaaatttcttgagcataccccacaagcacaggcaaccaaagctaaaatggacaaatgcgatcacatcaggttaaacagcttctgcacagcaaagaatacagctaacaaagtgaagagacaacccagagaatgggagaaaatatttgcaaactactcatctgacaagggattaataaccagaatatttaaggagctccaacaactaaataggacaaaatctaataatcgatcaaaaaaacagacagaagatttgaatagacatttctcaaaagaagacctatgaatggcaaacagacatataaaaagttgctcaacatcattgatcgtcagagaactacaaatcaaaactacaatgagatgtcatctcaccccaattaaactggcttatattcagaagacaggcaataacaagtattgacaaggatgtggagaaaaggaattccttgtacactgttggtgggaatgtaaattattacaaccactatggagaacagtttggaggtttctcaaataattgggctcccatatgatccagccattccactgctgggtacatagccaaaataaggaaataagtatactgaagtggtatctgcactcccatatatattgcagcactattcacaatagctaagaatgtttccagcatgaaatgtttccttgctgttaggttactggaagtttatatgatattttaaaaattgattcagaagctaaagagtgttggtattaaatcagaagtggccccataaatcttagtaatacctacacttatgtgttttatctcctggtagagtcaatattcatggaaacaatattcattggaagcaacctaagtatctaccaacagatgaatggataaagaaaatgtggtacttatacacaatggagtattattcaaccataagaaagaatgagatccagtcattctttttttatctgttccatcatttgcaacaacatggatggaactggaggtcattatgttaattgaaataagccaggcacagaaagacaaacgttgtactttctcttttatttgtgggatctaaaaatcaaagccgttgaactcatggacataaaaagtagaaggttggttaccagaggctgggaagggtactgaagggttggggaaagaggcggggatggttgatgggtaccaaaaaaatagaatgaataagattcactatgtgatagcacaacagtgtgactacagtcaataataacttacttaaagagtgtaattgtattgcttgtaactcaaagggtaaatgcttgaggggatggatacaccttttcattttatagtccttttatttctgaaattaaaataagaaagaattcataggcaagtttgtggacttgacagtattgtcaacagacttttgctccgctctatctatattcacttttactcttcttccagcacatatgttgagtagataatattctctctgatagacttgaaaaaggatggttaaaacatgctgtgtgtatgtttaaaatgtgattataattagtagagcagcaaataaaataactatttgtgaggccataagggagctgtagaagtgtctgagattaaagcagatgagactaagaactgttccattaaatatcaaggcagtttttccagaaagtgtcatctttttaccctataagaagcatgttaattcaattttactttatatccctctctccctccctccctattttcggtcacctgttttcctttcagtgtgacaaacagtgacatgaactagaatagctttgtattgttcattgttctcttttttcccccaaaaaagagaacagtttttcccttttcttgactcacttctttttttatttgagatagaatcttgctttgtcacccaggctggagtacagtggtacagtggtgcgatcttggcacactgcaacctctgtctcccgggttcaagttattctcctgcctcacccccaccccccaagtagctgggattacaggcacctgccaccacacccggctaatttttgtatttttagtagagacagggtttcaccatgttggccaggctggtcttgaactcctgacctcaagtgaaccacctgcctcggcctcccaaagtgctgggatgacaggcatgagccaccacacccagccttgactcacttcttttgtacagcctgcttatgatattgtttcttcttgcaaagacgagaagaaaacccccttcatctggaagttaagagaagattgatgtgctgaacactttcacatcagtgtttggaagccagttaaagggaaatgtttccttgttgttaggttactgaaaagtttatatgagatttttagaattgattcagaagctaaaggtgttggtattaaatcagaagtggccccgtaaatcttggtaatacctacacttgtgtgttctgtctcctggtagagtcaatattcatggaaacatttcagccagtacatttaatcctagagagttgtgtcagtggctatgaactgtattgttcaatattacacactatagttggctcttccaaggaggacttcacatcttcctctgctctgtgaagttttgtttttgtttttgagagggagtctcggtctgtcacccaggctggagtgcaatggtgcgatctcagctcactgcaatctccatctcccgggttcaagcagttctcctgcctcagcctcctgagtagctgggactacaggtgcgtgccaccacacctggctaattttgtatttttggtagtgacggggtttcaccatgttggccgagctggtctcgaactcctgacctcaagtaatctgcccaccttggcctcccaaagtgctgggattacaggtgtgctctgtggcattttaaagggaggtagcttcgggtgtgagttcaactgtataattcacttttcaaatctttcttgttggtccttcaggtatagctcttccctcaggtctgcagtatcagcatttgaggcagaaaattagaaatttgacctacttatgtaatatgcaagttcccatcaggagaatattagggaagatataaacctttcattttttattagtgtttaatgtaaccattgaagaaagatcaaaacagtaaatctgtcatggcaaggaaaaagtatttaaataaatgttttaccttatgcactcatcatcttgggtcctgaaggagttcatttgattcctggggcaggggacaaaaggaatatcaaatatttggcaagattgcaaaaatttctctaatcaaaaaggtgccatctgaccatgttttgccacagaaagcagttctcaccaaagtttatcatggcatgtcatagtggctgtttgctgacagtgtgtgggttttggccattcagtggatgactgggaaagggaaataatctactaattgctttcccttgggttttttgtttccctggaagaactttaatcagtctgcttctattgtttatgttgaagaatagaatgaaggagtgaggtaaaatatactaataattagatgatttgatactcaatatgtaaataataggtgggtttaaaggcacctcacacaatgtatagatttcagataagatgagggaaaattaactgttttgtaattggagccctaaatgagagttaggtcccattgccacctacgtttgtgttacagcacaatgtataatgtgtcagtttgctatacttaaagtcaaaaacttgtatccaaggcctcgtttgggctttactcaggagaagcaggggctcctcttctgagaaaaggctgaacataagtgaataagtggaacatcaagccaggatgcagtctagtcaagaggaatttttgcacttgaaaaataaaaatgcactctagtataaaaacgaagggaagcgtcatgtggcttgttgctcttttggagatgtgtgtgtgtaagaagtccaggctttgctgttgagcttttcgtgattcacatgctttgcacaaagtcagtttgcatcagtccacaaatgcagttacagctggtttttttttttaatagtcatttattttatcataggttgcattcttaccaaggagaaagagccctgaactttcattaattagctgttctgttgctccactggggcaaaatgcctgagccaatactatttaaaaagcatatcgggaatttaattcccctctcctcctttgaaactttaggatttttttttttttttttttttttttttggtgggggtgtataggtctggggagtgcctttcaggtgctgctccatagcatgtgtgtgcctgttagaaggcagcatgttagaaacgcagccttcccaaagcagtcttaccagaaggagtgggatagaacagccacaaagcaacattataaatcgtctgagccttgcaatgatactgcccattaaggagccttttttttttttttttgccccactcagttcctggctctactaatagaacagcgcatcaagcaaggctgtaaataaaagttattacataataggtgggtgccgaagtggaacagacggagctgaggcatggaggccttattactgctcatcagcaattataaacaggataaagtgtctgggacttgcgctgatgcagcgagggctaatagaggctggggatgacactgggcaatgataggatgatgtatgctgatgggttttactgcctcatcttgctgctagcttccaagacaagttgtattctctgttttcctgcttgctcatctgtctgaagagatggtcccattgcctctcccgccagcaggtgggctggcatttattcctcatacctgtgtctgcttccaaggcacccccctcgagaaggatcttcagaaatatttcataatcatggccgattaaagttgtaatcttattgtatagtctgccatcatagttacagatcacaccctcagaaggagttgcttatgtggattatagcaccagctgagacactgtggttaggcagccagtccagcactttactaaaagactgctgtgacagagtcctgtagtagattctgtaggaacatgcaaaagaagtgataaatgtgtatcttgcccctgggagcttacaccatagagagaataagtacagaaacaagtacaactaattccagcttttgcgagcaagagatgtaacttatgtttatttcaaaaagtgaagaacaggaagatagattatgccaatcattaggagcaaatatagtactaatgttgtatttttcttttcaagaattatcttcctcgtgaaatgcttagaattcactttagagtcatggggaatgatgaagggatactagaatgtggagggaaagtctaggagtaggactgtgttttccagtgaatggaaaacttcaaatgtgacttggcaatgcttttgagtagcacatgagcacctagtacttggaaaaactgagatacagctctgttcaacttcgagtgctcaacttcactaaatcacagtaatgagacctttgagataggagaaatctgtaacggagccacagaagaatactttttggaaagggctttccggtttgatccaggagtttatcagcattctggtacttcatgtatttgtcatttgtgcctttaagtaaatacacatctttatgtgtagtaccctcaaaactaacctatcaggagacttcctactgttagagatattgtagtttttctctgatgccttaaggtgtgcctaggtgtatctcagttttgaagaagcctaatacatgctaatcccagtagtataagctacataaactaagaattaatgttataggaggatccttcagtctataaaatgccttgccattgggttaatgtaaataggtttttccttttgcatataaagtaatacttgacttgccaaaaaaaccagttcctactgatttattcaggaatgttctgtgggtagtggccagtggaatagagaaagagagataaatctgattaagatatgtttgaaaagagtaattgacaggatttgatggctgattagagttggctgaagaaagactgcaaagtataaatctggagaactgagggaagaaagatgtaactgacagggaaggagtaggaagaaaacttgattgaaactattttcagtttctgatgagttaaattattatagtcctatagaaaattataaatatgagcctgttttagaaattgctaatttagaaacaatgattaaaactgtgcaaatgaataaagaagaagaatggggggtaaggactgtgtttcagggcaggaaagagaaagaggagccagtgagttaaggaagctaaagaaaggagaaagcttcccacaggatcatgaaagatgcatgagaagagggatcaggaaatgtgaggactaaggaaagctatggccatggctagcagaagatcactggaaaacctgaacgaagtttgtgtaatgtgtgggaaacgaaagcctgaaatcattaaagagggccttgataacaaggaaataaaggcagcagacagaaatcattcattatggagttaattgaaccattaaaaactagcaaatagtggtggttggagggagagacagggtcgggcattttttggtgtggaggtggttaaaatagtgaactattttgcccctactaaaatacaaagaaaagggatccaggaagagaaatagaaaagattagaggagaaatggaagaggcatacaagcaagactcagcagaggcagaaacccagaagggttatttctatctaagagtgtaaggaaggacatacagtcagagattttctcagtaaatgagtagatagttagctgagacaagatgaactagggagtttctcctagaaaaggtggtcgccgtgttctgattaaaggaaaaaataataccataagttgtaagtagcagcagagagctgagggtataaggaaggaactattgtggactgaggagggaagatagcatctacaagtagtagctaattcaagctgtcattaagtagtttaagtttatagtgggccaaagtaacactttccatgggtactgcatttaatccagaagaaaaaaaaaaagcaaaggggaacaagtggtgctctctttgttttttaataagatttcatttttataaaagtaacatatggtaacacaccatatcacagaatagcttagaaaagaaagtaataacttggatatgatcctactccacaaagctgaccagtgtttctctcttgacagttttagtacctttgttctgtaggttaccttgtaattatgagaggaaaataatgcttaaagtcctcctttttgagatgtcaactggcatgaaataggaagatttagcttatactattcctcatcccagtgtttgctattttattgttgattttcattctttcctgatccatcaactttcagcatcatctcttaatgaggatattaatacatctgattggaaatacttattcatcatatcttcggtcggctacacttgtaatttttatatgtcatggttgttagttaatacaggttgagtatccctttatccaaactgctggggtccagaagcgtttcaggtttcagattttttaatatttgcattatacttactggttgatcatcccaaatctgagaatcccaaatctgaaatactccaatgagcatttcctttgagcaccatgttccagagctcaacattttgtagcattttggatttcagatttgaggattagggatactcaacctgtatttacagtcaggctgtaaccagaagcaaatcctccatgtatgttcataggttgttcctaaaaaattgaaagcccaatatatgacatttacattattatgactctgtaaacgttccctgtcaggccaccgtgatacatgctaagaatatatttctttttctatgggtctaatgaaaacagttaatggtgaactatttagaaagcaagctttcatttacttttcagggctagcatctgtgagccattgcataagaatctctgagccatggaaaaagaatgttactacagcaaagccaaattgatcctttattatattccatcagttgctcaaaaatcatgccacatcttagtttgccttatatttgcattatagctttttaatacaggtccccccacccctggcatttataattgcctttctttttttttctacagtatttggttttacgtcaccacttacttcctaactctgtatttacacctttcacctgaaacctttttcctagcgcctaccggtctttcctctccaatctgaactagattctgtaagcccgcggtgacatcctagaatttcctttcactgctcaagcttttattctctcatttttccaaatacacccccaagttagtgcctaaaagaagcagtgttagagttcctgcatatctgaaaatttttttctgcttccattatgttggaaaatttgagtaacaattctcggatgaaagtcattgcttcagccagacacggtggctcatacctgtaattcccagcactttgggaggtggaggtgggtggattgcttgagcccaggaattggagaccagcctgggcaacatggtgaggctttgtgtctacaatcaatacagaaaattagccaggcatagtggtgcgcacctgtggtcccagctacttgggaaactgaagtatgaggatcacctgagcccaggaggtcgtggctacagcgagccatgattgcaccactgcactccagcctgggcaacagagctgagatgctgtttcaaaaaaaaaagtaattgcattcttgtcttctagtattccatgttactactaagaagtcagatgccactgattatcatttttatgagtaatatacctggatttttttcacttttagaactcattagggttttgttgttgttgtcccccccaaccccccgagacagagtcttgctgtgtcactcaggctggagtgcagtggtgtgatcttggctcactgcaacctccgcctctcgggtttaagcgattctcctgcctgagcctcccaagtagctgggattacaggcacctgccaccacatcgggctaacttttgtatttttagtagaggcggggtttcaccatattggccaggctgatctcgaactcctgaccttgtgatccacccgcctcagccacccaaagtgctgggattacaggcgtgagccactgtgcccagccagggttgtgtttttataagcttagtgttctaaaatttgtagtgaagtgtgtattaggcatcccttttttccattcaagatgcgaatacttgctaggtcccttagatctgaagactgatgcccttcttcagcgctggaactcttttattttcccctatcaactttgtgggggtttttttgttttgttttgtttttctgggatgcttataatttagatgttggaagtgctattttgataatctttctctaattcttttctcagagtcttcatttcctgttttctggatgattctgttgactttgtcttctgacccttttatttcaacaatcatactttgagctcacttttgttctctgaagattttttttcgtaatgttctttccttatttatgtatataataattccatggtaatgtcttctaagcatattcattagcggttagatttgtcattgtgctcttctgttttctgaattaccagtaattaccttgagaccgggttttctgtttatcttggtcttcttcatgctctaattctcctcatttacctggcaaagcttggttttctgttgacttttaagaaagaggctgtggatgagtggggaagataggactgttttggtttttgagagtctcactctattcacctagtctggagtgcagtggcgtgatcaccgctcactgcagccttgacctcctgggctcaaacgatcctcctacctcagcctcctgagtagctggaaccacagtcctgcaccagcacacccggttaatttttcattttttttttttttttttttaagagacggagtctcgcttgttgtccaggttggtcttgaacttttgctctcaagtgatcctcctacctctgccacccaaagtgctagaattacaggtgtgagccaccgcacccagcctaggactgttttctactatatctctttgttatgtgagaatttttactgggggctgtgtgtgggaagcagtgagtataggtattaactggcagaattagtggtaaggaggttgagaacctgctgttaggctttcaaattcaggaggagaattcgactataagggaccatagaaacagctttgcctagacagatcatccagttgctttgaagaagagctgtctagatttttgccaggtaaacgtgggctggctgccataaagttattatgaaggaagtgagataatttatctaaagcacctcacctagcatgatgcctagtaaatgctcagtagataatagagatgtagacagatggtacctgacaatcttgaatgaaatgagactgaagagaaacttgagggagtgtagaggaaagtgagaaagaacttagagatggaatcagaagctgataataagcacctgaggccagtcagattggagaatgcagacatggaaaggaggtagaagtcagtggagatagggaaggagggagagccatagcagcccttgtttgaacaggtgagcgctgtgaatgacaggaagctcagaaagcccctttgtcctttcttaagaaaattgagaattataattgggaaaatcagacttccttttttgttgtattgcttttttctagcctggccccaccccgctttttgagatagggtctcactctgttgcccaggctggatacagcagtaccatcacagctcactataactttgacctgttgggcttgagtgattctcccacctcagcctcccgagtagcttaggactacaagcgtgtagttgtctcactgcaatccctgcctcttgggttcaagcaattcttctgcctcagcctctggagtagctggaactacaggtgcatgccaccgtccccggctaatttttgtatttttagtagagacagggttttttcaccatgttggccaggctggtctccaactcctgacctcaggtgatccaccagccttggtctcccaaagttgtgggattacaggcatgagccacagtgcctggccagaagtttaacttctaaatgaatgttgtaagaaaatgaaaacagtattgcccatcttttttttttttttgagacagagtctcgctctgttgcccaggctggagtgcagtggcacgatcttggctcactgcaacctctgcctcccaggttcaggtgattctcctgcctcagcctcccaagtagctgggattacaggtgtgtgccacaatgcctggctaatttttttttatttttagtagagacaggcgtttcactgtgttagccaggatggtctcgatctcctgacatcgtgatccgcctgccttggcctcccaaagtgctaggattacaggcatgagccaccgagcccggcctatcttaaacacagttaaagtaagtcctcacttaacattgttaattggttcttggaaactttgtcttcaatacatatatatatgtggtttttgttttttgttttttgtttttgtttttgttttggtagagatggggttgctcaggctagttcaaactcctggtctaggccttggaagttaaatatttccgtatgtattggtggaaagtaattcttaacagagatttcacaagcttgccttttaaaaacataaatattcctatttcctgaggtctctaagcttttatactaacaactgagaactcttctttctagggcacatcacaatttaggggccacagagggttaatagtttcttgcgattaaaatctgggtaagaaagactggctgttgcatccaaaccaacaacatgagaagatactttagccaataaattcactggtttatgattaaaaatcagacagtttaaccttggaggcatttttgtcatgggggacttaatattgtgattagttatctgaacagccaagtgcctctgtgggttcagttaaccagcctcccactatatatgtataattatttctagtgcatacacatactctgccataaaagcttatttggccttatgcaccccgtcattctgaattctctgtttcattaccagtatccacccacagagtttcagaaagccattcccaaatagcagaaccacaactcagaattttaaataaactacacctccattagctcaataggacaggggaattagttacatgctatgcatttcccacacccatccaccctttcaaaacttactaaaaatgtatacatatataagcaagaaaatagggcatttaactcagattgtgttaatttttctgttactttagcaaggagtaaagaaaaagactatagcagacaatctttaaaatttttaccttgaatatgggtcccaaggtatatatgtatttacttgaaaaatgtactgggtgctgctgctttttttctagaggaagtcaaacaactctcttcaaagatagtgttattacattacagcttgaattatatgtccaaatatgcagatggcttttaaaagaaagctgtatgcagggagagaactcatgtagtaccattttgaatgagaggtgttagctgtagcagaatttgttttccagcttggcattaactgatagttcctgtaactgacaagattcagctccactttttccttggcatcctgttgataaacctatttctttttttctttttttttttaagacggagtctcactctgtcgccagtcaccaggctggagtgtagtggcatgacctcggctcactgcaacctccgcctcccaggttcaagtgatgcttctgcctcagcctcccaagtagctgggactacaagcacacaccaccacgccaagctcgtttttgtatttttagtagagatggagtttcaccatgttggccaggatggtctcgatctcttgacctcgtgatccgcctgcctcgacctcccaaagttttgggattacaggcgtgagccaccacgcccagctgataaacctatttctagaagattaaaatcatatcttaaggtcttggtcatcatccttcctagaatagccattgcagtaattaatgcaatgaaaaataggttcttattggtgttggaggaagtaaggaccaagagatgacaagtgaaagtctgtgagtaatcactgaagtgtacctacaggtaagttttgacttcactgcaaacccggagaagcatgagttctgaccctactgttgattaccagctacaaacatgttgtcatgtactttcccatcagacctaagcagtgtcagcatttctgagaaagaattcagtaggcactccagccacttatctctaaggatagctgctctggaatatagttatggatttttctttttttaacataatttcagacttcagaagttataagaatgtttcctaaaattcttaggtacccccctacccagcttttcctaatgttaacattttatcacattggccttatctctcgccctctttgtgtctgtctgtatacatgtatgcatgtgtattatatccatatccctgaccatttgagtaaatcgcagacatgacacccttttataccaaaacttcagtgtgtaattcttaaaatcggaattattttacacagctacagtacaattgtcaaaattgcgaacttaacactgatataacatatagttgagttttagtatggtggatcacaatgtggacatcttgataaatcttttagtgaagatggttgaattgaggttacaatgttagatagttgctcctctcatgtttcaaatacatactaaagacaattttcataataatgattttatgcagaattccttgcttccgatttttcagcagctcattttgcaaatggagttctctttttttatatataaaccattttcttaaagcagctttcttcagctctcttaaacgttgtacacacttagtagtgcctacatcaacactgacacaaccctgtataaggaacacctaatatactcattcagggagaagaaaaggtgtaaggctttctctgggcactctgtgtcataatataccagaagaaatctaacttttggttcatttagcatcacatcacatgaggtgcagaagttatttatttataagcttaaggatttgtcttgagagcagtgagtcaaaagactaaatttcgaggcgggcagatcacttgaggtcaggagttcaagaccagcctggccaacatggtgaaaccccatctctactaaaaatacaaaaattacccgggcatggtggtgggcacctgtaatcccagccacttgggaggctgaggcaggaaaattgtttgaacctgggaggtggaggttgcggtgagcggagatcgtgccactgtactccagcctggcaacagagcgagactccctctcaaaaaaaaaaaaaaaaaaaaaaaaaagactaaattttgggtggaagaaactaaatgataggtagggagaggaactgaattaagctgatgctaaactggaaacaaaaatagtttaaaaacaaatcagctatttaattttagcatctactcagttatgcattcaagctgatttttttaaacagcaaaatataaacgttcaaacatttcccccttacattaaacctggagcatatcccacaggatgacagtctctcactgctagattaccatcattagcaacttgtcctgttacagaaatcatcttcctcctttcttctttcttcttcctcctcctcttcttcctcctctttcttctctttctcctcctcctccttcatcttcttcttcttcatcttcatcttattgttgagtaccagtagagtactgaacatagctgattctgctcccaccctgaaagcttgcattataagtcagacaggcaaaacatttggaagatgagaaacactcacgagtagggtacttaggcatcataggggtgggataatttacatgggaatatctgactttttgtctgtatgtgtgtttttgataaaaattcagaaaatttacttgaattagtgtctcattcatctttacccatttccccacctcacccctacactcagtgtttctccataaaggaaatctattttcagtctttttggcaaaggactcagggccagattaggttaacccctgggcaagtcatctatacttagagaccaaggtgttggggtacagcattattcgaagacttctagcttgtctcttccctccagacctgtccaaatataagtcaacagtaggaggaagtgcccacagttgcaggtactatccagctgcccaaaagttgtataattttataaggctgaatttaaatgcctctaggcttcacgtaactacagagtaggcaggagacttactctgtatttctagaaagtttaacttttttgtttgtttttttgaggcagagtcttgctctgtcccccaggctggaatgcagtggcgcgatctcggctcactgcaacctccgcctcctgggttcaagcaattctcctgcctcagcctctggagtagctgggactacaggcgcgtgccaccatgtccaactaatttttgtatttttagtagagatggggtttcaccatgttggccaggctggtcttgaactcctgacctcaggtgatccacctgctgcggcttcccaaagtgctgggattataggcgtgagccaccgcgcctggctggaagtttaacttctaaatgaatgttctaagaaaatgaaaacagcattgcccatcttaaacacagttacagtaagtcctcacttaatgttgttgattgattctttcaaactgcgactttaaggggaacgacaacaggtcctcagataacatcatttggttatgacgttatgagaaaaaaagttggctttgttatatgttgttttccttaaagtcacagtttctaagagcctgtcagcaacattgaggacttaaccgtatatgaaaataaatctgggtgtgtgtgtgtgtatgtatatatatatatatatatacacacaatatatatatacacacacacatatatatacacacacacgtatatacacacacatatatatacacgtgtatatatatacacacatatatacacgtgtatatatatacacacatatatacacgtgtatatatatacacgtgtatatatacacatatatatacacacacacatacatacatacacacttcacggacttctcaagtttctctcttttggcagatgaaaaatcttggctgattttgctcttctgataaatactgcaaaagatagtagaactgaagttctatctagtcttaacactgtacgaacactgtacaaatctttgaattcttatggttatagactgacttggggccaaggaacagattaaaattaggggacttgggcatgtggactttgagaagtagatttttctgttaggtttttcagttttgcttttctgtctgttttgtcttaacttagagtactaccttattcggtactccactgatgctataaatgtagtatttttaaacatcaatgcattgtaatgttgttgaactccaaaatgcccaagcatgttataaaaaggaaaggttatctattgaggttcatttgtcatttacaatgagaactgaaaactttatgagaaaaaagtaatatagttgggcaggcaggagaggtcttgctgatatggagaagctaaaacaaggaaatggtgctaggctaagtatcagccacaaaggatgactgctgtattgctagcctgacaggttccactgaccagacacctctttgaggaatttagctcctggcaatgccctttcagtaattagtgcagtggaaatggcacttaacaaacagggatggtggctgcagtttttcaatgaacccatcctcatctgtgcctttttggtaaagagacctcgcgtatgagctgtaggacactctcggggtggttgagaagaggaagctttgacttctgcctgtgagacccatataaagctgagaagacatgttttgccttatctgataattaaaagcaataaaatttcaaatgaaaatacctaggttttcttgtgctaatggggagaagttttttttgtatcctacaagtaatcagtaaagaaacttttgtggatgaagtctttaaaaataacatgcaagtatctaaatccaagattaagcctaagatatgactggtggaatgatgttgtacatcagaaaagaagataatgaataaattaagtactatatgactacagtccacagaaatccagagagttagcaggagtggaaagaaaatcatgtgagaagtcttataaatcatattctaagagcagagaacaagtagatttattcagcagagatatatcctagataaattaataatcatatttggacaagataattttatgaaatagaggagcttgttttcattcctatatttgccccaggatctgtcccctgccctcatcccagagacagctgggtctttgtatacgcagaaagtagcagaaagttgtcttcgtaataaggtactcttatgggaaagcagaagtagcatctttaagtgtagcaactgttggagacaggatatatagtagttaagagcaaggactctaggccaggctactcttcacttatttgttgtgtgactgtgggcagttcacttaaccaatgcctcagtttcctcatgtgtgaaatgcaggtagtagctacctcatagccttgttgtaacaccaaaatgagttaatatatgtaagagcatttagaaggtgctgataaagaatatgtgctttgtgttagtgttcattattgcaattattaggaagcttaactttaaggaatctcttttgtcatatccaccttccatgataagtggccttaaaaataggcttgtacaagtccaggcatggtgggtcatgcctgtaatcccagctactccagaagctgaggggaggatcgcttgagcccaggagtttgaggctgccgtgacctgtgatcatgccactgcactccagctcgggtaacagagcaagacccagtctattaaaaaaaatttttttaatgagtttggacacatgggttgtgtacacactgtatggttccatgtatatgttcacatatgtgacattcttgaaatgacaaaattctggaaatgaagaagaaattagtttgtcccaggttgccagggatcagtggggaacagagggaagtggacatggctataaaagggcaataagaagaatccttgtggcgatgggaatgttgtatgtcttgatggtatccatatcagtatcttggttgtgatgttgtactagagttctgtgagatgttacccttggggaaaactggatgaagggggcatgggatctctctgtattatttcttgtaactacatgggaacctacagttacctcaaaataaaacatttaataataaaaagaaaatgggctcggaacattcctaatagagaaaaattggcagtgaaagccatgtgtatatctgaacagacagaccaatattaggtaaataaggcaaataaatatcacagaaggaaaactgagctgaccattgacattttagtgagatgttcatgggcccccaagaaaaaaattgagccccgtgggttcagagggagggagaagacagacaacagcttcatttccctgaaaactcatcaaactggcattctccaagggcctttgcttcccagactgtgaaatgttctatttagtggatggtttttggtaaagagaagaaggtagatgagtagcaacttacatacaaatgacattctttttttttttttggagacagaattttgctctcactgcccagtctggagtgcaatggtgcaatctcgggctcactgcaacttccacctcccaggttcaagcgattctcctgcctcagcctcccaagtagctgggattataggcatgcaccaccacgcccggttaactttgtatttttagtagagatagggtctccatgttggccaggctggtctcaaactcccaatctcaggtgatctgcccacctcggcctcccaaagtgccgggattacaggtgtgagccaccactcccggcctacaaatgacattcttaacggcaggcctatgagaaaagaatgtggggatgacaggtatgagctaaaaatcatctgtctacatgcctggaaatatagtaattaaatccaggagataccttgtctgacttttctctcatctacttcttaagcaccccatcccccagagtttatcacttttactttgtgtgttcataacactcccctcataccacttagtatggcgctagttgtttgtgtgtgtgtgtgtgtgtatatgtgtatgtgtatatctttccttctggattggggccaccttgaggggacagctcactactgtacttagttttgatttgttacttcaaagcccaatgtctgttgcacagtaggcacttatgaaataatgaatgagatattggctgttgtcatggccctggacagagtagacattaatcgagaagcctatataaattaaacagatcaaataaactgggaatattattgcactaaatgaaattgtggttatttttacaaatgaacattcctgggcttttctttatgttttttagtctggtgaattttttccttaggtttaaaataagaattttagagaattgagtaatgcagctatgaagagatgtcttacagcaactactaacagcagtgtggtgtcagtcaggaggtaaagggcaatcagaaaaagacaaggagaccattggaaaggagataattggaagaatgacttgtgtggcctgctgggttcaatttcagtcacagagaatgccatcagactaaaacaaatcatgattgaaagcactagtagcaagcttatctcttaatgtttgtgtaagcatctcctccttgccaagacacacatgagccatattctgatgtccagtatgtggaagaggtgaagtggaggcacctaaaggaacagcattcttctccccaactgcaaggtgcagtagaaactgggttgattacacagtaccttcccttcaccttctttacttacgccagtcctccagccatgccatgtgggcttgtcaggtgcctgctggaagttttacatttctggttctgaatgtgtaacacagaaagtatacaattaaatattcccttcctgccaggcacagtggctcacacctgtaatcccagcacttggggaggccgaggtgggcggattacctcaggccaggagtttgagaccagcctgggcaacatggcaaaactctgtctctactaaaaatacaaaaaattagccaggcgtggtagctcacacctgtagtcccagctactcgagaggctgaggcaggaagatcacttgagcccaggaggttaaggctgcagtgagccatgattgtgccactgcactctagcctgaatgaataaataaccacctgcttaaaagttacaggataccattgattgcttgattgattgatgaaggaaagaataaatccaggtggtggtacattccacaggaaaattaagaaggactgttaaaaaaaaaaaaagctcacgttatttgaatgaatgaacaaatagtttgagggacatactgttctaaattaaaagagatttagacataagagccaaatgtaacacatgaaacttgattggacatgcctttaagaacaatgagggtaatttcactatagactgaatattaaatattgtgtgacattggggcattcttaatattcttaggtatgatattttggtcatgtaaggaaatgcccttattattagatatctgtgtattccaggatgaagtattttgatgtatgtagcttattttcagatggttctgggagaaaaaaagtataaatatggaggggcgagtgtattaggattcttcagagggacagaaccaataggatatatatatttataaaaaggagtttattagggagaattggctcacatgattccaaggtgaagttccatgataagccttccgtaagctggggaatagagaagccaatagtggctcagtccaagtccaaaagcccccaaacaaaggaagctgacagtacacgctttagcctgcagccgagctcgagtccctgggaagccactggtgcacctccagagtctaaaggccgaagaatctggagtctgatgtccaagggcaggaggagcagaagcaagcatctggcgcagaaagaagaaagtggaccagaagaccagcaaacagacttatcccaccttcttcctcctgctgtgttctggccatcctggcatctgattggatggtgcctacccacattgagggtggatcttcctctcccattccaccaacttaaacgacagtttcctctggcagacacacccagacacatgcagaaacaatactttatcagccatctaggcatcccttagtccaatcaagttgatacttagtattaaccattatagtcgagttaaaggaatgtgataaaacattaattgttgaatctgaatggagtgtacacaggcgcttagtgtattattcattaaccttttctatatgtttgaaatttttaaatttattgaaatttttaaaataaaaagttgggtaaagactaaatgcatttttcctatggttggcaacaaaccaagggtgtcctctctcaacactcgtattcagcatcataccagaaggactagccagcacaggcaaacaaaaaaaaatggaaggcatacagattagaaagaagagttagagggaaaaccttgccctctaaaactgttggacttgctgccatgactttttttttttttttttttcttgagacagagtcttgctctgtcgccgaggctggagtgcaatggcgcgatcttggctcactgcaacctccacctcctgcgttcaagcgattctcttgcctcaacctcctgagtagccagaactacaggtgtgcgccactaccagctgatttttgtatttttagtagagacagagtttcaccatgttggttggccaggatggtctcaatcccttgacttcgtgatctgcccgcctcagcgtcccaaagtgctgggattacaggcgtgagtcactgcgcccagcctgccatgactttcatttaagattgttctatttgatggagagctgttcccccatggcccattagcttctcctgcttgatcttttgatgagttcatagtcacttgtttctggtatcatggtgtaccgccaaaatcagcttccaagttcctgtgcaccagaaatgggaagggaagatgggctgtgaggaagtgaaaaacctaatctcagtctttaaaacatacctttggggttttgggtactcatctcctgaagggcatatgataattttattatgactcctgacttctgtgtgttctgcggctctttaaactgtcttctagtcaaaaatgtctccgcagaagcagcttctgcgttgctatccggaggaccaaaatctgattggtagatgataagagttggccccaggaagatttctgatgccgtatgttttttgagcatactaaggacaaagacctcaaagctcaggtgcactcccaagatggtcagccttcctgatcagccattccagatttcccaatcttgtgttcccaggaggagagggagactaatgcttaggaattatactgcctggcagtttgtgaacaactgactttttaaatgtttatgatctaggacatggcatcctaggagtatttcaagctagattcgtctccatatcaaatgaagatgatggcattctccacaaaattttaataatcagcctcttgaaccttgttctctgtccacacaatggcttttcaacagatgtgttactccaaaattattttagggtcattgggaacattaagaaaggaagggaaaatttcagtcaaatgaggtgggaatttttttttaatgggtagcaaggtgttttctcaaagtctttcatggcacacagagtaaaatgtcaggagaagatgaatctaatcccagcatataccccgaaagcaaagcatgaggagaaacacagaaagtacctgtaaagcaggtttttttcaagtctcttttatcagtttttccagtgagagtgtggtatttttcgtggacaaaggttttaccagctaaaagctccttttaagtggtcgaaggagaaacagcagtgatgtgtgagggttcgttaattattgctcttactgatgtttgcacaggctgttgggatcataaatgtcaatctgtcaagagactgataggttctaaaaaaactgattgagtacctcaagagctgtcatagagcctgagattaaacagattcatctttcgtagaagtaagggacggtgtgggtgaagggaatagcagaaggctttcttctctttgttgccgcattgcttctcccactctcctattctgtattgtgagtgttggcttgtacggaggcctaaaagcctgtctgcctgagatgtcaggaagccacagccatggttagtgcacggggtgtgtgcaggctgccagctgcagggtgacaggagattaagagagattgagattcagctttgacaggcatgacacaatttatttggaaattttcaggcgggaacatgagtaataaagacaagaatgacagtaaggaacaaatgtgaatttctgccagagacaaaacagaattttaaaagaagtagctctgtttgttgtctccagttaagctttccagttaaactgtgttcttaaattgaaagtcttaacactactttctgagactggctaggaaagtacaattagaagaattcctctcttcagaagattccatgtctttaaaattactgtacaaccagcccaccatatccatgggttccacatctgtggattcaaccaaccatagactgaaaatatttgggaaaaaatggatgattgtgtcgtactgaacatgtagtttttttgtcattattccctaaataatacagtataacaactatttacatagtgtttatattgtattagggattataagtaatctagagaagattaaagtacagttgatgcttgaacaacatgggtttcaactgtgcaggtccactatgcacagatttccttctgcctctgccatcccagaaactgcaagaccagccccccactcctccttcgtctcctcctcagctagtcagcgtgaagacaacaacgatgaagacttcgatgatccactttcacttaaggaagagaaattgtgttttctcttccatatggttttcttaatttttttttcctgtagcttactttattgtaaaaatacagtatgtaatacataaaacatgcaaaatatgtgttaattgtctgtgtgttatcagtgagacttctggtcagcaggaggctattactagctaaattttgagggagtcagaagttatatgaaaattttcagctgtaacaggggtcagcgccccaaaccccatgttgttcaagggtcagctgtatacgggaggatgtatgtagcttatatgcaaatactttgccattttatataagggacttgagcatctatggaatttggtatccttggggggtcctggaaccaatctcccttggataccgagagacggactgtgcagtacttgtctctctgtcgaaaattaagcgcagttactttcaaaccaagaaagctaaataggcaaaatccttcttcttaagattttccttccttatttaatcacattatgattcttgatcagactttcctttgactagatctgatgtgatatctttctcattctattaaacattggcagagaaagcaggggtctggtgagtaccaagagttgtgaacgtggaatgggggagcggcagctctgtgtgggtatatctactacactagattatgttctcaagtaaaagcatactggaaaaaaagaatctgctttgttggccctttatgaaggaccttaattagaagtcactgttaactcctggggtgggaatggtttccagcttggcacgggagttcctcctgctactaatgagcatgctccttgcaaggactcgctgcttctgacagttaaagctgcattgtaagagttatttcttgtcacctctctctccacatttaactgttactgcccaagttcagagtatgtaagtagactgttaggtgttttcaggaaattggcaatgcttcacggtaacagggaatgatatttgtgagtaaaagtaaatcattacaggttaatttattcaaatatgggtagtagatggttgctttaatgtcaaccatgtttggatttttttttcctggtagtctttttctaattgacataaaacttacaaatgaatagttgaattatttaattcattatcatgtcgttagaacccctgccctggacatctgtttctcttatttaagcaactcgccctgtggcacaaaggtttcattaactaattagcagaggaaatgtaaatttcttatgcaagtgaggatgattctatagattactatttatttcattagcttctcattaaaacactaagttgacttgtgagaaaatgccggagaatggtttgcttctcgaagaaattacacatacacagtcaccttcttgggcaatagcttgtggaggatagtgagcagttttggaagcttatttaccctcgctcttggtggcagggagcattagagagcatctaacagatcttcatctagggaagggtaagtgggcatattccagagcttcaaaggtgtggatctcttgctatctggaatagttctttgattctaaaacataacacattctgttagacatttcttctgccttgctttagaatcatctagcattgcttcctggggcccagacttcctgtacatggatgcctttggtcatagacttgtacggatgctgggacattgattgtcagaggatcgagtagggcttaatggtgttcttttaggatgatcagtatatcataccagaagctgtggcagcatcagaaacctcctttaggattcattgttcaagaatattccatgcctactgcctaccagaacaaataactcagtggtctttatattaatgtggaatagatcaaggaaaatctcagcatgggatcatgtagacattccttagtgttgctattgaatgcccattggtcaggtaagatggggaattaagagaaaaagaggtcaagactgcacaggcctcctaactttgcagggcaggggttggggggtcccatcaaagtgggttgtttggtgatgactaatgattgtgattatgtaaatatgaattctatttctcagccataggactcatacatttaaaaaatttttcttcacatatctaactcccttacttatttggacatagttaccttatggataatattgccacactgaaattctttttgtctttattttttcccccggcttcattgacacagtgaaattaaattgtcttctccttgcaggaaaggtttgttttagaaatgggtgctttgcagatgaacagcatgtttgacggtttgggatagattcatgtagaaagagctctaaatgtgaactctgcattttcagacacagaggtgtgaaagaaaggggctcagggtctgagcagttctgtgttagagtagaggtgtgctggcattgtgccaaggccctccagattttaatcatagtaataatgaaaaggcctcagctgcctccccatcttgtgctgacacctgcctcccagtgggagtaatttcctataaggatgctttgaatttaggactttgtctcagaaaaaaacattttttgttacagtttttaccctagaattttcttgttacaaaaaaaaaattctaaatagggttattgatacaaatagagccattgctggtttgtgtaaaaggaccccgcccgcagagagcagtgtggctcatacaaggtgaatttctttcagctgactgctttgtaatgatttatatttaaattgttgcttgttgctcttgtagaagaagggagagcgcctgccctatctgtagccaccttactcaccacactgactgggcctggacagctttgctcagcagagctgggaaataggctgaacttgccttcaattgttttcatcagagtccttatttagttggtttgtattggggcaaaatgtcatgtaggactggaagaattaaatgagatgaaaaatgaagtctgtagttgctaagaatggtgcagggcctccatatgccagtacagcacagcagggctgggggactatgagcaaactaccagcatcaccatcggggtccactggacaatcttgggtgaagtgcagcatcttcctcacacacagggaggctaggaaagggcatacagacagccttcactaaaatacatcctataggctgtggcttctcactagagccactttaagtagaacattaggactgcctaggagacaaattcattcattcaaaaaatatttattgagccataggcatggagggaacatcagtaaacaaagcaggtgaaatttcctgccctcttggagtttgctttcttttagggcataatgttaaagataagtgctgtggaggaataaaagggaaacagacgaggggaagtgctaagaatagggattcagtgatctagaagtgatgatcagggaagaagccttcaatgaaaatgtgactttgcaaaataaaatttaaaagaaaatgtgacgttggagcaaagatatcaaagggaatgatgcagggcctccatatgccagtacagtgcagcagggctgggggactgtgagcaaactaccatcatcaccatcaggggcctgggtgataaaagagataagatcccatgtagatctgggtgaagagtgtttcagacagagggaatagaaggtacaaagtaccacaggtaggagacaataaggaggctagtgtagagataagcaaaggaaggaaagcagcaggagctgagcgtggggcaagtcatgcagggtatttgagagtctaagtatctggactttcactctgacaaggggagctattagagggttttgagcagggaagtaacatgatctaacttgatttttaacagagtcacttgtctgctatgtggagaatagactgtagaaacaaggggatgagcagagagaccagtgaagaggctcttgtagtaggcttgatgagttggtaatggcttagaccaaggtgggggtgacagaggggtaagaggtgtggcatctggattattttgaggaagactgtttaggagactcccttctggaagtaatttagcacaaacaatttggaacttggtaagaggtacatcgtgggtatgcaagcagctgtttcaggaatacagagccccaaagagctgcccagtttattgaaggcaagagtcgtttacagccttgcctgtgataagagctttgttgcgtcttaattacttttttgaagttgtgcaagacacagttttcacagagtacacccccctccacctaccattttggctccacctcaaggtggggtgcctggtgctgctgctgctgcaccaccccatggtggagttcatagggcagcttgcatgtgtaccagcagaggtgccccttcattctgaatcaaattgaactaattgtcagtattagaacctgacttctgtgtctttaagagtagaaacgtgagtaattttactataaaagattacagatcactcatcaaacgctggctttgggaatggaattgtgaaagcatagtgatacagagatacattagacatagtcccatctctaaagaattacggtctacttgaggacaagcaaatgcccaagaaaagatatctaaccaatacaggcagtaagcatctaggtcccagcaagggaatacaaagacaggaccccatttctagctggaatggtctcctcatagaatctcagctctttttaaaaacaacaacatagaactggtttttgttgagccacccacaccctcctctccagctcaggcctagcttgttagaagtcagcactaaaggtacacgtttgtcatagtttgtgcagtataaaccaagcaagtcagaactggctctcacctgtctgattcctggacaagggcagtagcctggtcaggagaatgcctggaaatacattaatcaactgtgcttgccaggccaggcactaatcctgatccccaaatatgttgttttggtcagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggtaagcatctcccccagtggcgtgatggagactatatccttaacaccttggcccagctttggaaatttaagtggctgaagtctttcgttcttcttctgagtactgtaagtttgctacagtagtgcatgcgatataggtttggggcttgagaaatcaggagcatagtatgtttgcctctaaacaccctttattctcacacatgcaaaaaagacaaaaacatccccatgttcttaatgcatatctccttagagctacatctcactgcttagtgctttcaacttccccccaccacttactactctggtttcttctcacgacttcagaagtttaccaaacaagcaaaattctggagtatgtaccataaaattcagatattaagttaattttgaatgagcttcttactatttatgataaatggaagatttttttttctccatatccctgttaaattaagctttgattagaaaattacctttgaaccttagttcatctagtcagttaataccttgaaatagccttttttttttttttttttttttcctgggctgaatccatcctcctgcctctgcctcacaaagtgctgggattacaggcatgagccaccatatacccagtctgaaatagctttacagtcacctttccttctgtattctgtagtgtaataccttttagaattgctgcacagggatgcctacccacagtggaatgaaacttaagtcaaccctttctctcttcttgaccacatgtatcatgacacataggaacgaaattgtgtagcagcattattttaggctgatttacagtttcctgtacttgtttttatttcctggttttaaaacctaatattataaaattgtttgaggaccagttcagctgtcatcaggttgactttgagacctgtctgtagcctctgagaatcctatttctttctttctgagaagtcagctttagaagccccctttcacttctgggacagccgaagatatcctacaagtactattgctgacagtcaggactaaatagttcactcagcagttataaagtaatggtcactggaagtttactatcttctgaagcggcagcctttgctgctacggttcctcaattatctgccctattggaaatgggaaggaagagagaggttattagcttttcatagaaactacgttggaactcctattcctgttttgaccagatacctgtttgttacacattctggtgtatgcggtactccacgagattagaagtgcatattcaactgcagaaaccggaaccagcatggggagtctaaatgttaccagataaggtttttagggcattttggttatagtgctaagcatttttgggaaaccgtaaagagggttaggataggtggtgggaatagaggctgacagcagttttcagatgtccgtgtgttcatgcacgcagtatggcccaggtaagttcaaaaccttattcttaggctatttcgatcaaccctgccaggcaattttaaattcttggtgatgtagggcagggacactgtggatggctgaggaaactctgggctctgctggctaaccagcttcgctccactctgcagaggctgtctcatcttttgtgatctgcaaattcttgctttggtcttcatgtgaactctcagggaatttgagcagttcagtctgttaccagtgttgtgagcctacctggtcattttagctgttgcttttgtaacgtaggcttttggttgttcctcagttagaattgtgggactttcctgaaccttctgttcttgtttcttccttgaaagtaactgaatcctgggtattacacaggatttgccatagcggatcaagcaattggtctatcaagtatgctgtcttgtccccggcagtggctaatgcttcttcttcttgtcaggcaaacaggagatttcacaatttagcactgagatctaaagatgtaaccaggtctcctagtttacccttcagctttgacgcagactacctaatttcctaaggtcttagcatccacctgaaaaaaaagaaaaaaaaaaaaacagtaatatatgttagatgacttcacattcactcaagtaaagccaacttgtctaatctctggtaaatatagattactctgccatgctcttaacctttgtgggcaggaggctggattgctaaatgcatattgggtttgcttcagtatgcatcctttttaaatgttctaacatgtagtctcttggcttgtgcccaattccgaaagtctgcttttagggagatttgactttttctgttggagaagaaagccctgagctttctgcagtctcaacaggatgtaactttcctagagtcagctgggcattcagtttgacccactgagagcattacacttatgtgcccagaaaaatgactgagtcgactgtcacccttcaaaagatgaaggacaacaatgggaacatgccataaaaaagtctgggactgtttttgacaaagagctcttgtgttcctcctgcctgcttggatctctctaggaaagggtgagttgtactgttatttccttgaggatgcatggatgttggagagatgtttaactgccctgaaaggttttagaggggggataacacagtaatttactactgaaagtgaagactcaggaaggtagtttgagctcaaacagaacacttcttccctgcagaaaatctttttttaaatatatattcgcaatcttttcttccatttgccttccattctgtacaggttattaactgctgacaagaaattcacatctcataaataatgcttaagagccattgctatataaattgaatgtgttatgaattgtgatgggcctttttgtagcattcgatgcctagagcaggaagaacagaggatgtcattttcattaatttctaatgaggtgccaattaaaggcagggaagacgctccaaagggaagagtggccaagctcccctgaatcctccgccccagggctgtcgtccaaacactgccagtgaggccttctctaaaaattccattaaattacagtctcatcgagagcacacacagacacattcagcttccctttgatcttcaaaagagcaatttgtaaggcgagttctgagccttcttacatagggaacagctagaggtgataggaattgttaattgccaagacacttcatgggctttcagtaaggaggaattttgaatacgaattctcctctgcctccctgtgactagataacctttaaatcaacaataccaaagtaacacccttttcctgtgaaatctttcagggtgccaattagaaaaggcatgtggttgcgaggctgggattatatcctgcatcttagagcatcttcaatagtttaacttctcaagatagaaaacagttgcctgaaaatggatctatttgtttcattttctactcagtaagcaaattgatcagctcattgtcattgcaggagtcttgtctcctgaattgacacctagaggatgttcttctgcaatctggccatcttcatcaaatctgggccacgtcacagccacaagaatgccgtcttctctgagcagatcttgattgatacacgtagcttggcttccttttttttttttttttttttttttttttttgtggagacggagtcgcccaggctggagtgcagtggcacgatctcagctcactgcaacctctgcctcccaggttcaagcaattctcctgcctcagcctccctagtagctgggactacaggtgcacacctccacgcctggctaattttttgtattttagtacagacagggattcatcatgttgcccaggctggtcttgaactcctgagctcaggcagtccacctgcctcggcctcccaaagtgttaggattacaggcatgatccaccacgcccggccttcttggcttcttaatcactgtgcaatgcttgctagaactgcagaactaatttttaaataccagttgaagagtgtaagttttaacatattttcaattgatggtgcattaacaaacttaagtggatatgctccctttgggaacagtagtgcttttattaacctcctgagtaatctgacatcctttattgttttcaaaataagttttctcttcactttagaaacctgaagtgatgtgttagctggggcctctggagtagttgatcatctccaagtgcctcagtggtcattgctgccttatcattcactgtcaaaccaaattcatcaagcatttactgaaatctgaatatgcagaaagcattttcttaggttttatggggaatataggagctagaaatacagaatctaagagcttacagtctaaatctgtggcttcaagcttgagtaggggcctggtgtggtggctcatgcctgtaatcccaacactttaggaggccaaggtgggggaatcccttgaggccaggagttcaaaaccagcttgttgcccgtctctattttttgtagagataggcaacatagtaagaccctgtctctatgaaaaattattgccaggcaagatggtgcaaccctgtggtcccagctacttgggaggccaaggtgggaggatggctttcagcccaggagttcgaggctacagtgagtcttggtcacaccactgcactgcagcatgggcaacagagaaagaccatgtctcttaaaaactaaaaaacaaacaacaaaaaacaagaaccaaaacttgagggagcatcacaatttacctggagggcatgttaaaaacagattgttgggacccacacccagaggttctgatttggtagaacaagttcccatggaatgttttcacagcctttctgtttttttatgatattgacatttttaaagaatacaaccctctatccctcccctcacctattttttagtagaacactctttatttggggttttaatagaacactccttattctgatatttcttcataattagattcaggctacgaattctcacccagactactacataaataatcacgcatccttctcagggttttatgggaggcacagatgtccatcagccctcattgttgatgttaattttgatatacccacctagtcagggcattccctggtttctccactatgtagttactatttttccccttgcacctataaaccaatctgtgggaaaacactttaagaccaagtaaatgctctgctcctcgtgaaaaattttccctagattcatcatccattgatgattcttgcctaagccagtctctgctaggagggttgcaaaatgatgatttactaactctagcactccctcagcatttactatttggcactcagcattcttctataagtgaagccacctcctctcccccatttatttatctgttactggcatggactcatgggctcttatcttttttaatggtttatgatttgttatggtacagttgtcccctggtatctgcggggaatcggctccagagcctcccatggataccaaattcaaggatgcctaagtccctgatataaaatggtgtagcattgcacataacctacgtacatcctctcatatactttgtcatctctagattacctagaatacctaatacaatgtaaatgctatgtaaattgttacatgctgtgttgtttagggaataatgacaaaaagaaaaaacctgtgtcagtgcagacacaaccatcataggcctaactacatttttgatctgtggtcgttgagtgcggaacccatggatatggacaaccgactgaacttaattattttggtgctcaaattgtcctggatttagccagtggaagttattttctgctggctcctgtgctcttgtggcatacttcccatctttcttcagtggtggggggaggatttgggagcattcccttattctttggcgtaacagcatgtgtccctaaatttccccaatcctggaatcagccacttctccaaggacccccaaagtgattttaatatgcactcaagtaggtatttgctgggcccaagaggaaggcagacatacataaaataactggaacagcctaccataagcatttatcaaggtataggtataaggtataagcctatgttatagtgatatggagagggagagattaattgcaactcaagattctggacaggctttcacaattggggctttaaaggaagattgggactcagatatgggaaatgaggggatgcttgggcaaagctggtatttaggagatgaactctgttcagctggatgaagtcttggagtcaaatgaggacagactgttagaaagggaggaaaaggattccagattccaggctgaggagtttggatgttcgtttatagtgagaagccatcaatagttttgaatacagtcaacatgatctaatctgacttttagaaacatgaaacatgttggaaagccatggaggttgttgaatcttttcaagggaatgatctagagagaatgtgaactgattgagtcaaaaggaatatgcatgtgtcacaactgttgctgccattgcagggggctacacaatgaacaaacagtgatatccgtaaggtctagagtggggcaaggagctgcagtgattaggacacatgttggggacatgcattaccaggctgatccatttcaccagcatcagaaatcagcccacgtgtctgtgccttaattttaattcttattcaagtgtaaacctgtcaggaacatttggcattctgtcttatgtctgtaaaggaaagtgaggcagtatgttcttataaaaagccttattctgttcacagtgttctagcctagatccaccagaaaaccctgttatgcagagaaacacctgagatcttttattatgaccaaaactgatttgactggtgaaatgttatcattattgccattgtgtggagagtccatgctctactatgagttatagggagagagtgtatccatctgggtcaccaaaatgtgtccggaattggtgggttcttggtctcactgacttcaagaatgaagctgcggacccttgcggtgagtgttacggttcttaaaggtgatgtgtccggagtttgttccttctgatgttcggagtttcttccttctggtgggttcttggtctcgctggcttcaggagtgaagctgcagaccttcgcggtgagtgttacaggttataaaggcagtgcagacccaaagagtgagcagcagcaagatttattgcaaagagcgaaagaacaaagcttccacagtgtggaaggggacgcgagtaggttgccactactgacacaggcagcctgcttttattctcttatctggcccccacccacatcctgctgatgggtccattttacagagcgccagttgttttgacaggctgctgattggtgcgtttacaatccctgagctagacacaaaagctctccacatccccactagattagctagatacagagtgctgattggtgtatttacaaaccttgaactagacacagagtgctgactggtgtatttgcaatcccttagctagacataaaggttctccaagtccccactagactcaggagcccagctggcttcacccagtggataccgcactggagccgcaggtggagctgcctgccagtcccgcgccatgcgcccgcaatcctcagcccttgggcagttgatgggaccgggcgccatggagcagggggcggcgctcctaggggaggctcggggctgcgcaggagcccacagcggggggccaggcggggaggctcaggcatggcgggctgcaggtcctgagccctgccctgccgggaggcagctaaagcccggtgagaaatcgagcgcagtgccggtgggccgcactgctgggggatctggtgcaccctctgcagctactggcctgggtgctaagcccctcactgccccgggccgctccgagtgtggggcccgccaagcccatgcccatctggaactctagctggcccataagcgccgcgcgcagcccaggttcctgcccgcacctttccctccacacctccctgcaagctgagggagctggctctggcctcaaccagcccagagaggggcccccacagcgcagtggcgggctgaagggctccctgagcatggccagagcggacgctgaggccgaggaggcgccaagagtgagcgagggctgcgagggctgccagcacgctgtcacctctcaagagcatggttaagcaaaagaccccggcctttaggaactcctgtttatatgctgagtctgggtgatgaaagactaaagcttctccagtactcctaagacagcaacaattgggatgtatgttacctgtgactcaagagaagaaagtgtcccatccatccccccaaaaggaaaaaaagttccacaaccttttgatgggagttattatatatgtgagagctaagggtaactagaaatcttgaggcaaattctgagaaaattttcttcctttgctatactcctcccttcactctcactgtactttttacctaaacataagtatgctatctgtattccccatttaatctttgatgtgtaagtgttccagtctaaaaccagatagattagtccctctgctgctcctctgtaaattgcaacttgagatgttagagcaaaacaaatgaaaccttttactgaacacgaactccatgtatttagcccattagtgcaggactgtcccagagacccagcctaccctatgttctttgacagggctgtagagagatgtcagaaacatgaagagctccctctccctaagcaaaggagtatcaaagactgagctcttcttacaagaccgaatgtgcagggcacatccgctgcagcctgtgtcacatccccacccatcccatactgacaggtatggcagaagacccttatcccatggcatgagataaatttccatctttttagcatacttgcagctacttgtatagtctaatattagtggcagtaacagcacaataatagtgttaccaaaaggtatttggataggttatcctgcttagaatacctttttttatggggagaaaaattattataaaaggaagtgaattattagtgtcttttattttagttccagtagtaaatagttttagttaattctttgtttaataaagtttttaaaacagctttttgagaaataatttacgtaccataaaatttgcccattttatggttgaatgagttttattacttttttatttctttaatcttgtttcagaccctgattttttagttcttattacattattcatttctttttaaaatctttattcagaagttgaatgagttttagtagatttgtgtaagttgtacagccatcaccaaattcagttgtacaatacttccatcatcccaaaaagttccctcatgccccttttcagtcgatccatattctctcccaccctagccccagccaaccacttaaagtctgctttctgttgctatagtttcaccttttctacaattttaatatcagtggattcatacctacatagtatgttgtttttgaaattcatccatattatatatcagtagttcattcctctttaatgctgagtattatttcattgtatggatataccacatgtgtttatccatttgccagtcgacatacacttgggttattgccagtttggggccattatgaatagagctgcatttatgcagaagtcttgtgtggacatgtgttttaatttctcttgggtatatacataggcatggagttgccaggttaaatggtaagtgtgtccttaacattgtaagaaacttccaagatcttttccaagcttatatcattttatattcccattagcaatgcattagggttccagtttcttcctgttctcgccaacatttaatattgtcagtctttttaactttaggtattctagtggctgtgtagtagtatctcattatggtatattaatttgtatttccctaatgaccaatgatgttgaacatattttttatatgttctttggtcactcatatatcttcttttatgaagagtctgttcacactttaaaattttaaccatgtttacaaaaagattcacaaaattgccatcttaatattgtaactcatcaatatgatatgtctctctatttaggtgtttctcagccacattttatattttcaatgcatagcttgttaaatttattcctaaatattttagtttgtgatgatattgtgagtggaatttaaaagttttatttttagattgtttttttttttgctaccacttagaaatatatcattttatatcactttttgaatactgcagctttgctaaatttaacttgttagctctcgattccttaggattttctacatccatgatcatgtcatctgcaaatacagttttactcctttccaatctatatgccttttatttctttttcttgccttattgcacctccagcataatgttgaatagaagtggagtcatccttgccttttccttgatcttaggtagaaaacattgcatttcatcactaagtatgattcagctatagatttttcatagctgccccccacaggttgtagttgattaatacattctaggaaaacatgggaaatgttcaaatatgttcaccaaaaacagatgattatttaacccatggtaggctaccacgtagcctgtaactggtcaacaaagctgtgttctaaagagttttgccatcccatagactcatttctgtttgcagatgaagcatattccctgtgttgatagtcatatgtcacgcgtgtgtctagctagagtggtgaaagcctgcaacctgagcttagccctcttatttttaaaccagtatcataagagacacccagatagctgtcctgggctatactcacttgaggtgatgaaagcaagccacagtgagagatgtttagaaatgctttgtttgaattaaaggcatgaaaatttgtgtgtagataatagaatcacgtaccaccagaattagaaggagccttagtaatcatttagtctcatctcttttttttttttttaaataaatgagaaaaccaagatcgaaaaggtagtccctcacctcagatcacacctgtgtgctaaatagtggtattccatgtagcccctgaactaaacttcaaggcctgctgaagagtttctgtccagggacccctcatggcagtgcctgctcctcccttccttcagcttaggtttcagccacactcactgtacctccctgtcacttcttcctgccctgtagtctctattgaacccagactatctcttctgaagtacccacatttcttggtctttcttccaaattcaccagactctcttaacttcttcttgttagttcagcctctaaaaccttgcccaggacttgggaccctgtgtggagcctttgcagcagaaccaccaaataaggccagttatggcaaacacacgcacacgcatagtagttagtatttagtcaaaataatcggatttttaaaaatgttttctttcagatcaataataaattacaaagttttactaaagttatgtcctttccaaagcctttaatgtgtagttaaaactaatttatgttaagcacattgtatgcaaatacctgctactaggtactcttagtcaccctaatagattcttcctgtgattcccctcttttaaaatttttatttccataggctattggggaacagatgttgtttgtttacatgattaaattctttagtggtaatttgtgagattctggtgcacccatcacccaagaagtatacactgcatcttatttgtagtgttttatccctcacccccttcccaccctttccccctgagtctccaaagtcgttgtgtcattcctatccctttgcatcctcatagcttagctccctcttaggagtgagaacatacaatgtttgtttttccattcctgagttacttcacttagaataatagtctccagtgtcatccaggttgctgcaaatgccattaattcattccatttatggctgagtattactccatcatgtatatatgtatatatatacaccacagtttctttatgcactcattgattgatgggcatttgggttggttctacgtttttgcaattgcaaattgtgctaccataaacatccatgtgcaagtatcttttttgtataatgacttcttttcctctgggtagatacccagtagtgggattgccggatcaatggtagttttacttttagttttttaaggaacctccacactgttttccatagtagttgtaccaccagcagtgtaaaagtattccctgtttactgcatgcacagcaacatctattatgttttgattttttgattatgatcattcttgcaggagtaaggtagtattgcattgtggttttgatttgcccttccctaatcattaatgatgttgagcattttttcatatgtttgtttgccatttgtatatcttcttttgagaattttctattcatgttcttagcccactttttgatgggatttttttcttgttgatttgtttgagttcattgtagattctggatattagtcctttgtcagatgtatagattgtaaagattttctcccactctgtgggttgtctgtttactatggtgactgttccttttgctgtgcaaaagctctttagtttaattaagtcccagcagtttatttttggttttattgcatttgcttttgggttattggtcatgaaatccttgcctaagccaatgtctagaagggtttttccaatgttatcttttagaatttttagttttaggtcttagatttaagtctttaacccatcttgagttgatttttgtataaggtgagagatggggatccagtttcattctcctacatgtggctagccaattatcctagcaccgtttgttgaaaagggtgtcctttcaccactttatgtttttgttttgtcagaggtcagttgactctaagtattcgggtttatttgtaggttctctgttgttttccgttcgtctgtgtgccttttgttatgccattactatgccgttttggtgactacggccttatagtttagtttgaagtcagataatgtgatgcctccagatttgttctttttatttagacttgctttggatatgtgggcttttttttttttccatgtgaattttaggattgttttttctagttctgtgaagaatgttggtggtactttgatgagaattgcactgaatttgtagattgcttttggcagtatggtcattttcacaatattgattctacccatccatgagcatgggatgtgtttccatttgtttatgttgtctatgatttctttccgcaatgtttgtagttttccttgtagaggtctttcatctccttggttaggtatattcctaagttttcattttgatggttttttttgtttgttttgtttttgcacctattgtaaaaggggttgagttctttatttgagagctactgatttgtgtacattaattttgtatccagaaacttgccgatttatttaatcagttctaggagctttctagaggagtctttagagttttctaggtgaacgatcatatcatccatcagcaaacagtgagtttgacttcctccttaatgatttggatgccctttatttctttctcttgtctgattgctctggctaggacttccagtactatgttgaagaggagtggtgacagtgggcatccttgtctagttccagttctcagagggaatgctttcaacttttccccattcagtattttgttggctgcaggcttgtcatagatggcttttattatattgaggtatattccttgtatgctgattttggtaagagttttaatcataaagtgatgctggattttgttgaatgctttttctgcatctactgagatgatcatgtgatttttgttttcaattatgtttgtgtggtatatcccatttattgacttgagtatgttaaaccatccctgcatccttggtatgaaacccatttgatcatggtggattatctttttgatatgttgttggatttggttagctagtattttgttaaggattttagcatatatgttcatcagggatattggtctgtagttttcttttttggttatgttctttcctggttttggtattagggtgatactggcttcatagaatgatttggggagggtttcctctttatcttgtggaatagtgtcaataggattagtaccaactcttctttgaatgtctggtagaattctgctgtgaatccgtctggtcttggactttttttgttgatatatttttaattagcatttcagtcttactgcttgttattggtctgttcagggtatctaattcttcctgatgtaagctaggagggttgtatctttccaggaatttatccatctcgtctaggtttttctagtttatgtgcataatggtgttcatagtagccttgattgatcctctgtatttctgtgttgtcagttgtaatctcttccgtttcatttcttatttagcttatttggattttctctcttcttagttaatcttgttaatggcctatgaattttatttatcttttcaaaaaaaacagctttttgtttcatttatcttttgtgatttttttgtttcatttagttttactctgatattggttcttttcttcttctgggtttgtgattcccctcttaaggagtacttctaagaagtgtgggcctcagcccagcgctttagagtccttctttagaaggtaaaaacgcagttctttaagtaattttaatgtacccccaagttagaccatactgcctgtacattttatagactcatttgttcataggaaacaccaagataatttagaaacaaagagaattactggaaattgcaaatgagtagtacccacatcaatgaggtttcatattggttccagtcacttccattctctctcacttagagatttataccttttgggtgtgtaacacataccttcctcccactgttgtccccttccttgccagactcaaaaaatctcagcaggcaggagtacatgatgctctgtaacttcccacagcccctattggagtatgtggcctgtagtggctgcccagtcagtggtgactaataatgtacaagaaaaaatggaaagtccaagaaatgtggtgtcctcatgagcctgctgcttatgattaggggaaagcccttttggaacagtgtttgaaagcaggcccaaccacagctgagtgggaatatttctgggccagtagccatgtaaattcttgaggtccagggtacatgtgcagcctcaggatttcccagtggattatttggctgaacgaaaaagatccagatagagtgtttcccccccaccaatttttattggtagaggaagaaaataattcagactagacatatatgctgtcagatagggtagtgtccttgcttgcttgaattaaaattatttggtatgcttatgagtttaattaaataactcaactttggggaagggtgtacttgcacaaataaaacctgtgtttgtattagtacttggacatgaataagatgggttctgtgggctgggtgcggtggctcacacctgtaatcccaacactttgagagccaaggtgggaggatcgcttgaagccaggagttcaagaccagcctggacaatgtagcaaaaacccgtctctacaaaaaaataaaataagcctagtgtggtggcatatgccatagtcctaactactcagaggctgagggagaggaattgcttgagcctaggaatttgaggctgcattgagctgtgatcatgtccctgcactccagccagggtaacagagtgagaccctgtctcatagaaaacaaaatacatgggttcttcggaggtcacagacctactgtgtgtaaccgcactagtctctgattcctgcctaacaaacttgcgattccttgacatataatccaagtaattaaggtatcttagaagccatccatctggtgccagtccagacccctaaactgacgctgcataaaccccatcagcagtttcctggcaggtagtcccactgtgtacatctgcatggagggagtgtggcatctcctgcatggaggatgtatggcatctcctgttgctgggcaacttagattgactaggtgcttcctctacccagcttaaactggcctccctctagaacacatactcattccccctcactctgccctccggagcagtctgtcacaaatcctcttcttcaagcctgttcacagatttgagcactgtgatgtaagctttccagcagcccagctcccgcagtaacaaattcattctcagagaccacagaactgatattggagcatgaaggacagggtcagaaacaggactggactcagtgtttgtctccacagtttttctcagtgaggccctcacaaaacctggtgtcttttttaacaaaacccttcatctggtgatctcccctgagacagctcaacagtcttctcttctgtggagtccatggttggcctctgtttatgatatatgtctcagagcatattgaaattgtctgtttacatgtctgtcctttctccagaccatgagcacttaacgatattcttctgcagttctcggctcttactgcagtgcctggcgtgcggtgacacattaatagacacttgaatacactgtgagatccctgcgtcttgcagttgtgatcatctgggtgaaggaaaaagaggaatagctttattgaacagctagtatatcctgggtacctgtacttgagttatatcatttgactcttaagagcattgttggacaaggccgggcgcggtggctcacgcttgtaatcccagcactttgggaggccgaggcgggcggatcatgaggtcaagagatcaagaccgtcctggctaacatggtgaaaccctgtctctactaaaaatacaaaaaaattagccgggcgtggtggcgggcgcctgtagtcccagctactcgggaggctgaggcaggagaatggcgtgaacccgggaggcagagcttgcagtgagccgagatcacgccactgcactccagcctgggtgacagagcaagactctgtctcaaaaaaaaaaaaagagcatcattggacaaatggtacctccttttttataaagttgaaactgaaactttgaagcttagaaatatgaaggtagcacctgggatttgagcccaggtctgttgagctcccagaaccccaccactttttcatatccccaagctggcccatggggtccccaaaacagtgaggagaggactacagcagtaactgtccatattttcaaccatacagaatttagtccattccttaaccacttccccgtttcagagatgctttttattgaatggtaaaaatgtatgtacctgactgtgagaaccacttaagatggggtaatgagtcatccagtgcactgtgttttgttgtgtcccgaatgccacatctagataagatgcttctggaaaaccgggtccacagcatggtcaccttttggtctcccgctgtacctgggtaatatgagacacagtggcatttaattctgttgacatgcacattccgttctcctgagtgctaattcatatcctcatattccttgaaaagttacctcctccaagatcccttattgcagttgacttccccttggtgctcccgatttattacacatcggtgaattatattgattttatttgcagttgatttcttgctttgctctttgtgaccttcagctatttttctctgcatgtgtctccagctatcttaaaaggcaggaactagtgacttcttttttttccttctcctccactcagcccctagaatagagctctgtaaacagtgcacaggtgaccaataaatacttttgactccttgagcttgatagcttctttcccttgctggactgacagcctaacactggagcctgaatcctttatttattagatgagatttctatagcacctttactctgagaagatcagtatcaatgaagtttgtttctgcttctggaaagtgctttttacctaagcagaccaaagtcctgataagaccacatgacagcccttactcctcagctgctggggcctggagacgcagactaagaaaagcctcaccacttcacattttgctgtcttgttgccagccacgagcctgaataagattctgtgccagcataaactctaatgttggtggatactgtagtcagtgttacaaaaagagcatttgcatttggagagcattgccatcttttggaagggagacatggagaagactgccttagaggtcagtatatctgccaataaccagatccctgtgaatggagctttcatgggttgttggctttcacctagtgcctgatgtcagggggcactagaactgttcagtctctcgaagtcgtgttgcttagtgagctaaggttactgggacaggacccatgaggggcgtgacaggtgatacattcccagagactcaaaaggaacaagccctggataagttgggaataagcgctgagaggtgacactcttaactgttgggaaaaggggctagcacacttcagatctggatagttgagactgaccatgaaatactacagcaaagttcagaggcaaaaaaactgaaaaaggtggatgtgttagccctatagttcattggagaagtgcctaaaataattggattaactggcttctctaagaaatttctcacctttctacatctccgtgttttgtgcaggcatccccatccataattcagggttagacagagctcagttaagaaatgaacacgtgaggccggccgtggtggctcacgcctgtaatcccagcactttgggaggccaaggcgggtggatcacctgaggtcaggagttcgagacaaacctgaccaatatggtgaaaccctgtctctactaaaaatacaaaaattagccaggtgtggtggcgtgcgcctgtaatcccagctactcaggaggctgaggcaggagaatcgctggaatctgggagttggaggttgcagtgagccgagatcgcgccactgcattccagcctgggcaacagagcaagactccatctcaattaaaaaaaaaacaaacaaaaaaaacacgtttccggtgagctgtgtagacagatgagaggtacacacgtaagagctgcttggtgtggacacttactagcatcaccaagtttggcctgcccttgagcctgcagtccagaaggctcccttctctgtggagcaggtattaaggcagtcatagctgtggatttccttttccttttccttttttgagaaacaaaaatggtcacaagtaaaaagaaatccatgtgttggagagaaaagagacacagtagagaaggactagaaatgtctggaaatggaggcggggcaaaaatggaggtgtgatggtgggtgtgggaagtccactggcattgacctgagagaggtgtttggacacagctgccagtgcctgaggatgccaccgcttatttcctcctgagatgtgaaggatgttccctttctctgttgttgcctgtggaaatgagaggcagagccacctgtactgtctagtgtattgctataccccagtacagtgcctgtgacacagtccaaggaagattacagggaatgtcccatgtagctttggatacttccttgttcgtgatcacaggccacaccaactggtgcacatgctaaaatgtacagtgcctgggtgggtgaccggaagacagatgactctggcccgtggggagtactgcctgactgctgtcttccatagaagacagatctttgcatgatccaaggcaggcctgcttcatttactctgatggctcctccagaaaagtactttgggacggcaagggagctagggatgagtgtgttccatgccgatactagatttctttgttagtattaaatacttgcttttgctctaggccacagggtgggaggtggcaggcagtggctaccacaggtgaagatgggtcctgtgggtccaggagacaggctggcagccacctgtctgtgccttgaggactgtaagggtcatcaggacacgtgctgtgcacagcaggccactgttctccacacacccagtgctgttctttcttggaccatggcagctgtgagtcagcgcaccgtgtagtttgtgcatccttgtgatgaatgcacaggatgacatttgtttccctgagctctgcaccatatgttctagattcacccaggaagtgggggttccagatttacaaactaaagggctaggtttatgttaatactcttgcatcaattaaattgctcttccctcaaatccaggattaattttccatggaatctggagtaactgaccaaaataccagggtggaataggaaatggatgtcagtgggaattgtgtggttacattcaattctgtgttgtctgtactccgcttgtttgtaattatgagcaacagcaaagcttcagttccaggagagtatccagtgctatcttggacatttctgggttacctctaagagtgagctcagcaagtgtaggctcctatgaataacggcaatagaaaggcactgttaggaaagtaaacgtgctactgcaaaaaacaggatacaccacaagccagacagcagtagtttttcagttgtgcccagtgcacttgtgttcacccaggtaactggatgaactgtgtggtgatggtgttctcctgtgagggggaggggcacagttactagcattaaatattgctagaagtaatatttttctgtttttctatcttgttgctagaagcaatatgtttctatttttaatgagtcaaatgctgactctatttatttattcattctgttcatctttattgagttgtagaggaagagcaaggggtaaaactgacaaaagtccctgacctcttggtgcttttattctttaggggagagatgcagtaagcaagggaacagataaacaaggtaatttctgatgggagcaggagatatgatgtaataaaatgacagtgtgataagggaaagggggagctgcaaatagggaagggggaggccagcacctgggaggacatgaaagctgagctgaacataaaagctgggagagccagccattcagagagttgggagagcagtgccctagacagaacaaaggccctggagggaggaacaaacttggtgtatctgaggaagagaaagctggccagcccggccagagcacagtgcgttgcgggaggagagtggagacgcagcagggatcagtcgggggcttgcatgtctttgcaaagaatctgattattgtaaacatagtgagaaggcattgaatggttttaagcaaaggagtgatctgacttaaattttaaaaatattcccctggagagccaggcacggtaactcacagctgtaatcttagcactggggacgcggaggtgggagtatcagttgagctcaggagttggagaccaacctgggcaacatagtgagaccttgtctctattaaagaaagaaaaaaaaaagaaaaatatatttctctgggagagaaacacatgcttgtgtatgcacagatgcatggactctcaagaatacataaaaatagacagtggtggtggttgctgggcttctggagagggtaacagaatgagatgggagacttactttctgctaaatatcattttatacaatttgaatttttattatattcatgtactacctttaaataggcaaagtaagaatgaacaaatacaaaacaagtacatctcaggtcaattttttttttttaaatccagaagttccctccaactgctgggagggggacggcttggagggcagcaaaggcagaagcaggcaacacgcctgagctctagcagcctggtggagccatcggcctcaccgcattccagccctgctggctgcctttctcttccatcagtatgctgagcttattcctgccacaggacatttgcatgagaagaggtgcagagccgattcaggacatcatttagatctaactagacctctaataaagtcagtgtgaggagtaaggaaaagagaggaatcaagaattgagcccacagtttgacttgaacagcagctgggtggatatattgccactcacactgaggcagagaagatgaggagataaactaacagaggtcaagaagatgaagagttgtttcaaacatggtacagttgagattcctagcattattctagtcagacgtgtttgtcaagtaggccattggatatcgggatttggatttgaggggaattcatagatggaaatataagttcaagaggcatcagcatggataccctatttggatctggatgaaattacctaaaggagaaaatgcaggaggacgtgatgctgggtgattttagaggagaaaccatgaaggattccaaggagcagcagttggtcaggtgggaagaaaggagtgtgacatcacagaagatgaaaaataaaagtattttaagaaacagaaaagtggacaaatgctgtagaggttgaggtgaggatattggatttcgccccttgaatacctgattggcctttgcttgctccctagggttcagagaacacagtctttctatacctaacctatcattcatttacctgaccaaaatattttgagtgaaccaagcagtattttagggatagaggatatgtgataaattacagaagcatggtgcttgattttatgaaatctagccaaggagacaaattaaatgaacaaattccacaaatgacgctaaattaaaattgtgactagtgattgaaggaaaagttcaagatgccttgaaagcatccaactgggccctaacctagtctgagggtccaggaagatcttcctgaggaagtcattgaagctaaggcctgagtaagcaagaatttcctttggaagtcagtgtgtctgggacatagaatgcaagggagtaaatggcacaaggggaagcggcagccagggttgagatcgtgcttcagtggggaaatttttattgtaatcagtggagcacggtaatcacagacagggctggatctcatcatctcatcatgttggctgccctgaggaaggtggctttgatgtggggcgaccacctaaaggaagctgttgcagtagcctcggaaaaaagttactggtctctttgactaggtggtggcttatgacgctggctgctctgaggaaggtggatttgatatggggcgaccacctaaaggaggctattgcagtagccctggaaaaaaagattctggcggctttgactaggtggtggcagtagagatggcaagaagtgaatggatttgatttttggaaatcgtatccacaagactcggtaattgaatgtgaagagtaagtaaggtatcagtgatgactccaggtttgtgtcatgagccactggctgcatggtggccctattctcttagaatgggagacattgaagaagaagcagatttgtgaggaagtagcaagtgtcctatgttagacatctcaagtctgaaatacctgagatgccaagtagataattgaatacacagatatggagctccaaagagaggtctggggcagagagataaatttcagaattgttagcatacatagttagaattttaaccttgaagaagagtgtgaagagtgtaggattaagacaaaaagaaggtccagcactgaataatgctaatatttcaaggatagcagatgaagagctatcagagaaagagaaggaaaacaaggtaagcagatgtcacagagcccacaggagtagtcagctttctagaggttctaagtgataattgaaaagggtcattagatttagtgattttcaggctccattcgtagggtgttttgttttgttttgagacagggtcttggtcttttgcccaggctagagtgcagtggctcaataatggctcactgcagccttgacctcctggttgcaagtgatcctcctgcctcagccccacaaaatgctgggcttacagacatgagccaccatgcccagctgttcatggggtgtttttttatacccaaattgtaaccattaggtgaagtcatcatatctgagccccctctcctacacccccaagtgaaatggaactgggctatgtggttattaataccttccacacaggagatttgtagagtcctttagtgggctatccattcagtagggctttcactatagtgtgtagtctgacttcagatttgaactcatgtctgcagaaaatatttttctatactgaataagcctcttccccttcagggcaggtgtttttaaataaactaactttaaacatggagaatcaagaagccagcttctctgcccgcccccacccccacccacaccacacagtcttataacagtggacagcagacattgtaggacttctgaccttgcagttcagattttgtggaaacggggcaaaagcatgcttgtacttctaagctcctcggaatgacctttttgagttatcgtggtgaaaacaagaagcccttagagaaacttcattcttaaaacaagcacataaaacaagtgcatgtgatgctggcacagtttgggtgaaaacatagattgtttgcagaatgtctacagcccattcctttctcctgctcttcctttcactacagctcccagcctgacagtcttggggaaatagacatgaggcttttcaacaaacaatcagtacgtgaccaaacttggcaacacatgctctgcctctgtttgtgacagaggcttgcagaatactcagctgtacctgtagaggagctcctctctgatgtccttggaaagtttccgtgtccctttcatggtgtccctaaccactgagtactttccaggctgcactatatagtctttgtatatttaattcagatttctctgaaatttgcatatcttcagaaatttttacttagcttgtcacttagcatgcatttatagtctgtaaagacaggcttgtggagggggagagaggaaacttgtacatcatatgttcagaggaagatttccacattcgttctcttttgtcggcagtgacttctcaaaggagaatggaaccagaatctagatggggaggtaaaagcaagtggggcagaaaaaatgttgtgtgaatggaggaggaaggaacagacatgatgggggaagggggtcagagtcataatgccaagcatgtcagctgcaccgtgtagggcaaaatggcaaaagggatgaccccaccccgaagaatcatcccaggaccaaccagccttccttgagcacatgccgggtgcttcacaggcacggttttcatttatgcccgtaacagccccatcttagagcagacacagcggaggttcttcaaggttaaatggcctgagccacataactgtcaaaacagggcagcaggaacctgaattcagtacttgggtctaaagctcacactccatgctgtattatcctgaaagagaatgtgtagttcagctgttaagggacttgctgtggaagcagggttgaaactaagttacaggtctctccctaccccagtttctcatcttcatactccctgtgatcccagtgtgttgattgaaaggtcagttgggaaagatggggaaaatgttcctttcttttccaggtgtttctctggagagagatgtgtggcatttatagtctgatgccccctgaccacgttgccactcggacattctgtgacttggatgaactgactcttgcctgcaaaggtgccttcagggaggctaaacaggccacagctccctggtgagccatgtgtcaggagcctggcaactgagttacccccatgggcccaggctgtgtcttcagcagctcctggatggaatgcgtgcctccccttttgtcatctctactttaactttggagctggttttgtaggagactgctctgtttgagaagataatcttttaaaggattgggaaatgctgaaagagaaagccaaacaaatcaggagcctactgaaaggaggataaggtcgttcccaaaacagaagtttcgtaccagcacagcactcttcccctgagagccgtgtagaggctggaggaggtggaggggcccgccagcagtgcaggtgcctccttaggggtttttggaccctaaagactgccccaggtaccaagtggttaatgccatctgctttcagctactgaaatgaaatgatgtttgaaagagcaagtcatttcattattcttgtggcaaaaactgccttgagccattttctcttagtttttaaatatatgttcatctccagataaaacagcctagcatatgagcctgcagccagcccccgtctccttgtgggctgggcattgaagggcttgcttggaggagagttctcataagtcacaatatctttcatggtgtgggcctcctaaccttaccctacccgctgggttgcaaaaataggttttcctatatggaggcaaaagagtaagcgatggaaggtttgttctctggctgtcaggtaaagtgagggctgcttgagctgggtgatagaaggagacattactgggacgaagccgacattctccacagaggagaggaaagaggtaattagagcttttgcaagaatggggctgtctggagaaacaataataaaggacatcaacagtggtgaatttttttatacttttaaaatggcatgtgtacaaactgcatggggagcttcgttagctggactgtggcacagttttcttgcctgcactgctgacggctctctgagagcgatgtgacggcacatgccaagggagggctctcaatcaccgctgactgcacacagctgccttatgagttctttgcacaaggcttttgtatctttgcctctatcatactgcttttggttctaacatttagctggcatgtaactgatattttaatttatttgggggaaagcagatgattgcttctcttttaaagctgtctcgatatgatttagtgtttcttatgaaattgttgaggaggagtgtgggcttttctaaattgcaagttttccttctctttgaaaagcagacagactgatgcccagcttgttgattcactgtggctttggttccagtgccctgggcagctgacttctgtccatccagtggttctcttctcagcccagcagagcactatgtcagccaactcagcaagctgggatccagttctgtttattggagtctaatgattttccccctaccatgcaaagccagggatggaggagaatgcaaagcagatgccttccattcccaaaacacctgcagctgctttgcctgtaccctggcctgatgaaataaaatgcatttagatcctttaatataatacatttctgtgctacaaattctgccttgggcattgggtcaccggatgtggtataatccagggattgctgctggtgggagtataaatggctaatgctttacaacaagcttccttgtaaccacctgctgttcccaacgtgtacttacatatgagctatgaggtcagtgagctgtcctaagctttaaacaattattaccttgctagaaaaatgtgatatatatatataatatatatatatatatatatatatataatatataatatatatatatattttttttttaataaggttgcttgatcatttaaggaagatgggtcggggatatttgtcatttatttttgaaatagacactttagatgccaagtggttcatgagttgatgtaccacttgagattaatgagttgagatttggagggtcaactcaggatgctttgggaggtcttggatagcttctgtctgctggagctcatgtgcatccacaggaatagtctctgatttaccaaagaaccagatctacctgcctgggccccatcactgtgctgcgcccagcacaggctagggggtggtgagcaggtgcctctgcgcagacagcagcgtgctgccacctcgggctgcacaccagcagaggcagagtgtgttacagtaccacatccccaaggctcatcagtatttttaggtcctccttcaacttttgacaatttaaaatttaaatgagcaagaagtgtaaaacatttgcaaatgaggtaaaaacacctgagcagctggagctgcagccctccctgggctgtggctttaataaaacagccacttgagggagcttccaagtgagggatctgcaagaaagcaaatgtttaatttattatagtccaaaagtatccagagctgtccagttttgccaacttgaaataattctttttacttcaagataaagccaatatttaacatttctgtctggcaccgattgaatcaaaatgtcaggggctcaacttttgtgactttcagcatcaccttctttgtctccctcaggaaattctgtgtaaaagggcagttcaacacctgcccaattcttagggattggagggaaatgctggcctgtagggtccaagggcctcagccaagggtagaggcctcacctcaggcaggatgtaaggtgggctccttccctctgccctccagctcctgctccacccacctctccagaccccttacagtagccattccctgtggccactgggggaagggaaccagcggacgctacttgacttggttcagctgccctctgtgcctagcctgccagcattgtcgagaggtaaagaacacagaacacacacccagcccgaccttctaggttgagttacaccttggagtgttccttttgggcagtgattgatgttgatttttgtatataagtgagtgagatgttgttacaattttcacagcacttagaacaaggtgttagatgttgtggcacctttgcctaattatggcatttgtgcagattgttctcagtcatgtaggtttagtctcaaaacatccactcctcctccctgtgtagacagaggtaagctgtggctgtggatgagagcatctgaatgaattgtatccatttcagatgttagctttaaaagctatagggtcatgttagaagtttggttcccgccaaatgagtaattttagagatctgcacatcagatctttatgggtcttggaaaaatgctcctcctcagttcaattttctgccgggaatgtgtttctaaggccctttaggtattgggcatcttcaggtttatgtggcacatgggtcattagggccataggccccatttctgcatcaggagggctgagtccagatgttctggtttaatatttatgagtggcttccattgaaatacctgtccttccgagagaagtgcccctaccccctgcctctctattccgggtgagtgagctgaaaactgcctcctgcttttctcattcacatgggattctttcagaacagagttttagataggtcttgaattgtgtttttgccttttgccataatcttgtgtctttggtagcaacagtcagggaagtgattgctctacccccatcactgtgccaagccacaggcttgggcggggccccgggatgacagccttcggtggttcagccactgtggctgtctggacaggcatcctcttcttccattcctgttccatgtgccccctcgcgatgctgtctgctcacttgaaggagatcttctcagatggagggtgtagctggtggagaccctggggaaaccttccccccagatcacagggggtgtctggtactacttgctgtggttgggcctcctcactagtcctgctctctctcttcccatgcccagggcagcctgtcagaagccagaatggtagcaggcagagagaggcctcagtccagagggccatggaaagtggagtcatggagcacagtgcctgcagagctgctgtttttccctccctttgaaatcgagggctcatcctaaattgctcttcagtgccaacaagcaaagggacgcccacacaagttcttcagcattttgtacagatttactgaacgcaactcaggcatccttaaggaagctctgcagcttcctcctggaccagtatttcatgaaaatccagtaatcttgggctctaaggagcagggtagccagtcatgtgacttggcaggggaaagggctaaggttaaaccacatttagcaggcagattacattttcagccactttgccatgactcttcctctctctttttggggggtgagcatccttttaaccatattcccctatcccttatcctcctttatcccttcaaagcaccaaatgatatatagctgtagtaagcaaaaatctgttgaaatgtttttaaaattacatgctgctgaacgatagggccataaggaaagtgtagatatgggaatgtatgtatgtgaatgagtcagtgaatttgattttttttatttgtacaaatgtatggggtacatgagaaattctgttacatgtatataatgcatgtgatcaggtcagggttagggtgtctgtcacccgagtgcagtacatttttgctaagtatagtcatcctactccactatctaacattgaatttattccttctatcttactatgtgtttataccctttaatccacttctcttcatcctcctccctctccacattcaccctcccagtctctctcttttcactctctacctccatgtgtttaaattatttagctcctgaatataagtgagaacatgggatatttgcctttgtgtgcctggtgtatttcacttaagataatgacttccagctccatccatgttgctgcaactgacatgatttcattctttttgactgaagagtattcctttgtgtatatatactacattttatttatccattcatcccttgatggacactgaggttgatttcatatctttgcttttgtgaatagtgccacaataaacatgcgaatgcaggcatccctttgatatattgactttttttcctttgggtagataccctgtggtgggattgctggatcaaatgataattcttagttttttgagaaatttccatagcggtttctatagtggctttcctagttgacattcccaccaacagtgggagtccttttctctgcatcctcgccaggatctgttatttttttgtctttttaacaatagccatactgactggggtaagatatctcattgtggttttgatttgtatttctctgatgattaatgatgttgagtattttttattcacctattgactgtacatcttcttttgataattgtctattcatgtcctttgccagtttttaataggattttttttttcctgttaagtaccttatgtactctggatatagtcccctgtcagatgagtgatttgcagatattttttcccatttggcaggttttctctttacctgtttgattatttcctttgctgtgcagaagcttttaatttagttaagtctcatttgtctatttttgtttttgttgcctgtgcttttgaggtcttagtcataaattctttgcctagatcaatgtccataagagttttccctaggttttcttgtagtattcttacagtttcaggtcttgagttgaagtcttgagtccattttgagttgatttttgtgtgtggtgaaagataggggtccagtctcactcttctgcatgtagcaggccaattctctgagcaccatttattgaagaggatttcctcttcccagtgtaagttctcattggctttgtcaaagatcagccggctgtgaatatatggctttatttgaatttgattttaatatataactttttaaaatctggggaaaaaagaattacatgctaccctgggtaataataccagagctgctgtcgtagttcagcaggtcagttctgtgtactcagtgttttcatcccttctggatgccaccgtccttggccctctctggaaaggcccttgttggtttctaagaaatgaggtagaggaagtgttaaggctggcctagctaacatgactataaatcctctgtgttttaaaactgctcatattgaaattatggaaaataatcttctgtagcagcctggactcatctctctccttacccagcttggatcccagaattcaatcagagagcaacccaaggttcatgacacttgtagtggtttctggaaacagatctgtgagtaccaagaaaagaggataaagattcatcccatccaccagtcattcccatgcacctctacccgccatcccctgtatccaggacaacccccttctgacaccaaaatgcatttcaccattggctgctgtcggtagataatacctgctcagcatttgggacaagttccagacataacttcctcttagtgaatgatcctgacaggagaaagaattgagcttaatttatgccatctaataacctcagtgcagctacttgggaagttagccctccagagtttcccccaaagttttctccagtgaattacagtgccatatattctcattgctaccagcgctgctcccaaaatctatctgctgtttaatagtttttacctttcaaaaatgcaagctggctgggcgtggatttttgaaagcattcctcctgccttggcctctcaaagtgctgggattagagggtgccttctaatcccagcaatccagcacttggaaaggtcaaggcgggaggaatgcttgaagccaggagtgtgagaccagcctgggcaacatagtgagaccttgtctctacaaaaataaagtataaaaaaacagctaggtgtggtgatgtgtgcttgtagttgcgctactggggaggctgaagcaggaagacctcttgagcccagaaggttgaggctgcagtgagctaggatcgcaccacagcgctccagcctggtgacagagcaagaccctgtctcaaaaaaaaaaaaaaaaaaacctaagccaagtgtcaagatgtgtctaacaggtacacagaacctgggcagagaaataaggtgttttgggctggtagagggaatgtcagggtagctactgtgatagagggtagagggagtatcaggtagctactccttgggcggtagagggaatatcagggtagctactgtgggtgtcactccctgttcctttttccagagtcctggggctctcacatccaccaagctggctgctcactagctggcggaaggcaagctaagcaaacatggagaaggggggccagatgtagcatttcccttccaccccagtccatctttgactaatgaggtgttaagctgagccaggagccaagttaattccagcagtaatccatttcctgctgcttttattcagccagcaccattcatcagaaagagaggagagcccttgggaccttctgaatcatcccaatatcttgaagaaagggaaggggcagcaggggtccacccaccccttattatagatgctgaaagtacagaagtatgtcaggacttggtgacaaaaatgtctatagacacatcctgatgccatcctgctggtgcccctaccctaagccctgactggcagcaggttctccctcaccaggtaggctttgctacaaaaagatgaatttacttgttagatggaggatgcatattgaggccatccatgcctctgctgcaaaatcctttaggagaaagacaactggtatccaatatcttcgagtaatgaacttatcagtaaatgtaacacatgagctcattaatcttaactttgcttttggaccaagtgggagctcggcttctcgggagacagaaattgcatctctgttcttttccttaaacccaatcccaatttagagtcaaacatactgccctgctctccctgggaagcagttaataatgtttcctcacacaatggatggcccaagctcagctgggtcactccagccccctaggctgtgtacatgtcccttgcacacagcctgggctcaagacttcctagtagggtgtgagtgccagctacatccttgagactggttagtccccagccattgagtacatcacacacttttcttccctcaggctgaggaatataggtgaagttaatcttagaagttaaggctattgaatcttaaccttaaatcttaaggctgttgaaactcttcatcctgtggccacttcgtccttgcttgggctcttgctgttcttctaaaagcacagcctctacatctctgaaaagaagttgaggatgtgaggagggatgagtcagtttgcaaggggtggctgcctgttctttatggcctggatgagggcttaaaagaaagaagtctgaaaagagatgctgttggttggaaaacaagtaaggagagtgtttgcttgggcaggctgctgtgggatgcctgctccagacagggagaacaggtttaggaatggatctagatttacctggaagcttgctcctgtggacctgatccaggcccacggggcctggaggtgtggtgagataatgctgatgggatgagaaggtgatgaggagccagccagcactggcaggtgtcttcctagccctgatcttgttctccccagcgttttgaaagaggcggccagcagactctggggacctcagacgtctgtgctccacatgcgtatcggccgctctagagattgcctgggaagctggagggaatgggagacaccccggtgcagctgcgccctgagttctctgagcctggctcctggctccctgcagccctcccctccttgttcctgacccagagtgactttacctgtaccggctccctgctcgataggcctcttgatctttcatcactggtctttttctcttatttgccagaccagtgtctcccttggatttctctgcttcaaaaagagccttgcagcatcctgcgcttctgggagggaaagacagctggaggcctgagtgtgggcatctcaacctctctcacctacccagtggagtgaaggacagctgggggtccgagtgtgggcatctcaacctctctcacctacccagtggagtgaaggacagctgggggtccgagtgtgggcatctcaacctctctcacctacccagtggagggaaggacagctgggggcccgagtgtgggcatctcaacctctctcacctacccagtgcagttagaagtgtcagattccttggagatggcgattggagcccagcattgctgtctcctctgtttctatctaatactttttctagcactagaaataatccactttcctttgagagctcccactcatttttgggttgtggtttgatcactcccaccatcctctcaagccccggctgtacaggaggtggaatgtcatttaagacataatcatttctcctgcctcctagaaatggtgggcatcctgtggtggaaatcacagtttgcccgagccaagcagagagctgagctgacagcctgtgctcttccgcctgcatggtgctggagaggagcgcagagcccactcatttgcaaggacagggctgtgtctcgcagccatcaacttagggttctacccttcaagggtccaggcagggacaggcttgagcagctgtggaatgcaaagtgctgaccctcttgctccagggtgcaggtgttggagtgagctctctgctgcatcaggaacccctgcagtgagtgttgtccactcactgggatgcccctccatcctctggacaaaggcaattgtgaggctctgcgcacttggaggccaccctaacacactctttcctctgcttctcccgctgctgcaggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaa

SEQ ID NO: 2615 - DNA, 1986006 bp, Homo sapiens
taaaagataaggatttagctcttaccagcctgttctcctctcctctcaccttctctttctacattcatgcaataatttttggtttaaatctatgttcaagttttacattgttgaatcatataaataagttgtagctaagccatgtaatacaatatggttacattgctttgtataatttttatttttcctttgattaataacttgatttttttcttatttgtacctatccctaattcattcccaactgaattttaaacattttaaagttcagcttacacattgatttttaaaattgtgtttacacgttgattttaaaatgtaagcattagggataggtaaaaagtgaataagcaaagtgaataagcacattctgtgaataagcactgaactaatggagttaaaacatgaatcaaaatatatacagataaattagatgtaggaaaaacaatcagaaccttcagtgacattttacaatcttatcaaaaagatatgttagcatttagactatttcaggtaatatagtaaacagttgattccccgtaagcaatgtatcaaagaaataactatcaaaataactgcatttatgtatagtgtgtactaaaatctctagtgttaacttatgtaacctcattttgttcatctccatcataaacattgtatccttctaatttaattagttcaatgttttttggttcctgaaaaaatacaacatctttaattttgccaacaaaattggttttaaaaatctcttgagtaacgatatttacctttctaccatattcaaagccccctagataacaaatgccatcatagtttagagccacaaagtttttatgtggatcaatatcctcggaaagaattagactgttatttatgtaggccttgataagagtctgattttgaattacaactacatggtgccatttattacaacagaatgtgccattgttatagctcataggcacagagattctttctcccaagttaactgctattttcaaggtctgattatggagaccaattgccagaaaatcattttcttcattttgagctattcccatccatacaattagaccttctgttttagtggtactgaaatttaaggatatagtagtgaactggaggtttctcattctataatttggatcaatgtatttaatgtaagaattacccataaattttgcagttgaaaatgaagttttgttttcacaataccttcccacccaacccaaagtacacaggcaactgtaagaaaatgattggtcaggtatacataaagattggtggaggcaaagattattcaaacaggacacagactggttacatgtatttccagcccaatctggcaaacatctgcaagaaaaagttgtgccatttactgtacattcacctccatttctgcatgtgttgtacccacaggctgtcccatcacagtcacctacatttgagccaccttttgctccaaattcagttaattgtaattcttgattatttatgataacttgtcggatacagccttgaaaacctacaggttcattttctattgccatgggatttacaagatttaaagaagatactcctccaatatagaagtctgtatttgtgtccagagaactcattttagtggaggccttttctgttacatttatcccatctagatccaggtagccttctgcaccaactcttcctgcttttattatatgccaagtacttccgtttatagttactttttggagagtttctagaatgatagttctgtcgccaaggttgtagcgaagttgaacggaactatttactaaagagatgcataaaaaatcacctgcaagaaagcaaacagtaagtttgattagcaacagtaaaagtttccattgaaaacttttgctgtttctggccaagttggataagttttagttatggggaaaaaagtaacagatcttgagcacaattgtgttagttttgtttccactcacagagcaaaatgcatatatcctgtattctttcattttgttcagcaattggctacataaattttctctagttgtggacagttctcattgaatgaatatattgtggtagtaagttaaagtgaggtttttcttcaaatgaaagcctgttccttatgataccatttaatggcattcactattgtcaggctaggtacctataaattctctgcacattcctggctcctttcctgtctctccaaccttacctggaatgttctctttccccatccttacactctctttacttcaacaacactgactttgttaattaaggatttcattcgcctgttttctaggaacactccgccaccccattccacctcaactagataactcctacctgtccttcaggtttcagatcaagtgtcacttcctcagagaagttttccttgatttcccagagctggtcaggaatttttttctgtcagtgccttaatatcactaggtttccctccattacagtatatctcattttataattatatagtcgtgtgaagaaataggaacaaataccatccagcatctgaagttgcaatgaggcattcagaagaaaagtaaaggcaattctgcaagcttggaaaaagcatgttcttcactgtaagattgcttgaagaggatagcaaaatgacttattaataatgaaccacgcagaagtctccacgaaacattttcttctccctctgaaatttcccaacctttttcttttctcatccagggatattcggcattatgctacactacttcttcctccctccagagtgcctatttccacacctccctcctgcaaatggtgttctttccttctattctccattgtggtctataccaagccattctagactggttggaatgtttggcagctctatagttcttcacctatcaaactacgttctctagctttattttcctcatagggaatttttagtgagtatactatgtcgttacatatgtgatatttggttaacagctgctttatccactaggttgtaagctttatgagaacagggtctgtgtttggtttggtccaacagttgattcccagcacccaaaacggtatctggcccataaatagatgctaaataattattaaataaagaaatacgtttgtagggttgtgggttgagatgactcagaatatttctcaaataatagttttagcttgaaagcaaaaacttttttcctataatgacatgaaaattgttttaaaaattcataacaaagaaactcagtttatttgcataatttctaacatgtatagcatttttaactataaggaaagagaagcaacattataaactttcagattaggaaagaaaaaatatacattgggttataccaccaaaaactggaacaagtaaacataattgataattaagttcaaaaaatttatagcaacctaaatatactttgtggcctgcaagtgaacacaaaccagttatcttttgcaagattatggaggaagcttttcttgctccttgtgttgtagagtgttcctgtagtaaacaattttatagtgaagagctacattagaataaaaaatatctaagaaatgattaggaaagctgaagctgtgatctatactatcactggtcatgttgccaaccagaagaaagagcaaggatagcttctgcgaagaaaggattattttaactcagctagtatgttcttacgaaaaattgacaaaaagttttctttctgtggctatggaagctaaaagctgtattagcttaaaaaatcatagacttttaaatttcattgcgttaggatatgatgctctagttatgggtcataagtacacattggcattattattattattattattattattattattattattattattttgagaccagagtcctgctctgtcccccaagctggagtgcaatggtgcaatctcggctcactgcaacctccatctcccgggctgcctcagtttcccgagtatctgggactacaggcactggccatcacggccggctaatttttgtattttgggtagagcgaggttttaccatgttggccaggctggtcttgacctcctgacttcaggtgatccgcccacctcggcctcccaaagtggtgggattacaggcatatgccactgcacctggccttggattcgcattagagtaagaaaatgtaatgaacagtccttacaagaaacagagctcaaataggataaagatcataaatgaattcactttggctatttaatgcccactcaaccatggctgaggcttctcccacctttgttctgctattgtttctacctcatcatctgctatcccaccgtgctttattatagataagagaaaccttgtaggacctaatatttgtgaagagactacagaatcagcatatcaggggaattgtatatacatttttttctgtagaaaaggaaagcaatggtaatttaaacttatttatatatttttaatatagtttaattatttgagtatgttttaacttcacattgcaatgactaggcctttttatacacgttgggaggattataactatatcagatgaattcaggctttgattaatttgtgcttaacaaaatgttgataatttttatatatcaaaaatcttttaaaggtgttaaatttttagcagaaatagatgaaaagggaccagagtcttatttctttaaaatatctttcaaaaatcagagatctgagatcatctagtataattttcaagttatcattttgttttaaattttacactacttgagagtactcaaattattaacctctaaagagatacagaaaccatgttaatttagaatttggttttcaatatgtgaaaaccacattggctgcttttattaaaatttttggattttaactttgtgtattgtttggttagtttttactaataggtcctcttagcagaggatcaactatgaagacttggttaatgtttacatcaggcacagttcttagagaaggtacaaagtacaggactgtcagctgcattttctgcaaccttaaataaatgagagacttcaaataaacttgttatatcacttgattactaaaaaataagtttatgcctttcatctgataattgtttttggttaatctaggtttaagcatgtagaacttatatttttaatatttaaaaattttcatgattttcttatataagtgtcaaatgcagcatcaatcgtgtgaaactaatgaatctctgtaagtagtgtctgatggcataaaaaaggaaactcttgattgtcttgaactacatgcattgaataacagatgtaagaagatgtgctcttgccctcctatgtgtattagtgtgtatgagctttatatttcatatacacaaacaaatatgtatcgttgtactgattataaaactgtagtacaatattcccagccagtcacaatcctgaatataccttgattttctgccctcttacataggtcccacttaacattaattttgagttttattagcaatataactgaagctgattgtcttttaatgtctcttgatttataaatagaaaatttatgtttgtatgtggttctcctatttgacattttcacagggagatttaatcatgaatttaaaaccaaatatctcaggagaacaaatttcttctgagctgtattttatagctcaattgtactttttctctttgaaattattttgagggtatttcagaagtgcattgaggtggaaccactttggtcgaattccctgatattcttatcatttagaagcaagtcaagacacttctataagaactacttagattatgatcattagagcaccatttttgctaatgatgtgaaatttagcaaatgtaattatttctcaatatcaaaattgtttctcattttctgagagacaagatcaaagaaagtcaaatgtaagattttaaaaatacttagcaatagagatgtaactatatgtgcagatgtctttgtcagaattttggagaaatgaatgaaaatggatatcaagggtaaagtaaaacctaaaaaattaaattttaaaacactaattggatactttatttcatattttatgataaatatgtaccttttaaaatcctaaaatgtttttgtaagcatttcagaacacaaatcctgggtttactgtttggatgacagaacaacttaaagagaatttttggagctataaatgtggttgaatctacaggaaatgtatcagccatgccttccttttaaaaaatcttttatatgcatattttgtctcctttgacatagtactatcgtgcatggctttaatgtcttttttgatggtattgtttttaagttgagcatatactatatttagattttgcaaactttaattccaacaaatctgttgctattttattagaatatctagggcttctaaattcatacgcatacacttgcagtgacaatagaacataaaagcatcaaatgtttacatatttaaatactaggtgacacaaacactatcatacattacttaatagactattaggaattcattctgcaaacaaacagcctgccaatcttacctgattgggcttttaagtgttgtgcagcataaaataggataccatctgcagcgagaggctgaaactgcaattgaatatgtgtcttttttcgaacatgaaaggaagcaaaagacatccaggataactcattgcttctgaaagatggatcacttatggataaagctgagggaaggagagaaagagaactctgggagttatctgctggattaaaaaacattgctcataaatacaataaactgcttatgtaattttgtaatttcaggatttatcgcccaagagttgcttgtaggtgagtacatcaaaccttggtaactttgtgagtctgttttaattccactaactttagggttttgtaacgaagtcacttactgaaaagccttctcttgcttctggtaactatgcctttttggccgatactatctgacacaaatcttctgctctagattgcattatatagagggatcagatgcatagctgaaattcttggaaatgtcttacatttataatgctttcagaaagttcaaatgttggaagatagaggacaacactttataagttattcttcagcctctatatttctgattcaaatacagagtataattgagtcaggatatattataaggcataatatattgatttttttttttgcttctgtgtataactgacccaatgggaattatgagagggagatggaaagttctgcacatttggccagtttttatccctatgaaatctatattccttcttcttttcttataatgttacagtgcttcttagagtgcgccctggttcaggacatagcttagccattaatctagttatttagttttctccctgctctgtggaccaggcgtatgctaacggctccttttactttagattgaataattggtaggtgtttatccaagaggtgttggcatttgctgattttttttaaaaaactgtactcattcatttcgacttattgctattcagaagggtagaggttagaatcacctgatcgtgttgccaagaatgcaaagcgctatacctcattcctagagggcctgatttattaaagccaggatggaggctgggcacggtggctcactcctgtaatcccagcactttgggaggctgaggctggaggattgcttgagctcaggagtttgagaccagcctgagcaacatggcgaaacaccatctctcaaaaaaaaaaaaaaaaaaaaaaaaaaaaaaaatatatatatatatgttagctgggcatggtggcgaatgcctgtggtcccagctactggggaggctgaagtggaaggatcagttgagcttgggaggtggaggtgggggtggaggtgggggtggaggttgcagtaagctgagatggcaccactgcactccagcttgggcgacggagtgggaccctgtcgtaaaaaaaaaaaatgctgggatgggattcagaaagcatccccatttttaataaaccctcctggtgtttctgacataggggttccttggaccacattttcataaaatctggttaaaattttaagaacacaagggtgatttaaaatgtgagtgtccttttgaaactttttaaaatattgctaaattaatacatgtttattataagacaaacaatataaaagtgtataacattttttaagtgaaatttcattgtttctcctctcttaatcccaagaattactgttaagtttattgtacatgtagccagactttaaaaaaatacacatacaattaacatatgcatatatctaatacttgatttattttaaataaaaccacattttatataaactatgcataagtaattgcttttttccatctatctttgtgaaactgatattagcatattttgcctatcacttcttttaaatacatggaaggtatttttaaaagtacactttattttttcagagccattttaggttcactgcaaaactgagtggaaagtattagggtttccatataccccttgtctcaacacatgcgcagccttctccactgtcagtattgcccactagagtacatttgttaaatggatgactctatattgacacatcattatcacataagttcatcatttacataggattcactcttcacgtacattctatggattttgacaaatgcgttgtgaaatttatttaccattacagtatcatacataaaatcatacatcatatcctctttgcttgcctatttgactctccctccaccctggcaaccactgatctttttttactgacttcatggttttgccttttccagtatatcatatagttggaatcatacagtttgaacacaagttttcagctcctttggacaaataccaaggaacacaattgcttgatcatatggtaagagcatttttagttttgtaagaaactgcccaattgtcttccaaaattgttgtacaattttgcattaccagtaatgaatgagagttcctattgttccatatccttgctggctttaggtgataagtgttcgggttttagctattcgaaaaagtatctagtgttatccaattattataatttgtaatttcctaatgatgtaagatgttgagcattttcatatgctcatttgccatctgaatatcttctgtagtgaggtttatgtttagatattttgcccattttaaaaattgagttaatttttgtgttgaattttaagaattccttgtttactttggatagcagttctctatcagatatatattttgcaaatattttctgccagtctgtggcttgtattctcactctctttcatgtgtctttgacagattagttttttaattttaatgaaatctaatttatcaatttttttctttcatggattctgcctttggttggcatctagaaactcatcatcaaactcaaagtcatctagattttctcttatattttcttctaggagttttatagttttttattttacatttaggccttgaatccattttgagttaaattttgtgaaagatgtcatgtctgtgtctagattcttttttttttttctttttgcatgtggatgtccatttcttctagcatcatttgtcgaaaagattatcctttccccattttattcttcttcctcttttgtcaaagagcagttgactctattttgtggcataatattttataaaatggatataggatgatttccttagcagttccctcattgaagggtaactaggctattttcagttgtattccatttctcctggtttcccaccctatctctctagcttcatgtgcccctgtcttataaattttataattcctcagggctttccatagcccatctctcttcttttctttccattagtgacctctcatctaattccatgactttaagaaatacctatacatatgataactccttgaaaatttacgtctatctaaacctcttctgtcagcttcagttttatatagtcatctctcttattgattatttgttttggctatatgagttatatcgaacttaacatgtttgaagttgtactgctgaaagatactcttccctcagccttcctcagatcagcaaatggtcccaccacccattcaaagccccatgtagaaacttggtaatcaatttgattgtgctgtttccaaaatttcctttatgtttcccaatataatgcattaatagattatagctgcatgatatatttcatatttgccccatctttctattaccactgccaccatccaagttgatgccactatcaactcttgattagaccattgcaatgtactcctcattgatctttttactttttgtcttaatctcttcacatacattttatatatctgccagagaaaccttttgaaaacatcaattcattgccctctttaaacccttcagggattttacttagaataaaatgcagattctttaccatagcctctggagctttgcatgatttggcctcctgttaaattcccaacattcccaccattgtgcatatggtgcactgcataaccccaaggggaagtcatcacattgtaatttatgtgaatagtgttccctggagatgttcaatgaacaatctacatggaaatatgatgctacttttcctccttttctttaaacttcagatgcactggcttttactactggatttgtcatagtttgattatcttagattaattataccacaatttacttaaccactgccatgttgccatgttttgagttgcttgaaattattttgttatcgtctgggcatggtggctcatgcctgtaatctcagcactttgggagggcaaggtgggcggatcacgaggtcaagagatcgagaccaacctggccaacatgatgaaaccccgtctctactaaaaatacaaaaaattagctgggcatggtggtgcgcacctgtagccccagctattcaggaggctgaggcaggaggatcgcttgaacttgggaggcagaggttgcagtgagttgagatcgcaccactgcactctagcctggtgacagagcaagactccacttcaaaaaaaattattttgttattactaatactgataaacatacttaattatatctcgttttaaacatgtgagaaatggaatcgcagtgtgatggtctgtgttcatttttagagttaatagatgccaccaaactacactctaaagtgtccacaaccagcagagggtgacagaatatccttatatatatcctcaagcacacttgagattattgaaattttaagtttttagcagtcataatgattccattttattttaatttgcattttgctgattacaagtgaagttgagtttctcgtgtgaatattggccatttgtgtttttctgtgacttttttgtttatgtctgttgtatgtttttaaattcgatttgcaatttttaaaatgtcttctgagtcctaatcctttcttatatctattgcaagtatatcctcatatttgtcatttttctttcaactttacttatggtatgctattcaaaatttttaagtttgtatttaccaatattcttggtcttttacaatttacttgttttgtcttatttaaaaacattactcaacacatagttatgtataatcatctatatttttccctcagagattctagttttgcattctatatttttttaccataaatttgtatgtttttaaatttataggcctttaacttatgtggctcatagtattgtgaatagtttgagctagaaatcaagctttatgttataagcagatagctaatatttttcaaaaattaatagtttgtcctctttgtttgtatttgatacacacttttagcatcttacaagtaatattttccctctccctcttgaggaagtgtttgtaggaaatattgaacagaatgaagaatgcagataaaaaacacctataaggctaggttttgtggtagtacctatttggctttgctgctttcctttggctggatttaacatctgggagggggggtctcaagaatggaagagttcagtcaacaacagcatgatgagagggttccctgttacccagtggggaggagctcgaattgtatttcaagaggaagcttttgctgaaactattgctgatactgggtcagtgcaggagttgagaattatctgtgcacatgtgagcgtatcataaaacagctgacctcctaactcgtgcttttccaaagaagtgacacatgctgaaattatatgtaaatgtcactgaactaaacctcaaaagaaatgaattttattaatagctctgacattgtatgttttgagaagatgctcaatacatattttttatataacaagaaaggcttcagctctaatagcttattatttgattaagtattcagtaacaaagtactggggaggattgcattttctaataataatacacattcaaaatattggtgcaagatgtcatttcaaaaagaggtacatttttatttagcagcttcaaggataaactagaacaggaaaaatgactatgcttagtatgactcaaatgtttattttatagattaaaataaagtcaagagaaaaattgaggtggacataccagtgattagtcattgagatacgcccaattatttcttgtatgtctatcaactcctaaaaatgatcactttgtggtgaaaatattccacatgtattctgaaaccgtaaattaatatttcctgattggctatccatcttttagatttagtgaccattggcaaccctccctatttcaccataggcaaaggtttgtgccaacacgttcactaggttcacagaagttgaagtattttggctacctgtccgggacataacagtaaaacaaacaaaaattatttgtgctgtcatccttgtggatggaaatagtaaattaaataaacatgttggtaaactaaatatatgatgtatgtttaaatagtgaatatatgttgatacatcttagaaaaacagggaaaggagaaaggcatgtatgcatgtgggggcaggaaaggcattatgaagaaggtggtatttgaataaacacctcaaggaggtaaagaattgggccaagtggctctttgaggatagagggaataatgaaccctggggtgatagggttcctaccatgattaaagaacaggaaggagggcagtgtgactggacgagtgttaaggaaggggagagttttaatagataaagtcagagaggttatggggaccagatcacattctcaaagactgggaaggttctgagactttcacctactggctagctaacttactagcctgcaacttctcttcttttccttttaatttcaacttgtattttaggtccaagggtacatgtgcaagtttgttatatgggtaaagtgcatgatgctgaggtttggcgtacaattgatcccatcacccaagtagtaagcatagtacccaataggtagtttttcagcccttgtgcccctccctccctaccccctctagtagaccccagtgcctattgttcccatctttatatctgtttgtactcagtgtttagttcctacctataagtgagaacaggtggtatttggttttctgctcctgtattaatttgcttacgataatggcctccagctgtatctatgtgcttgcaacattttcaatgatgctagtaagagacatgaaactccagagacaaaggaaagtttattacagcattagcagtagccaaagtatcagcattttttactcaattctatgaacctcagttctctcacggaccacgttataaacatgcattgggttgcttggggaggaagtctgaggttagagatccaaatatttttataatgggcagtgagcatgcttgctttttgctccaaatgaagacagtatctccatcttataaggcagtaagcaaactggcttcttgctccaaaggaagacattatccctgtcttccaagaatattttctacacaaacatatttgaaaagatagccaagaacaaaaacagccagtacctttaatcagcaggtggaggcaattgtcctaagcaaattaacacagaaacagaaaaccaaatactgtgtgttctcataagtgggagctaaacattggatacacatggacataaagatgggaacaattgacactgggaactacaaaatcgggacgaggcagatgggagtaagggttgaaaaactatattgagtactatgctcactacctgggtgactgggttcaattgtacctccaaccttagaatcatgcagcacactcttgtaacaaacctgcacatgtacctcctgaatctaaaataaaagttgaaaaaaaacttgtgtagaaacatgacagaccagtagaaaattgtctctctacatattatggctattacatccatcaagactgtcttataagaatgagatgggaaatcattggaaagctttgagcagaggagtgtcatcatctgatggaagttaaacaatatcgctttggttgctgcactgagaatacagtgacgaatgcaaatgtgggaacagggcactccctatcaagaggttattactataatactggtaagaagtgatggtggcttgtatcagagaagtagcagtggaggtagtgaaaagtcatatttcaaatatattttgaaaaattgaaagatcacatgtgggtaagaaagaaggagaggaatcaagggtaactatggggtttttgtcctgagaaactagaaggataatgttgtcattaactgaaatggggaagactgtgggagaagcaggtattttggagaagatgtggagctcaggtaggacacatttgagatgtttttaagatgttcaaggtggtggtttagtaggctgatgtatgatctagaatttagtaactaatagatcaagcaacagagatcggtaaggaatttaggagatttaaacaacacaatcaacatgtttgatatcatggacatagacatagcatttgaccttcccaatatgcattcttgtcaaaaacacacaaaatatatacaaatatttgctaaatactgggccataaaacaagcctcaaaaatacaaaagaattgatattatatttacatttacagacttgctcaaagctatgattcagaggaaaaacatgcttactctgcctgtgcatcagtagcaggtagcacgaggccttacattgctcagtttaatttgtacctttgaagcttttgttttgttttggtttctctgtctacaccacgtttgctgtgtctgagtttacttttgagttgctttaaaaaatcattttgtgcaatggaaacaatggcggtttgagtgttgagggtgcttataagaggtgtgtaataatggaaatataattttttataactcactttgaaacaattttgaacttatagataagttgccataacaaaaagaactctcatctctttcacccagactctccaattgttcctattttattgcattttctcatctttttcgttctctcatttcctgtctctgtcttcctgtgtctctgtctgtctctgtcacacacacacacacacacacaccctacttattattagacctttttcccaacctataaaaacaagctaaagatgcagtgtcctacaacttctaaacattctagtcaatgtttcccgtaaacaaggatattttcctatataattagcactcaaacctccaaatcaggagtcaacattgatacaacactacaatccaacaatccaatccataggcatgattcacgtttcaactgttccaacaaggtctctttttcctttcttgtccaggatgcccttcaggaatgcgttacatttagttgtcatgtctcttcatatttcttcaatctggaacagttcctcttactgttttccatattcttgacagtttttaagaggctttacatcctgtagaatgaccctcaacttagctctatctggtgtgtctgcacgatcgattcaaaccatgtaatctttgtagaaatgacgtgcacatcaagagctacataatgtagacccgtatcactacagttaatactaaacttgattattgagcagatgatcaaatatacaaataggagcaatatttggatttgccaggtttcttcacttaaaattctgtgttttcccatttgtcaattttggcttttgttgccattgcttttggtgttttagacgtgaagtccttgcccatgcctatgtcctgaatggtattgcctaggtttttcttctagggtttttatggttttaggtctaacgtttaagtctttaatccatcttgaattaatttttgtataaggtgtaaggaagtgatccagtttcagctttctacatatgactagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagcgtgatgcctccagctttgttcttctggcttaggattgacttggcgatgcgggctcttttttggttccatatgaactttaaagtagttttttccaattttgtgaagaaagtcattggtagcttgatggggatggcattgaatctataaattaccttgggcagtacggccattttcacgatattgattcttcctgcccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataggaatgcttgtgatttttatacgttgattttgtatcctgagactttgctgaagttgcttatcagcttaaggagattttgggctgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcaggatgatattggctgtgggtttgtcatagatagctcttatgattttgagatacatcccatcaatacctaatttattgagagtttttagcatgaagtgttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgttggatttggttttccagtattttattgaggatttttgcatcaatgttcgtcaaggatattggtctaaaattctcttttttggttgtgtccctgcccggctttggtatcaggatgatgctggcctcataaaatgggttagggaggattccctctttttctattgattggaatagtttcagaaggaatggtaccagttcctccttatacctctggtagaatttggctgtgaatccatctggtcctggactctttttggttggtaagctaattaaagtgaagagcttctgcacagcaaaagaaactaccatcagagtgaagaggcaacctacaaaatgggagaaaattttcgcaacctactcatctgactaagggctaatatccagaatctacaatgaactcaaacaaatttacaagaaaaaaacaaacaaccccatcaaaaagtgggtgaaggacatgaacagacacttctcaaaagaagacatttatgcagccaaaaaaacacataaagaaatgctcaccatcactggccatcagagaaatgcaaatcaaaaccacaatgagatatcatctcacaccagttagaatggtaatcattaaaaagtcaggaaacaacaggtgctggagaggatgtggagaaataggaacacttttacactgttggtgggactgtaaagtagttcaacccttgtggaagtcagtgtggagattccttagggaactagaactagaaataccatttgacccagccatgccattactgggtatatacccaaaggactataaatcatgctgctgtaaagacacatgcacacgtatgtttattgtgacactattcacaatagcaaagacttggaaccaacacaaatgtccaacaatgatagactggattaagaaaatgtggcacatatacaccatggaatactatgcagccatgaaaaatgatgagttcatgtcctttgtagggacatggatgaaattggaaatcatcattctcagtaaactatcgcaagaacaaaaaaccaaacaccccatattctcactcataggtggggattgaacaatgagaacacatggacacaggaaggggaacatcacactctggggactgttgtggggtggggggaggggggagggatagctttaggagatatacctaatgctaaatgacgagttaatgggtgcagcacaccagcatggcacatgtatacatatgtaactaacctgcacattgtgcacatgtaccctaaaacttaaagtataattataaaaaaaatacatacagacatatatacacacataaaaaaaattctccattttcccttgtaattcatttctacgtcaggcaaaagtattcaaaaattatatccatatcctgatcctcaactaatctccacccactagcagcattaactttcatcgatgactccagcaggaattaactaccttttggagatcgttgctacatactgattatctacttacatcattcgtgttacgtttattagctggaattccactaataaataaatgtatggaagatctttcctttttctcatcctccttcatttcctctttcatttttccctgcctccctccttcctcccctcctttctatcggtatggtatcattatttttatttaatggattgtaatctattatcataattgttttgtttatcaaattctccctgatttggccagctagagctccttcaagctggttcctgtgtcctcctgtctcaggttatttttctagaagcagactctgggatggaacttagtgtatgggaggtttattggagagtgtgcttggaagcaacatgtgtgagggagaaaacagcaagagggagaagttggcagctgatttcacagggagctctggagctccctggagctctttagagtcatttcacattgaagcaaagtggccaggtctttggagcacccctctcttcctgtcatcttctctttaaacagttattggattaaagctgtcactggtgaggtggtgtaaccttggacaaggcagctctcttcagtcctcgtgagggacttacctttgaactctctgttggcaatattcccaaaagttgaggaagtgagtacctccatttagaaaggggtggggtgcagatctgcattatgtaccataacattcacttcaaggaaattcaacattgaccttgctactattttactttatgaattaaaaagtaaacttattccccccacccccaagacagagtcttgctctgtctcctaggctggaatgcagtggtgtgatcttggctcactgcaacctctacatcctgcgttcaagcaattctcctgcctcagcctcctgagtagctgggattacaggtgcatgccaccacgcccagctattttttttttttttttttttagtagagacggggttttgccatgttagccaggctggtctcgaactcctgacctcgtgatccacccacctcagcctcccaaagtgctgggattacaggtgtgagccaccatgcccggcagaaagtattaattttcttatttatagcacttaagattacatgaaaatattcagcacttttggaaccacaaaaattccaaaaagataatgtgtataacgaagtgtagtcctaattaggttgaaatgctatattccagatgttaattaagaccctgatatggtttggctgtgtccccacccaagtctcatcttgaattccacatgttatgggaggaacccagtgggaggtgattgagtcatgggggcaggtctttcctgtgctgttctgatagtgaataagtctcacgagatctgatggttttaaaatgggagtttcactgcagaagctctcttctctttgcttgccaccatccatgtaagacgtgacttgctcctccttgccttctgccatgattgtgaggcctctccagccatgtggaactgtaagtccattaaacctctttttcttcccagttccaggtgtgtctttatcagcagcatgaaaatggactaatacagatcctgacttttgttttcaaaacactttgcttgaagagctgaatataagttggcacctcccatttctctcacctggtttgaaattcttataataaagctatgtgtttaaaaatgtcagtgtctcatgttcctagataagggatggatctattttaaagatgagatagatgaagaactatttagaatggattctgtgttttgaaacaatgcatagatagttgatacttttattgttatgtgcattaaggttttacagcttgagtactgaaaattctgatgccttttgggtgtgaatgggtctgcctctagaagcagagagaagccacaaataggacttcacagaaaccacaaataggattcaaaggactctgatttagtaagtagcatctatcatcattaaattagctgctcaacgtttcctctgttgttcattttgaggtagaatttgggaaaggtccagggttttcagtgactcataccaagtttttctggcagtgaatcatctttgggagactttagaaatccatataggttaattaagaataaaacgccacaactgctcttcttggataactgatctactgagttctggccaatagcttcagggatggtcagagtaaggggctgtttcagaagcgttagtggttagttttctgagaggaataataactaataattcaagttacttctaaattacacaaacttcactcatgatcaccacttttatggtctttattataaatagaatccctcagagagattaataatatttatatttactcctgtttaacaagtgcagcattaactggccaataccatctagtaaaaaagaaaatagaataggctgattagtgaagtggaaacacttggattgcaatgaagtaccatctgatttatgaaatccatagatttctaaaacaatattttgagtaaagatatgtgttctcaaaacacttaaggataaatgatatggaatatcaaaggaagatgtttttaatatgagcaaaagattgcttcagggagagcacagactggcataatatcaaagatcaagaaaaagattcaaggatttgtcacaatttattgaaagggctgaacttggtaggagtcagccaataagtagcttgattttcccctgtgattcccctttggagatgtctgtgagatctttcattctcatccttgatggtaccttgggtaaatttgttagatctgttgtcattttcaggtttcagtgaaaagttcccattttcaggtactaagagaccccgttcaatctgaatcaaactgtcaacatttcacctaattctaagctccaatcctttttccacagctcatctgactcaaatttagaaagctgtactagggtagtcagggtagtcgtatgtttttgttttgctgtttgtactggtccttaccctccttcttcactttccgttctgctggttttggcttttccaagatcacaatgaggataagtgctaagaagacaagagaagggtcttttttgtctgctgctatttgtggctctttatcagcagtctaatatcttctgtcgtggcagacactctttggatctttgaaacctctttaactcttcacttgtacatctgtcctgcagttcttgacaaggctgatgcttcttggcagaccatttatgaatccaaatcagcttttgctcttgtgggaggcctccagcacatttcctcttgagacaacttacctttctggtcaaggtttttttttaaggtgactcatgcctgcttatcttggtgtgcacctctgttccccagctgctatacctctggctttgcttttagggaaagctacagccagcctcttggctttaagctactttggatgtgggtcaggcactggtcttaagtcttctgtcactccagggacataggtctgactctgagatcttgttctctcatgctccactcctgtttcacagccaatgtcagctcagcagaaattgacaaccccagaaaggaaatcttaggctttccttgtggcaagagcctttactttctttgagtacattttgattcctttctcactcattttttgagtacatcctaacccctcttcctatgccaataatgctcttcaagaaaacccaaaaaacaaaaaccccttttttcagaaccagttctcttagatactacccctaccccacaatataggctgggagcaaatgatggaccaatggtaccatctcttggcatactctatctggattatctatcagttcttttcactcagcataatgcccttgagatcctgattcaatacatgcctgattcatttctttttatttctgagcagtattccatgggacaattctataagatttgattaaccattcatccattgaaggacatttgggtagtttttaggatttggctattataataattctgctgagaccatttgtgtatgtgattttgtgtggacgtaagttttcttttttttttctgtataaatgtccagcaatgtgattgcagggttgtatggttaatgtatgttttgttttataagaaactgccatacttttttctatagcggctataccatcttacattctaaccaacaatatgtgagggatctagtttctctatatccctgccagcatttggcattgtcattattttttaattttaggtgttccagtagatgcatagtgatatctcattattcataaactgtttttagacttgtgggtatacattatacttattattaactttgaggccttggcctgaacttttagacaacaggaaaaatttaatatctcattgcacagtgattcagacaacctctgacttagggtaagattttccaggaaggaattagaattctaattagaattcaaatatagtttggcaggtgtatcagcttgcacctaagtaatatcttctgttgtgttttatatttgttgggcatgtctggtagaatggtgatgtctgccagaaatctacttacatttaagacttagaagtttcctaggagattactcatatcaaagaaatagttttgcagacaggtttgcctagtaaccaagcattcaagttgtcagatggaaggacagggcaatttttgtgagctgcatgatatttgccagttagattggtttgctaatttgatgcaccgtttgtctccaaaactatatccagattcagcataggaaagtagaggagactacaattaaagatactagaagagtcattcttactaagattctgggagacattgagtttaaagaagaacatttgagtattcttcaaagcaagcacaatctaaaaaggaagagaaatctccacacttctgccaaaaacaaccaaccaaacaaacaaaataaacagttgaactctggcactttgatgtctctagcagtaatgggtgaggtccctgacaggagggttgtctggagccaccaggttgcaatttgaggcagcagtagtgagggaaatggtatgagaagatttgtagatgttatgaggcagcatcttttgtgacatattttctcattttaggttttgaaaatagtgaagtactccctgaaaacacacaccaaataatgaactataaaaatacttggattatgaatatattttagtggcttctcttttctttttattataatgtatttttttctcatgcatactccatatcttgcttgtgttcaagcatactttaatttttaattcatcagttaagctgtctttgagttaccatgatattgggcatacctcattattttttacaccaaatgcattttaaaaaggaaaaaggacactgttttatcttctttcttgctgctttaatgaggatggagggataagttacaggctggcacattaaatgtactactatggaaggacctttttctttatcagtgtcccttccctacccttaaaatcactgatcagggtctagcagtatctgctcctcaaaacttgggaccaagtgatggtgttcccacttgcaatgtcctctcatagcacttttaactttcttctatagtttttaatgctttatgcaatactggtcagaagggcttctttctttcttttttttttttttctgagacagagttctgctctgtcacccatgttggagtgcagtggcgcaatcttggctcactgcaacctctgcctcctgggttcaagcgattctcctgcctcagcctcccgagtagctgggattacgggcgcccaccactacacccggctaatttttgtgtttttagtagagacggggtttccccatgttggccaagctggtctcgaactcctgacctcaggtgatttgcccgccttggcctcccaaagtgctgagattacaggcatgagccactgcgcccggccagatgggcttcttttaaaataaatccaatagttgacttttgtttccagcagtatagtagattagataacatgatttacctcatctccatcatgaaaaccaccaaaaatgttggataaattatttgaaaacatcttttccaataaattgatgacctggcaagaaaaaagaatattcagatgccaaaaaaggtgaaaaaagaaaatagaagctaaatagataagtagaatgataaagccagctttttcctcgagcatatttgccaaatctgctaaatccaaagtttaatcttcaactgttcaaggacatgtggacaagagagaagcctagaaatcacttcatatgtaaaaggaggctttccaccaaaaaactggaaccctaaagatacactcagtgaaagggtgaattagaaataaatcaccattattgccacagacacacaggaagaatgctatgttaatacgagggcagagattggagtgatgcacctataggcaagggaatgtttggagctaccaaaagctgaaagaggaaaagaagaaactgcctctagaggcttcaaacgaacatggccctgccaacaacttgaattcagacttcagttgcaacaactgaagtcaaggggacaatgagatcttcaatgtgttgtgagaaaataactgtcaacacactttcacagtcaaaaacaaactttcaagtaaaagagcaaaatgcctattcacataaagagtaatagatgatatgtctctaacaaacactaaggaaattttaaagaatgtacttcatacagaaagaaagtgatttagatggatgttggatggtcttattatattttcaaagaaacaaagaccaaaatagtttaaaaatgtatattatggactaaatatttctgtcttcccaaatacatatgttgaagccctaatccccagtgtgacagtatttggagataagacttttactgaagtaattaaggttaaatgaggttgtgatgttggagttgtaatccagtagaattagtatccttataagaagaaacaccacagagcatgctctctctctgtgtgtaccatgtgaggacacaggtagagccagctgtctacaagccaggaagagagcccttgctggaacctaaccattctggcacactgctcttagactttcagcctccagactgtgagaaatacatttttattgcttgagccacccagtctgtggtattttgagatactttccatcagtacctagtttattgggagtttttagcatgaaggagtgttgaattttgtcaaaggccttttctgcatctattgagataatcatgtggtttctgttattggttctgtttatgtgatggattatgtttattgatttgcatatgttgaaccaaccttgtatcccagggatgaagccgacttgatcatggtggataagtttttgatgtgctgccggatttagtttgccagtattttattgaggatttttgcatcaatgttcatcagggatattggtctaaaattctctttttttggttgtgtctctgccaggctttggtatcaggatgatactggcctcataaaatgagttacaaaggaggccctctttttctattgattggagtagtttcagaaggaacagtaccagctcctctttgtacctctggtagaatttggctgtgaattcatctggtcctcggctgtttttggttggtagtctattaattgctgcctcaattttagaacttgttattggtctattcgtggactcaacttcttcctggtttagtcttgggagggtgtatgtgtccaggaattcatccatttcttctacatttttccagtttatttgcatagaggtgcttatagtattctctgatggtagtttgtatttctgtgggatcagtggtgatatcccctttatcattttttactgtgtctatttgattcttctcttttttttcttagtctggctagtctggctagcaatctatctattttgttaatcttttcaaaaagccagctcctgggacttattgatttgttgaagggttttctgtgtctctatctccttcagttctgctctgatcttagttgtttcttgtcttctgctagcttttgaattttgttttctcttgcttctcctgttcttttaattgtgatgttcgggtgatgattttacatcttttccactttctcctgtgggcatttagtgctataaatttccctctaaacactgctttagctgtgtcctaaagattctggtacacaaacacaaaaagattgtgtctttgttctcactggtttcaaagaacttatttatttctgccttaatttcattatttacccagtagccaattgggagcaggttgttgagtttccacacagttgtgtggttttgagtgagtttcttaacactgagttctaatttgattgcactgtggtctgagagactgcttgttaagatttccatcttttgcatttgctgaggagtgttttacttccaattatgcggtcaattttagaataaatgcgatgtggtgctgagaagaatgtatattctgttgatttggggtaaagagttctgtagatgtctattaggtcctcttgctccagagctaagttcaagtcctgaatatccttgtttattttctgtcttgttgatctgtctaatattgacagtggggtgttaaagtctgccattattattgtgtgggagtctgagtctctttgcagggctctaagaacttgttatatgaatctgagtggtcctgcattgggtgtataaatacttaggatagttagctcttcttgttggattgatccctttaccattatgtaatgtccttttttttgtcttttttgacctttgttggtttcaagtctgttttatcagagactaggattgcaacctctgcttatttttgctttccatttgcttggtaaatgttccttcatccctttattttgagcctatgtgtgtctttgcacatgagatgtgtctcctgaatacagcacaccgagggttcttgactctttatccaatttgccagtctgtgtcttttaattggggcatttagcacatttacatttaaggttaatattgttatttgtgaatttgatcctgtcattatgatgctagctggttattttgcccgttagttgatgcagtttcttcatagtgtcactgatcttaataatttggtatgtttttgcagttggtggtacctgtttttcttttccacatttagtgcttccttcaggagctttggtaaaggcaggcctggtggtgacacaatctctcagcatgatactggacaaaagtcatctgtggatggacacttaggttgattatactacaagactacagtaactgagacagcatggtactggtacaaaagtcatctgttgatggacagttaggttggttccatatctttgctattgttgaaccaactttgcatcctggggataaagcctacttgattttggtggacaagctttttgatgtgctgctggacttggtttgccagtgcttttttgaggatttttgcatcaatgtttatcaaggatattggcttaaagttttcttttttgttgtatctctgccagattttggtaccaggataatgctggtctcatagaatgagttaaggaggagtccctcctcatcaattttttggaatagttttagtaggaacggtatcagctcttctttgtacatctggtagaattcagctgtgaatctgtctggtcctgggctttttttggttggtaggctagttattattgatttaattttggagctcattattggtcttttcagggattcaggttctttctggttcagtcttgggtgggtgtatgtatccaggaatttatctatttttcctagattttcaaatttgtgtgcatagaagtgtttacaatattctctgatgattatttgtatttctgtggagttagtggtaatatcccccttgttatttctaattgtgtttatttggatcttctctcttttcttctttattggtctagctagtggtctattttattttattttttcaaaaacacaactcctggatttgttgatcttttgaatgattttttgtgtctcaatctccttcagttcagctctgattttggttatttctttcttctgctagctttgggcttgatttgctcttggttctctagttcttttagttgtgatgttaggttgttaaattgctatctttctaactttttgatatgggtgttcagtgctgtaaattatcctcttgacactgtcttagctgtgtcccagagatcctggtgtgttgtatctttgttctcattagtttcaaagaacttcttgatttctatgttaatttcattgtttaccccagagtcattcaggaacaggatattcaatttccatgtaattgtatgattttgagctatttccttagtcttgatttcttacttcattgcactgtgatctgacagagtggttgttatgatttcagttcttttgcatttgctgaggagtatcttatgtctgattatgtggtcaattttagagtgtgtgccatgtgacaatgagaagaatgtatattttgttgtttttgggtggagagttctgtagatgtctgtcacgtatgtttgatccagtactgagtttaggtcctgaatatctttgttaattttctgccttgatgatctgtctacagatgctcccattccaaaccctctgggctctgtatcggctgatatccttccccatcacttctccaagcaggttttcctgccaactcaagtgtctgtggtggtcaaggggtctcctgctgccaggattccagaggcctgtggtgagagtgggttgttccttgccagttcaactcacccattcccccagagtcactgggggtcaggaacaagtactggtgcatagtagccccctccaggggtcccaacttcctccctcttcagcctggcttctgtgtcttccctcagtctgctctcagtgccttccctctgaagatctgctaggactgtgtgccacttgtcctagtcccttggtgacagctgttccacctggctgtgtctggttggccatcttgcccaaatctctcaataattttaaatgacctgatttcaagtttgccaattccttctcctgtcagatcaagtctgctgttaaacccctataatgaattgttcagttcagtttttgtatttttctgctataggtttctgttttttaatatagtttatttatctttgttgacagtcttattttgttcatgcataattttcctgatttctttagttgcctatgttatctttttaacatattgagatccttgtgacagttatttaaaatccttgttaagcagctcatatatctgcattcgttagggttgatttctggagttttattttgtccctttgatttagtcatgttctgctgtttctttgtatgccttgtaattttttgcttgggtttgagcatttgaaaaataccctctatcccagtttttatattctgactttgtacaggagaagaccttctttaatcagcccagctggaagacctctcaaacccttctaatctcttactctccttggaatctgcctgctgaactgcatttctaatattccactccacctttgtttccagtggcttctgaattctggtgtcaatactgtcagcactctgagtcaggtggtacagaaatgagtcctttgggcagccctcagacaagccagaacattggactcatgttctactgtttatttctgtcccaagggaggagaactcatatagaggattccttccagttgctctgtgtgatgctgcatagaggaaggggaacaaatgtgtgtgacaaatgccgcagattttcctacacctttcactggaattccgtctttgtcttacaatagccttagtgctatagattctcaattggtctccagcattatcacagaggaattgtggtccacatattattgttaatttggtgtctttgttggggaaggagagcctgtagcttcctagtctatctatgctgacctgcacttctacttttaaagtgtaactttttcctccaaatctaaagctctgcaatatgctttgtgaatttcaccactcttaccttggatgcactaattttgattatttcagcacatctatttaatcactttaagttgaacaattcctactgatggttatttgctaccaaatcatcctgttcttggtggtgtacctcaagatttctaaaatagattaattcccagagcgttgttctttaagatggactcaaagcttagtctatgtcataaacaggtctttatctgtacatactataaggctatgagtttaaatggataatctttgcagataaaattaactttgttcttaccaaattgcaggattcttaattaaaatactttcatttcattttgtttaataaaaaacattttgactttagccacagctcttctactgtaccataggcattttctgttcagttagcagagaaaaagaggtaagaataatttaagactttttgtagcatgtattaatctattatttgccttttggtctatggataagtgcatatgattttatgttggcttgtaagctcttctttaaagctttatcacaataagaatctaatagattaaaaagaacttttcttccatccttaactatttgaagtgttacgactttacctctccatttcaatttaagcagtctgacaaattttaaattaactaggtacacacctagttactgtagcaaaaatgaaagctgagcatctttctttgctgaaggaatggattattgtcagagtccactgggagttgtgtgaatgagcaattaaacctgttgtctaattgctaacagaaggaatggttaagtatcaattatagaaaaaataaaatcatccctttaggcacactttcctcaggactcagatggataatgctgaacaactctacttaacagtttaagtcatttagttatttgggtggctattttgttctgaatgatctttggaaacccatcaggatgatgtgttgcttaaaaattaagcattttacaaaatcgcatgattgttttatgataggcaaagacatctggtgactcctgctaccaaaatcttctaggatgtggtgttctattccatgttttgtgaagcacaatttgggggttgaacagatgccaaggtaaactttaaaatttttgcaataaaacatcgagtttgtcaactataaatctagaaaataaagcatatagtgatcctttcaatcaataactaggatacctggacttctacagggactttaagttttaattttttgactattttctggctgacacaattgatatccaagagtaaccatctaatgagtgttaaataatttctcccttagataattcactattattctagtaacatgccagatcattagcaagctactatattaacttagcttatgacaatatatttatagtactatgaatattatgcctataatattattacagcctttattgtgtgtcagtataagaaatggccatctatatagagtctcttcattttctagaaaattgtcctccaagataacataattgtttaatttcttttttttttttttttgagagggagtctcactctgtcacccaggctggagtgcagtggcgcaatctcggctcactgcaagctctgcctcccaggttcacaccattctcctgcctcagcctccccagcagctgggactacaggcacccaccaccatgcctggctaatttttttttgtatttttagtagagacggggtttcaccgtgttacccaggatggtctcgatctcctgacctcgtgatcctcctgcctcggcctcccaaagtgctgggattacaggtgtgagccaccgcgcctgcccttaattgcttttcttaaattgaagtttgctcaatacatttttattagagttcagtaccaggacgtagtgctctgtttttggtgtgatggctggaatgttttcttttattgagtagcaacctgttgtatgttatattttgcttagacttcccagaaacccaaagctagttttatgtgcagtcgtttgtcatgttttagactagtcttgtttggtcttttttgatttttttcttcctgtcccttcttaatttttccattttcttttcttttcttggtaagagggcatattttctttttctgtcagtatcttggctactaaaaaatatgtgtgtgtatgtgtgtgtgtgtatatatatatatatatatatatatatgtatatatattttttacagtgagctctcttttatgctattcttatgctatttggaagtgtcataataatattaagctgggtaaattgtataggaagatttatggatgttttaggagtctcaaaggcttatttacagaaggttttggcagattccattgattatgtacatgtgtcatctaggtttttaaattttgaataatcatcatccaattcagaaatgttgagacccatctatttggaaggcatatgttttagctcagtaaacaagtcctggagatttttaaatctagattttaaaaaaaatcttctgtattagtctattttcacactgctatatgggaagcaaggaccttcttcacatagtggcaggagagagaagcacagaggaggaacttccaaacacttatattaataaaaccatcagatctcatgagaactcactcattatcataagaatagcatggggaaaactgccccacatgatccaatcccctccctccctctagatgttgggattacaatccctcccttgatacatgggagttacaatttgagatgagatttgagtggagacagagagctaaaccatatcatcttttcttctgctctcactggtattttaataattcagaccttatctgctagaaatgtttttttcagatgaaggggtttacttatatatgcaagtccacccttccattcctcctcatgcttttctgaagtggttctcaccttaggaaagctatctccttctctcatgagtctactcaagtcttacccatcctttgaaacctaattaattctatcactttctaatgcccatttaggtccaactagcagaaataatgcatttatcatgtcactgatctggcaattaaagcattcaatatcttaggatatttcttactctttttccctgaacttttatctaaattatatactcacatttaatttttacaaacttttgcctggtcttaacctaaatagttagctctttgaatggagggacactattttatttatttatttatttttattattatactttaagttctagggtacatgtgcacaacatgcaggtttgttacataggtatacatgtgtgatgttggtttgctgcacccatctacttgtcgtttacattaggtatttctctgaacactatccctcccccagccccccactccacaacagggcccagtgtgtgatgttccccaccctatgtccatgtgttctcattgttcagctcccacttatgagtgagaacatgtggtgtttggttttctgtccttgtgatattttcctgagaatgctggtttccagcttcatccatgtccctgcaaaggacatgaactcatcctttttatggctgcatagtattccatggcatatatgtgccacattttctttatccagtctatcattgatgggcatttgggtttgttccaagtctttgctattgtgaatagtgccacaataaacatacgtgtgcatgtgtctttatagtagcatgatttataatcctttgggtatatacccagaaatgggattgctgggtcaaatggtatttctagttctagattcttaaggaatggccacactgtcttctacaatggttgaactaatttacactcccaccaacagtgtaaaggcattcctatttctccatcctctccagcacctgttgtttcctgactttttaatgatcaccattctaactggtgtgagatggtatctcattgtgatttttatttgcatttctctgatgatcagtgatgatgagcatgtttttatatgtctgttggctgcataaatgtcttcttttatgaagtgtctgttcatttcctttgcccactttttgatggggttgtttgtttttttcttgtaaatttgtttcagttatttgtagatcctggatatttgccgtttttcagatggatagattgacaaaattttctcccattctgtaggttgcctgttcactctgatgatagtttcttttgccgtgcagaaactctttagtttacttagatcccacttgtcaattttggcttttgttgccattgcttttggtgttttagttatgaagtctttgcccatgcctatatcctgtttaatccatcttgaaataatttttgtataggtctaagaaagggatccagtttcagctttctacatgtggctagccagttttcccagaaccatttattaaatagggaatcctttccccattgcttgtttttgtcaggtttgtcaaagatcagatggctgtagatgtgtggtgttatttctgaggcctctgttctgttctattggtctgtctctctgttttggtaccagtaccatgctgttttggttactgtagccttgtagtccagtttgaagtcaggtagtgtgatgcctccagctttgttctttttgcttaggattgtcctggctatacgagctcttttttggttccctatgatatttaaagtagtttttttccaatgctgtgaagaaagtctttggtagcttcatggggatagcattgagtccataaattaccttgggcagtatggccattttcacaataatgattcttcctacccatgagcatggaatgttcttccatttgtttgtgtgtcctctcttatttccttgagcagtggtttgtagttctccttgaagaggtccttcacatcccttgtaaattgtattcctaggtattttattctctttgcggcaactgtgaatgggagttcactcatgatttggctgtttgtctattattggtgtataggaatgcttgtgatttttgcacattgatcttgtatcctgagactttgcttaagttgcttatcagcttaaggagattttgggctgagacaatggggttttctaaatatataatcatgtcatctgcaaacagagacaatttgacttcctcttttcctaattgaatacctttatttctttctcttgcctgattgccctggccagaacttccaatattattttaacaggagtggtgagagagagcatccttgtcttgtgccggttttcaaagggaatgcttccagtttttgcccattcagtatgatattgtctgtgggtttgtcataaatagctcttattattttgagatatgttccatcaatacctagtttattaagagtttttagcatgaaagacttgaattttgtcaaaggccttttctgcatcttttgagatattcatgtggttttggtcattggttctgtttatgtgatggtttacgtttattgatttgcatatgttgaaccagccttgcattccagggatgaagccaacttgatcatggtggataagctttttgatatgctcctggatttagtttgccagtattttattgaggatttttgtatcaatgttcatcagggatattggcctaaaattctcttttttgttgtgtctctgccaggctttggtatcaggatgatgctgccctcataaagtgagttagggagtgttgtgggaagtcaggaccccaaacggagggactggctggagccacggcagaggaacataaattgtgaagatttcattttaatatggacatctatcagttccccaaattaatatttttataatttcttgcacttgtctttactgcaatctctgaacataaattatgaaggtttcatggacatttatcagtttccaaaattaatacttttataatttcttatccctgtctttaatctcttaatcctgttgtctttgtaagctgagaatgtacatcacctcaggaccactattgtgttaaactgtacaaattgatcgtaaaacatgtgtgtttgaacaatatgaaatcagtgcaccttgaaaaagaacagaataacagcaattttagggaacaagggaagacaatcataaggtctgactgcctgcagggtccggcagaatagagccatatttttcttcttgcagagagcctgtaaacagatgtgcaagtagggaagatattgctgaattcttttcctagcaaggaatgttgataattaagaccctgggaaaggcacgcattcttggggggaggtctataaatggccgctctggcagtgtctgtgttatgcggttgacataaggactgaaagatgccctggtttcctgcagtaccctcaggcttactagggtggggaagaaaccccaccctggtaaatttgaggtctgactggttctctgctctgaaaccctgttttctgttgtttaagatgtttattaagacagtacttgcacagctgaacatagacccttatcaggagtttttgactttgccctttgccttgtgatcttgctttgccctttgccttgtgatctttattggcctcagaagcatgtgatctttgtgacctactccctgttcatacaccccctctgcttttgaaatccttaataaaaacttgctggttttgtggctcaggtgggcatcacacacctaccaatatgtgatgtcacccccagtggcccagctgtaaaattcctctctttgtactctttctctttatttctcagaacaactgacacttagggaaaatagaaagaacctacgttgaaatattgggggtgggttcccctgataagggaggattccagaaggacactattttatactgctttggatctcttcgtattgcctgagtaggttctccacaaatattatttaaaatttaacaatttgctattactctattgagaatgagtttctttgtttgtttgttttctatttagatacagggtctcattctgtcatccaagttggagtgcagtggcatgatcacagctcactgtgaccttgaattgtggacccaagcattcctcctgcttcagcctcctgagtagctaggactacaggcatgcacgaacacacctggctaattattctattttttttgtagagatgaggattttgctatgttgcccaggctggtctagaactcctagcctcaaacagtcctcctgccttggcctcccaaagtgctaggatcacaggcatgagctactgcacctggctgagtattgttgttgttgttttaaacattttatttggtcattttggaaacttaatgtctactacatttatcattatagtttgaaaatctttacatcttttatatagaaaacattatctttttaaaataggaggtttaaaatatttcaacttaagaatatattaaagctaacccatattattaaaatgaaaatgataaaaatatctatgtgaacatggcctgcattttacccaaatgtaatctaacactttttttctttctctgtaggaggcgactaatactaatggagttctagttatatgctaggcactgtggaggcctctttattttattgattccttatcatactctttttggaggtatgctagaagagtctttgacaattctacctctcagactatagggctttctttaccatttgccttgtgatattccttggctgctataagaacacggcactagaaggctcgcttttctatttttcttaatgtatactttaaagattttatcaagtggaggaaacgaaataatgagctattttctgatctttgtatcttccactatggtcatgataattttgacttgcttgtcaccagtaatattttaattaaaaactaagggagccttcctcttattgccccaaactggctggatctcatcattgtcaatcatctcagtttaaaagaaggtgggcagacctgcctgaggggaagtagcaaccaagtcctatttgtagaaactgtttgtaaacaaacactatttttgtctgccttcctagaacggggggcagggtatttatgactcagtatataaaacattttgagggaggaaacttcagccattgctaactaaaaattcaatgtatgtattttttgtgcttattaatgctatcttgaatggaaatgaaaaaagaactttattgaaaaaataacctcatagatatgtctcttaaagttcttaacttttcactcactgttttgtaaaaactaataataatttaggacttgacaaaagcagaatgaaatctccccagactttagccaaaatttccccacgaacagagattcttaaatatctccttttcacacatgagaaacctgatgttcaggagagttaagttacttgcccaatgtctaaggttagaaatggaagttgtgtctgtttctctctactaaggcttagctgccacatctattcatttaaatgctcacaaaccttgatgttcatataaacttcagaattattatatacatttcactttctctccgagtttcacttataatttagcaggttgtactgaaaagcatagaagactaaacaagtaaaatgtgtgttcctaggaatcatagccagtgcctacttatcttttactttttatgactattataagttcatagagatagagaatctaatacacatgtaactacacctctattaattatcacagtgggattgaaagtagtgaaataaagcctaaagcttatttttttcctatgaagaaagcatgtgcattgcttgctgtgttccacatggccaaatacacctgaaaaacaagtatttgaaaacaggaaaacacagtaataattcctgacactgccatctactgtgtgttggaccaatttctctattattaggaaaaccaaggacttggctggaaaccatcccatgtgttggaagggcttgaagaattgaacatctccattagtaagaatcagtttcaatggaaatcagggactggttggaccataaagaattgttggcatgagaaaaatgtttaagtagtttgaacatttgcctgtttcatgcaaaatgaccatgtgtgtgggtttctttatcttatggaattagaaatgagtgaaaagaaaattatactatgaatggaaaaaatgtgaaaacaaaaaaggaaacattttcaatatttgctgggttaaaagtaaaaaactcacacattatggaatctaacttgctatatgtcattggtgcacaatagctagaatttagtatttaaactagtccatgaaaaaagcaatttaccaataatatgaggaaaaagtaaactgagaggagattttatgatttaggagaggttatatgtatagttgtaaatcataagttataacaggaaagatagctataacataaatgagcaaataagcaagacttgagtatatgagaaaagtaactggacatattgcctatcttgcaaaatgtgtgaaccagaattcttggtataatattttaatgagtactctggattctaaagtattctaaccaaattgttattttatagaatatcaaggtatatctttggttaactttgtgttagaattctatgtggatgtcacccattttctggcacctttaatgaaatcttctagactttctttctgtaaaatctcattactctgactattccaatatctatgtacatatgtatgtatgtatgtatatctatctatctatctatctatctatctatctatctatctatctatctatctaatcttctatctatacatccattcatctatcttcatctgccctctatataatctatttatatacatccacacacccacacaaattttgggttaatctatctttcaaactttcactgtctgagcctttaagcatcaaaactgtggcttgccctattgttaaattcactagcccttacgttacttgtcatattatttatttccatttctaaaagctattcctttgggagttataaaggtactcatcttggttaatttttgagtactctgcctttcactaaggaactattctatgaaaaccatcataatcagtttttattattgctattaagtttaaatatttaaccgattttttttttttttttgctctgcactatatgatggatgctagatactcaacagacatggtcactgccctcagttctatgaaagacaatcaggaaaggcttccctaaattagcaaggtgaagtgatagcacctggtatggaggagaagatgaaagcattctaggcagagggaagcaacacaaaatctctactccaggaaagagtgtggcatattctaggaattaagaaacacaatttcttaaagatcaagattgatccctaatgtcactatgagagactgatttatgtaagccagatacaaaacttcatctcattatttcataatcacactcttaagacatgattaaacattttttcccataaactactattattctaaccctcaaatgtcttccatttattaacaattttgacttttggacagttaaacctaagtagaatatcaaggaatataggaataaaatgtttgcattaatatatttgataaagtgatctagaaatattatttttttcttacacatatgaatatgatactacaataaaacatccaaataatgcaaaggtggatatagcacaattggtgattgactcctgtactctttttatcccagcctctgtttctaaaatagggaagagagagctaaagcttcatcttctgggtggtgggtgaggcaggatagagaaatagtagatagtccagtctcaggaagctaggatatggcaggtgggtccttatgtccctttattttcctggcttaatctctccaacttccttaactgggagtttcctggattccctaatgctattctggaagtcccagccaggtattaaagagaaggtagctcagatctagaaataccattatcccttagccacagcccagcttgggagcacccagagattgctgagctcttttagaggcactaccataagttgccccagtagttaggacactgttgcttcttactgttactacttgacttggggccatttctcctctctaatttccctctgaagctgatggccttgtgatatttctgacagttttgagtgagatggaaaatacagataggagaggctcccagagatgaagtcttgatctggaactgagttatgaacttaagctcacttgacttaactgcatttagcacaaaacatttagaacatctacacaaaatagagaatttagagttaataaattaaagcaatactaaaagccatattttttgtactactgaattttaagtactagtctatctgtgaagtataatgtcaaatatactagaaaaagaggacagtggatttgaattttattatatgtacttttttacttctcaaaaagaaaactgactttgaagttcctaattttagttatatttgtggacagcaaaatgatttgaaattctgcctcaccttgttcacagtagattccagtggttcctagaggacagaaacaggtgtatccatgaggtaatgaaatgcaggttgctcctctgctacagtggtgtggagggtcatgttcaggatcacaggtagaaactgtctctgtgcagaatgatcctttccacccagtggtacaattgcagctgtgggttgagagaaagccgcatggtttgagcacttgtttagagatggatacatactatgtattgccctgatgctaacttgtcaattttaactgaagttccaagagatcaaaatgaattgtgattcaaaccctaaattgtcaaaggaaagagttaataactggttataggattactggactccacaccaaagactttaaacgattcagagtgtaaaaattgaaagagaattttttgagaattgtttcttcagacaaaattgcattgtaagtctctctcccaactcccacaccaccacctaaagaaaaagctgtgcatggtgttgctgtctcctaacttcaagcctagtgaaaagagattcagcaggaccacttggagagcttggtgtgtttttccctggcattggcaaactcacaggctcagctcctggggttgccaaaagagctgcaaacatactggagacaagtcaaacgtgagtgaatcccaggaaagggatgttcatagtcaggaacaatagcttgaggacatataaaaatgaatcttgaccaagaggtgtccctctagctaaagatacagtggcagtaagtggtttctggctagagcagaagctgaggggtaatggggaatactcagctgaaagagacaccttgtctgggtttagagagtgatattgggaggagcccagcagaaaactttctgatagacccatcaaaggcagagttgtcagataaaatgcagagcatctagttaaatttaaacataagttaaataataacttttcttagtagaagtatgtcctgatatggtttggctgtgtccccacccaaatctcatcttgaattgtagttggcataatccccatgtgttgtgggagggaccaggtggagaaaattgactcatgggggaggtttcccccatcctgttctcatggtaatgagttagttctcatgagatctgatggttttataaggggcttccttcttcaatgggcgctcattcttctccttcctgccaccatgttaggaaggacatgtttgcttccccttccaccatgatgtaagttttctgaggcctccccagccatgctgaactgtgagtcaattaaacctctttcctttataaattacccagtttcaagtatgtctttattagcagcctgagaacggactaatacatgtcccatgcaatatatgaactttaaataaataatatttgagattttattgttatatcttgttatatatatatatatatatatatatatatatttgataaactgttgtttgtcagggcaccgtgtgtttattttgccccctccggcctccctccctccctcactccctgcctgcctttctccctttctccctttcttccttccctttctctccccaccatccccctttctttcttctgaaaacactacactaaagagtacatgagagaaagggttaacttaaaattcctgtcagagccagagagcaataaaccaccgtgccagtctaaaaagcgcattctagaatgggtatgaggtatagggatcagaatctgttaagctggaggacagcagctgatcacaccttcccagaccttttatttatgtcatagacttttatatgcttgttacacctaaattaatagttgtgcaaaaaacggaaaattgtatagggttctctaaaatggagacaaacaaaatacagaattaatctgctacaaaattgcatattttgaagattatttttgaagatcacaaagagtatagaatgtacaaagacctcatacacaaaaaaggaaatcagtaactaatttcacaaaagaaataaaactatagtaaaaattcttattaaagaatttttaaacgtgatgctgtcattactttttaaagtgacgattgcgccatctagtggttcattttatatctacttgaaaaaagcttaaaattattctcactgccttatagacagagctcacaatggtaaaatattttatttaattcacttacactttattgtatatatttaaggtatatagcatagtgttatgggaataaaacacttgcttggatattaaagtagataaatcacattaagcataatttaatatagatgccaaaatcttatttgaaaaaataacaaatcggagcctcatatagtttgtctcagaatttttaggtctgaaacaattagctatatgtttaatatataattagttattatataattctaatgagaatgattttgtgcaaggtcagatttttctttttgttccttggtttctatagcaccctgtgaaatagagataataaaaaaatttcaagccttcattagttattctctactttgggtgatatttttctaacccttgatgttaattcattaatatttcttcccttaaccacatatactactctgccctgaggaggagtagattttgtagaagtatgtgtgtgaggtgaggtgtctatataatgggcaatgtaaaaacaaaacagaggtaggtatctatttaaagaatgtttattattttttacaggctagctgtctgtgcttatcttaggattgagcatagtattgtgcttgatactgagattctacaacacaggaggctccatttttgacctcatggacttctgtattttggagaaatcagattagtaaggagacaattttaataaaatgggacaagttctaaaatgggtattatggtatcctgtggatgggcatctaagtaattttagtgaattacttagggaaggcttaggaaaggccgccagagtgagatttgcccgtataaatgtatgcactgaaaggaggtgtcaaaggactttgaacagcaggctcaggcagttcaacttttttttttttaaaactatttattaacttttgtgggtacatagtaggtgtacatatttctggggtacatgacatgttttggtataggcaggcaatgtgtgatgatcacatcatggaaaatagggtatccataccctcaagcatttatcctttgtgttacaaacaatccaattatacttccttagttattttaaaatgtacaattaaattattattgactatagtcaccctgttgtgctatccaatactagtccttgctcattcattctcactagttttttgtacccattaaccatccccacctccctgttacctaccaccgttctcagcctctagtgaccatccttctgctctctatctccatgagttcaactgttttgatttttagaacccacaaataagtgagaatatgtgatgtttgcctttctgtgcctggcttcagttcaactttcaagtgacatgacaggtgtatagaaaatgacacaaatgaggaggcacattttaagaatattgatctgttatgtgtaggatgactgcatagtgtaacaataagctctctggtgacgtaattttaatcttagtgagatcttagcatattttttttgctactagaaaaggggccagcaacctttttctgtaaagggcaaggcagtttacagttttgctttgtgggccatatagacactgttgcaataaccgaactctgccattgttgaaagcagccacagaaaacacacaaatgggtgtggctgtattccaatgaattttagttacacaaataggtggtaggccagatttggcccatctaccatagttttctgaccccggcactctagaccattaattccgtaagagcagagatagggtctgttttgttttttattattgtctcaaggccccaaacagttcttggtttattgtaagttttcattgactattcatggaataaacacacaaatgaataaatataataggtcatggctgggataagaaagcagatggaggcaaaagtcctgaataggaaaattgctgtggggatgcagaggttgaagtagatgtgagaggcattttcaaggctttggtaagtgtgttagtatgaaagaggaaaaattatagtaatgacaaacattatttgtcacttaccatgtgccaggcagtcttctaacctttctagtttctctattatgttataagaagggtactagcatcatcctcatttttcagagaaggaatctaaggaagagagaggttaagtctgctaatgagcgaggaaatccaccttttagtcaccattttatgtctctcaatcctgtggaaatgttgggaccatgaaagagtatggtgttgttagtgaaatagggacaactggatagcaatatagtaaagggaaaacataaagaatccacttttataagctttattcctgggatggagactggttcaacatacacaaattgataaatttgattcaccacataaatagaattaaaagcaaaaaccatatcatgtcctcaatagatgcagaaaagactttgataaaattcaactttcttttgtgttaaaaaccctcaacaattaggcattgaaggaacatacttcaaaataatgagagcagtctatgacaaatccacagcccaacatcatcctgaacgggtgaaagatcgaaccattccccttgagaactgcaacaagacaaggatgcccactctcaccactcctattcaacacagtaatggaagtgctagcccaagcaatcaggcaagagaaagaagaaaagatatccagatagaaagagaggaattcaagctatctctccttgcagatgatactattctatactgagaaaatcccatggcctctgccaaaaggctcttagaactcataaataacttcagtaaaatttcagaatataaaatcgctgtacaaaaatcagtagcatgcctatacaccaattacatccaaggtgagaaccaaagcaagaatgaaatcccatttacagtagccacaaaaagaataaagtacctaggaatacggaaccaaggaggtgaaagatctttacaatgagaattacaaaacactgataaaggaaatcagagataacacaaacaaatgaaaaaagatttcctgctcatggaaaggaagaatcaatatggttaaaatggctatactgacaaaaacaatttacagattcaatgttattcctatcaaactaccaacataatttttcacagaattaaaatattctaaaattcatatggaaacaaaaaagaggctaaatagctgaaatgatcctaagcaaaaagaacaaggccggagacatcacactccctaacttcaaactatactacaagcctacagtaaccaaaatagcatggcactggtgcagaaacagacacacagaccaatggaactggacagagaacatagaaataaagtcatacacctaaaagcacctgatcttcaacaaagtcaatgataacaagcactggggaaagggcttcctattcgataaatggtgctgggataactggctagccatatgcagaagactgaaactggaccccttcccttcattatatatgttatgaaaattaactcaatatggactaaagactttaagatctaaacctataaaaaccctagaagaaaacctaggaaataccattctggacatcaggcttggtaaagaatttacgactaagtccccagaagcaatttccataaaaacaaaaattgacaagtgggacctaattaaaccaaagagcttctgcacagcaaaagaaactatcaacagagtaaacagacaacctacaaaatgggagaaaatattcacacactacacaacaaaaaaggtctaatgtccagaatctataaggaacttaaacaattcaacaagcagaaaacagacaaccccattaaaaaaatgggcaaatgacatgaacagacacttctcaaaagaagacatacatgaaatcaacaaatagattaagtaatgctcaacatcactaatcgttagagaaatgcaaatcaaaaccacaatgagaaaccaactcacaccaatcagaatggctattataaaatgtaaaaaaaatgacagccattggtgaggttgcaatgaaaagggcacacttacacattgctagtgggaatgtaaattacttcagccattgtggaaagcagtgtggagatttcttaaagaacttagaacgaccattcaacccagcaataccattactggctatatacccaaaggaatataaatcattctatcaaaaagacatatgcatttgtatgttaaccgcagcactatacacaatagcaaagacatggaatcaacctagatgcccatcaacagggtactggataaagagaatgtggtacatatataccatggaatactacacagccattgaaaaaatgaaatcatgtcctttgaagaaacatgaatgcagctggaggccattatcttaagcaaactaacataggaacagaaaaccaaatactgcatattctcatttataagtaggagctgaacaatgagtacatatggacacaaacaaatgggaacgataggcactggggactacttgatgtaggaaggtgggagggaatgtggggtgaaaaactacctattgggtactatgctcactatctgggtgatggaattatttgtacaccaaacctcggcaacacacacttacgtaacaaacctgcacatggacaccctgaacctaaaagaaaagttgaaaaaaaccccacttttagctagactgcattgaaggtaagagtaggtgataaaatagcttttttttttctataagcatctagggacatggctcataaatttgatgatagttcaggacataaggcagatttaattaaatagactagcaggcaaagagctgggacacatgcacctggcatacaatacctaagactacttaaattatactgaggaatcattaacattatacagagcactgttttcttatttcaagaccattcaaaaaatgttatgtatccttaattgtcagtacaaggaaaaatttgtgggttcttctgtctccaaacataaacagatgatagcagagaataaaatgttaaacactttggaaatgtgattaatagctcatcatgatagtaaatcaagagatgaatattagagtatgttcttactaatatagttaattattttacttctgtgcatttagaatgaaactcatttgaattcctaaattgcagataaattgtttagttctgaccgtcaattttatagcttagaacttctatgggttaatttttcctcattactatagaaattcaacatgaagattttaattttcttgtacttaggcaagtctaagactgtaagagtttagtatgaacatggatataaaaaattaactgaaaatgagataatagaagatttaatgttttttgttaaatatcattcacttactaaacattaccaaagagggaatatagagcagcattgtacttcgttaccaaggtgagtacaaaatagaaaacatggtcttgttccccaccctgaggacttgctactttatttagaataatgtatttgtatgaaatatatgatatatataaaatataatattcagtttcttagggctttaccttagtgccaggcaccattttaagtactttgatgtagtacttaatcaaagtttaatcaccatataaaacctacaaagtaaatactattattagctctcagattgcagatgagaagctaatacagaaaaatataatctctgcttagcctactttttcagcttacctatcaaatatggattttgatgctttggacaagagagattcttatgtatatgttgaggctgagataagaacagagaatgaaagttattggagaaaatttaccttgagctggatctgtaaaaaagttctggttatagatttgtgggttttctatgcataagcaaaagcacagacacaaaatctatgtggtgtgatgataaagtcaaatgaataatataataaacgcatgtaatttagcaatgggcgatcacacgacctaaaggaatctagttctgcatatataacttatttctctgctctttaaagaaaaaggaaaacatagctgaattatcttctcaggtcatctcctgtgtggatgacttaattcatataaaattgctttcctttatggcttatttccatttgagtaacaagttgggggaataaggtaagtgtgatatgatgtataacattttacctgccaaaatttgctggattttaaatgacatgctcaaaatttgaagtctttgaagaatatacaatcaagtgttaaaacaaatgaacctcatcgtacactggaatgtgatggcatattgaaactcgacatgtttactaggacgggttgctataataatcactccacctgctgacattcccctatggccttcctttctttgctggtgagatactcacctaggtccttggtgatacctcacagagtgtaagaaggatgagatgaaatgactctttacatactaatgaaaatactggcagttgtctgtaggccttattttgtagttcttcaggtttaagggcttgaacactgtagtatgttaacagttgcactcagaattcctattaaggagagaactgtctttgggaaactacatgagctgcttggagtagacagtggaccctggttgcattgggatgaacatgagcctggactacaaaataagatgataaattactctgcctgagaccaggagggacttgtggtttgttttaacctacagatcagttggaaaaaagcaaagcaaaggacagaagacaaaaactggagtggaattgccatgtatttactgcagtggtggggtgaccaaaagacaagttggaagttatttaggtggccatgatataaacctcttccttcaacattgtcacctctccccaccccctgcaccaatctaaacaatctgatctaaaaatgtaaatggctttgttaatttgatagaaattaaagaagttgattgtagcttttaggcatctgtgatatggaatacacagtatgggtgaaagactggtgagctagagatgactttagaagataaacattccttttggaatcttcacaatttatgtagatgtcaagggtctggtagaaagtaactgacatctgagttataaaaagaccacgagagaaaagaggttactcttaagccacagtgtagggaggcttgatgaaaatccacagtgaattcttacctctgactcttattttccagctacttaaataataaagaaacaaaaaatgtgagcttattttaaaatctacactcttcaaataagttttccatattttctgactatggaaagataattttctgaaaatgtctcatctttggccagtgggagtctctttaagtaggctcctgttgtcttttaatataaccatagttgtctttgttaacattcttgcttttaggcataaaaagatatctaggcttatgtattttctgtcctagagctgagtgtacaattctccaagaagtcttggttcattttagtggaaaatggtatttggagatgacaattttggcactagaagtgttcattgatactgagttattgtttctaaatctttttagcagatatagctgggaaattttttaaaaaaaaagaaagatttttttttttgaggtggagtcttgctctgttgcccaggctggagtgcaatggcacaatcttggctcactgcagcctctgcctcctgggttcaagtgattctccctcctcagcctcctgagtagaaagttaagtaatgagttcatacattaattccagttcatattaaggattagaatgatttttacttctttgattttatgcctagatctctttcatgctgaaaattctagttcctaatgattaatgttaatataattgttcatttggtttatatatatctatgtgttatataaatataatgctatttgggtatttttatatatagttttaaaataacaatatcaatgttaccactaacatcaagactacaggatgcaatagaatctctttatggttctttttgtctttaggctataatctactgtatagtcaaaatattgtgttttaaaatcaattgaactaaatcttttctgcttggttatgctaccaacttgaagtacagttcatttcctaatttttcttcagtatttaaaaattggtctttttcatttttaattgaccatgtgaaacattttacctggttccaaataaaaactgtaaagcaaattatagttagaaagtctagcttttatccttttactacttcttgttttctcccttaccctatagataactatttataaattgtgtgtgtgtaatcttgcatttttttcttagaaaaatatgagcatatttgtatgtgtatctatatttatgtatttatatctgtttatctatatctattatccccttttcttacatgtttctttaccctgatttttttcacttaataagtcctgaggatcactccatagcaacatataaaaggtcttttttttatgtatgtgaagtcctccattatataaacattccttagctttttcaacaagatacctagtgatgaacatttgagcagtttccagtctttgttttaacaaatagagaaattagtttgctctaatacataatagtgtctgattctctacagcctcactaatagattagtcatatttttagctttttgccaacctcataggtgagaaaaattatctacctcaaattggaatctctaaaagacagagttaaaggtaattccaaggaagtagggagtactctctcaaggaagcaacagtgagagaaaagcaaagggaggaggaaaaaaggagaaccagtacaaggtaatgagttaccaagctggccatagcttcacaagaaactcagctgattgcttggtaaggagaggcggtttcttggaaggcgggatagagtagtacaattaatttgattgcaatgcagagagaaaaagaatagcaggaataggcaggttgataacagtcatgtatagcttgacaacagattaaaaatttacattttgctgcattggcagtggaaaaccaggaaacattttgagcaggaaaatgattaagagcaaagaggattttaggaagattcaacctggattaaggttaggagtgtttagggaacaggtcactagttggaaaacaattacatgtccagatgaggagtaatagaagactgaattaagcattgttggacaaaatatataaaagaagacagtctgagcaaaggatgcttaatttgggaactttggcagaccttagagaatctattattgggttctaggggtttgtaaacctctaaaatgataagcacatttttgtgttccaagtatgttcagtttttaggagaaagggtttttggctttgacctgatgctcaaaggcatttataagacaaaaaataattaggaaatcctgaatcaatgagattttgtgatcactgatagatttatgttgtaaataagcctcatttatgaacttaatctttgatgcattttacatttttacaaccacattcttccaactcctattgtacttattgtctgtgccactcattttaacatctaacttgtttttgtaagttttgtttttcctacactgcttttctttttttttttcagatggagttcccctcttgtcatccaggctggagtgcagtggtgcgatctcagctctctgcaccttctgcctcccaggttcaagcgattctcctgcctcagcctcccaggtagctgggattacaggcacccaccaccacactggctaatttttgtattttttagtagagatggggttttgccatgttgaccaggctggtcttgaactcctgacctcaggtgatccacccatctcggcctcccaaagtgctgggattacaggcatgagccacgatgacagggctacactgtgtttttcttaaagggacacatctgcatattgtcctcagtcacaggttactatacaacatggtgactatggttagtaacaatgtcttgtgttttgaaaattgctgagagtagattttaaatattccaatcagaaaaaattataaatatgtgaggtaatgcatatgttaattagctcatttgagccattccacaatgtatatatattttgaaacatcatgttctacatgataaatatatccaatttttatttgtcaattaagaaaataaaggaaaaaagtaccacttaaataaaacttgcttaaaaacacctattaagctagacatggtggaagaaattggcaaaaatgtaaaatatctttcttctcactaaacatttttagtttggaatcaaatagccatttaattaaagcattttatttacctaaaaaaaaaaaaaaagacacctaccaagcacatacacacatagaactaagaactaaacccattttttgtttttcacttaaaaattttgttttaatgtaaccttttttcttttttatccttggctactaagaacagaaatagttttacatttctttgttgcatcagaactcatcccaggagcataaaggcctgaaatgaactctgccttatgatactcacatttgagaaattccattagaacacagatggatctgtgtgtggtgatgaactcggagcaggagagaagggctttcatcacttcaccagggtcctgaacacactggaaaccttatcaggccccatctctctccttacttggaataagactttcccttatgtaccaaaacaatgcctcccatctcagctaagaggaagggagctaaagggagcattttgagttgttgttttaaatttataacattaaactgttcattgttaagaccctttgatcagctttgaggttttccttttacaattgattctaaacaccataaaattggtgcttctgtgttggtacttgcctcttgagcatttaacaaatatttcataaggtgtgttagttatttttcaggaaaagattaaactttagctttgagctgtctataaggctacctagaaattcaatttaatattaccctgcttcagttgaaaaataaagtttagagccatataaaattaagaatctgtaactaggataagtacagaaataaacttcttaaacacttttgaaaagtatattacaaagcacaatttttttttctttaaaggaggtattcttatattgagattagaaaagaattgtttaaaactgtcaaaaggaataaaattctttaaactgctgctgccactggatctgaatgtctgtgaatgggagacttaatatttttgaacagctttattgaggtataatttacttaccataaaattcacttgttttaagttcagggatctgtaaatttaatgttattaaatgatggtcacaagagctacttctggctctgtagtatatcttcatagttagtaattattttgtaattatgtcaataagaggatccccaaactggtcacaattttgataagaaaaatttttagaatcctgtaaggaaatttgtcagatgtatctttccccctgtacattattgcttgtctatttgttactcaaatttaggccctcatgtttgagatactgcattccacccacacggcaatctatgaaatccccaggatatgtgttataaagaaaggtattttcaatttggagaaaatacaatgtgccaactgaagataatttcaacgttattttttaaaattaagatgaaatgaacaggttacaaccagtaaataaagagcgacttaacactcttgttacctcattaaaattatttgctgtttttaagttcatttcttgctatttagattctggagagaatcttgaccctcgaaatggaagatctgattttgggtcctgctgtactactcacagggtgctcatacatcctctcgaattactcacagtctctggggcttattttccccctataatattggaattaggatactggcattgagtaatttagagggttttagtgaggagcaatggaaataatattttaaaaaatgctttgttacacacaaagtcctgtgcaattgtaaggtattacgtttaatatcggaactcaataaaatttctatattaatcaaaataatctgcaaatggttctaagtacctatctatacttggcactatatattccaagataaatatatatggctcttaggttcaaactgttaggctgtttggtccacatggaataacgtagggtggggatggattccccaccttcaccttcaacttcatatgctttcctattgcaactttctagatccctgtttattatcacataaaaaaacccccaaaatacttagtagtaacccctgaagaatgactacaactctttagataaagtgaagtaaacgtgtgcttctaattaagtttagttgtagagcaaattagagtgcatactttgtaaagcaatctaaaggtttcattaaaaattgtagagaagtaatgataaaattatagtggtaaagctaatgccaaaagttattgctctgtgatggtggcatcccaagccttacattttgtcctcaggaattccatgggttgagtcaaactatacattttttttctccacaaattttactgtgactagcagttgtttgagctttgcttttgatcattttctagtgaggaggtggaggggatttgttcagggagagtaagagattcactcatgtcttttaaaactatgctttcttcagggtaggctctgtctttcaggagaaactctgacactcctctttcccagctgctttgcagggagccggtgttcctggtgaacactgtgtcctgtgaggagcattttgacaaatctctctttagctgtcttatacatgtatgagacataagaaatttatgagtagctagagtgtaagaaattaaatgacatagtgcttacttccactttctttagcatattcccagaacccctcatatactacttttgcatagacgagatgctcagcaaaaggagtaattaatataaaaacattctcctttcttttttccttctcactcaatgggtccacgttggtttcatactaaagtagttcagaagtcaaattgtgtagctttactattgccctttctaaaggggctcaaacctacatatgaaagcaaatcccaatatgtaagcctttgtgtggttaacatttctgtctactctctcaatagtatggatttaagtgatatttttcatggtgcctggaatgagatgtagtgattcactgtcattgtttcacagaactaagatggcataaatgctgtgctgatcctatttttagttgccttcacctgtcctcccatcatgtaacaagtctacataagaacattttaaatatgtgcatctgtttgtgttcctagtttgtacaagtggaatgacagagtggagtaccagttagagtgcaaacaacctgctactttcattcctaataacgtcatacttactaaacactagttccactctctatgcatgtcccaccattgccacatttcattaaactgcagggagaagcatgacactggccaacactgcgtccagcatttgggtggccctcaggatttcccagtcctctgaaatggccatccttctcagtgcgaacttgaagagtgaaaatacagccttgaagaaatgcaaaaacacttcgtgttaacaaacagaagaaatagaaaaaacaagaagaaggttatttttcatttttaaagtagaagtttttcaaaataaagtaatacatgtaaattttaaaagaaatataagaatacagaaatgcgcagagaaatttttttttaaaagtcattcatgatatcatttcacagcagacaactattaacattttggtgtgtgtgtgtgtgtggtattttttctatgcttagtcatattttcttttaaacaaaaatgcaatctgcactaagctgtagaaaatataatattataccaaaaagttgaacatcataaataacattaacttttttcttgtagcattaactatttttaagtgatggcatattttcttatatcaaaatatatttaataaacctataattattataccattgacttatttatactttttgctattagaaataaaattgtaatgaatatcttatgtgtatatctttgtccatttaaattatttttagtacatatttctagaagtagaattactaggggaaaagatatagatgctttgaagtatgcctaagtgtcccccatagatcacaactggactcaggagactgggatacccctttcttcacaggcactaccatgcctgggattaccattccatttcatttttacatgcgatagctaataaaatactattttaccgtttttggttgggtatcaaaaatcttttaacaaatttattggtcattcataatttatattataatttgtatttatagtatataaagagagtctccttatataatgaggacattagctatttgtaatatacggtaaataaactttctccagtttaatatttaccactcaattttgctatggtagttttttttttttttaggtaaagaagtttatgtttatgttgtcacatttttctcttttttctttcagagattttgcctttctatacatctttagaaagaacttctcggccgggaacggtggctcatgcctgtaatcccagcactttgggaggccgaggcgggtggatcacgaggtcaggagattgagaccatcctggctaacatggtgaaaccccatctctattaaaaatacaattagccgggcgtggtggcgggtgcctgtagtcccagctactcgggaggctgaggcaggagaattgtgtgaactccagaggcagagcttgaagtgagctgagatcgcgccactgcactccagcctgggcaacagagcgagagtctgtttcaaaaaaaaaaaaaccaaacaaacaaaaataacttttctaccccaagattggataaatatatgtaaataaaaaggacagttcagtgaaaaatttgaaatgaaagtgtttgaaatcctgaaatgtattgtaattttactcagctcctttagcagttacttatagtttatttgcaaagttctttcaaataaatgggaacatcaaccagaaataaggtctttaaaatgataaaataaaggcaagattgaattttattttcaaaacttttttttggaggcataaaaagctttctttttcttttttttgtcattgttatactttaagttctagggtacatgtgcataccttgcaggtttgttatactgtatacatgtgccatgttggtgtgctgcacccattaactcgtcatttacattaggtattcctcctgatgctatccctccgcactcccccgaccccatgacaggccccagtgtgtgatgttccccaccctgtgtccaagtgttctcattgttcaattcccacctatgagtgagaacatgcagtgtttggttttctgtccttgggatagtatgctcagaatgatggtttacagcttcatccatgtccctacaaaggacatgaactcatccttttttatggctgcatagtattccatggtgtatatgtgccacattttcttaatccagtctatcattgatgggcatttgggttggttccaagtctttgctattgtgaatagtgctgcaataaacatacgtgtgcatgtgtctttatagcagcatgttttataatcctttaggtatatgcccagtaatgggatcgctgggtcaaatggtatttctagttctagatccttgaggaatccactcactgtcttccacaatggttgaactagtttacagtaccgccaacagtgtaaaagtgttcctatttctccacatcctctccagcacctgttgtttcctgattttttaatgatcggcattctaactgatgtgagatggtatctcattgtggttttgatttgcatttctctgatggccactgatgatgagcattttttcatgtgtctgttggttgcataaatgtcttcttttgagaagtgtctgttcatatcctttgcccagtttttgatagggttgtttgattttttcttgtaaatttgtttaagttttttgtagattctggatattagccttttgtcagatgggtagattgcaaaaattttctcccattctgtaggttgcctgttcactctgatggtagtttcttttgctgtgcagaagctctttagtttaattagatcccatttgtcaattttggcttttgttgccattgcttttgatgttttagacatgaagtccttgcctatgcctatgtcctgaatggtattgcctagattttcttctagggtttttatggttttaggtctaacatttaagtcttcaatccatcttgaattaatttttgtataaggtgtaaggaaggaatccagtttcagctttctacatatgactagccagttttcccagaaccatttattaagtagggaatcctttcccaatttcttgtttttatcagatttgtcaaagatcagatggttgtagatgtgtgctattatttctgaaggctctgttcttttccattggtctatatctctgttttggtagcagtaccatgctgttttggttactgtagccttgtagtatagtttgaagtcacgtagcgtgatgcctccaggtttgtcctttttgcttaggattgtctgggcaatatgggctcttttttggttccatatgaactttaaagtagttttttccaattttgtgaagaaagtcattggtagcttgatggggatgacattaaatctataaattaccttgggcagtatggccattttcatgatattgattcttcctgtccatgagcatggaatgttcttccatttgtttgtgtcctcttttatttcattgagcagtggtttgtagttctccttgaagaggtccttcacatcccttgtaagttggattcctaggtattttactctctttgaagcaattgtgaatgggagttcactcatgatttggctctctgtttgtctgttattggtgtataggaatgcttgtgatttttgcacattaattttgtatcctgagactttgctgaagttgcttatcagcttaaggagattttgggctgagacaatggggttttctaaatatacaatcatgtcatctgcaaacagggacaatcttacttcctcttttccttattgaattccctttctttcttcctcctgcctgattgccctagccagaacttccaacagtatgttgaatgggagtggtgagagagggcatccctatcttgtgccggttttcaaaggggatcctttcagtttttgcccattcagtatgatattggctgtgggtttgtcataaatagctcttattattttgagatacatcccatcaatacctagtttattgagagtttttatcatgaagagctgttgaattttgttaaaagccttttctgcatctattgagataaccatgtggtttttgtttgtggttctgtttatatgatggattacatttattgatttgtgtatgttgaactagccttgcatcccagggatgaagccaacttgatcatggtggataagctttttgatgtgctgctggattcagtttgccagtattttattgaggatttttgcattgatgtttatcaaggatattggtctaaaattctctttttgtgttgtttctctgccaggctttggtatcaggatgatgctgccctcataaaatgaattagggaagattccctctttttctattgattggaatagtttcagaaggaatggtgccagctcctctttgtacctctggtggaattcagctgtgaatctgtctggtcctggacttttttgggttggtaggctattaattattgcctcaatttcagagcctgttattggtctattcagggattcaacttcttcctgctttagtcttgggaggatatatgtgtccaggaatttatccatttcttctaacttttctagtttatttgtgtagaggtgtttatagtattcgctgatggtagttggtatttctgtgggatcggtggtgatatcgccttcatcattttttattgcatctatttgattcttctctcttttcttctttattagtcttgctagcagtctatccattttgttgatcttttcaaaaaaccagcttctggattcattgattttttgaaggggtttttgtgtctctatctccttcagttctgctctgatcttagttatttattgccttctgctagtgtttgaatgtgtttgctcttgcttctctagttcttttaattgtgttgttagggtgtcaattttagatctttcctgctttctcttgttggcatttagccaaccatttgactgactaggtaccaaataagtaatagcttttttttttaaactgcagtatagctttttttttttttatcctgggtttctaaattattgcagtaaactgattacattttcccatatgggctcttctttgaagaatctcatatgattaaaaaaaggagagagaaaaaaattgaactcacaagaaaccgaaagtactgaccgtgttggctatttttagatgagaataactctcatttacagggttgttaataaatctgaatctatctcatgtccactctattcagagtagtaaatatttaataacctccatatcaatgagcagtagttgctgtaacactagaagcttatttcctgttcatgtaaagtccaaagggtggttagggttggcatccaggtgagttggcaaacagagtacaggactgtgcagaagattttcataggcaaggcctggaagtagcaactattacacctgctgacatctcactggccagaactcaggcacatggtcatgcatagctgtaagagagtctgggaaagatctggtggtaacaacatgtcacaagcatgtattatgtgaaagcaccattccaggtgctgtggagatctgttatcagtaaaaactaaaaatcctattctccagaagcttactaaattctaaattaagacatacattctctaggtatataattatattaggtatgaaatgctaagtgggaaaagacttggtgctccaaagacttcagaaagagctcactctcaatgagtgagctcagagagtgggctctcattgaggaggtgtgatttgagcttgctttccaggcaaatggaatttgaagaggtggagaatgctgatttaagcacgggccctgaggcagggaaaataagacatacagagaggcagtggctagatatagtgatagttgattttatgtgccaacctgacttggccatggggtgcccagatacttggtcaaatattgtgtgtgtgtgtgtgtgttaggatgagattaacacttgaattgataaactgggtaaagcagattgccctccctaatgtgggtgggcctcattcaatcactgaagacctaaatggaacaaaaaagagggaattcttcctgcctgattacttgagctgggacattggtcttttccagccttcgtacttggactgaaacattggcttttcttgggtcttgagcctgatggctttcagactggaactcacaccacttgctctccttgttcttagggtttcagactcaggctggagctacacatcaattatcctgggtctccaggttgctgactgtggattttgggacttctcagcttccataatcatgtgacccaattccttattaaaaatctctctctctctctctctgtgcacacctgattggttctgtttctctggagatgcctgactaatacagatagattttattgaattaaaaaatcagtggaagcgagttaagtatagaaaaaatacatgggttttggaatgtcaggggtgttagtccattctcacattgctgtaacttactacctgaaactgggtaatttataaagaaaagagatttaattggctcatggtttcacaggccatgcaggaaccatggctggggaggtctcaggaaacttacagtcatgatggaaggtgaagaggaaggaggtatgtcttacatggctggagcaggaggaaaagagtgaaggggggtgatacacactattaaacaaccagatctcatgagaacgcactatcacaagaacagcaagggggaaatctacccccatgatccaaacacctcccacttggcccctcctccagcactggagatcacaatttgacatgacatttgggcaggaacacaaatccaaaccatatcaccatgtaaaaaattcagttattattctagagttgacagggtgtctgttgcgttctagagcaggaaaatggtataattcattagcatggcaatagggttatgatgtgtcagttaatcagggaagggtgagtagtcaaagatgacagtaagcctgtcattctaacttcagttgcatcagaatcacctgaagagctcattaaaatacatattactgggccccattccctgagtttctggttcaattacaatttgcatctctaacaaacttcccagtgatgctgatattgctgacccagggaccacattttgagaaccactgtacaaaggattcaaacaagtattagagggactggtagcaatagtaaaagaaataagtaaagaagtatattcagaaaaggcatttgtggtgaagatgagatgtttcacttcagttattctgcttctatagctgcctttagcacaattaacagctcagcaagattatctacaggcaacagaacttctagtgaaaggacccagcttattttcacttgtggcctaaccagttttacttgtttcttccccttattcctcctttcccttcttccatatcttcttgtcttccttccttcattccgtgcccagtctgagaccaccattcatgagcctcattctgagaactctgcagctttgtagcagatgcaactttggaaagcagaggagaggagaactgatcttattagggcagataaaacagtaaggcacagcgtatttggcagatgtagattatttaaggtggttagtctcaatacctttatgagcattaaaggtcatagaaaaaataatggttcattataagccattttttagaacaaaaacaaatgtgctttattagcagtaaggatttatattttagatcacgaactttggattagagttatttatcaagagtttataggaatcggctgggcacggtggctcaagcctgcaatcccagcactttgggaggccgaggcaggcggatggcttgagcccaggatttcaagaccatcctgggcaacctggaaaatccctgtctctaataaaaatacaaaaattaactgggtgtgatgatgcagttctcaagttcatggatagtaggccagacctggttgagtgactgagaacactataagaacagacctttgaccaagtaccctgggactaggatctaccaaaaagctatcttcaccaaatgaattgttattacaatttaaagcatgtctttattttataactctactacaatataaatcagctttgtaaggatatgttagctgggtttagtggctcagctacatgagaggctaaggtgggaggattgattgagccctggagatgaaggttgcagtgagctgagatggcaccactgtactccagccttgatgacacagcgagactcaaaaaaaaaaaaaaaaaaaggtaaagtaaaataaaaataaagagtttataaaaatgtaaaagcctagatcagataatattttattgcattatttaattgtaattctaaggacaaatgtgatatccttactccaactattaaattctttcagaaaattccatttgctttgcttcgttatgattaattaatgtggtggcttccacatcattctcagcaaattaacccaggaacagaaaatgaaacacctcatgttctcactcataagtgggagttgaacaatgaaaatgcacggacacagggaggggaacatcacataccggggcctgtcaaggggtggggggcaaggggagggagagccttaggacaaatacctaatgcatgcagggcttaaaacctagatgatgggttgatgagtgtagcaaaccaccatgacacatgtatactatgtaacaaacctgcacattctgcacttgtatcctagaacttaaagttaaaaaaaaaaagagataatttaaaaaatatatggtggcttccaaatctgggaggcttgttaaaatgcaaatttttagatcccactgtaaagatttcaattcaatagttcttgggtagggttcagaaatctgtgtttttaagaagttatcctatattattcttcagaaccagtagagatcagctttgggaaccatggatttatggtacagttgcaatttggttgtcctggtaagttggtaacaatacgccatgatttataataaatagtaaatgctagtttagagtggagggaaggcagacattaagagaggatccaagagaagaatgataaaattaggggatctcaaggtcctgaattttctataagactgtggcataagtggcaatttccaagaagacttgcccaagattcccatactcactaaagactgtggcagttgacatacttccaggagtgtgcaatcttaatgtttctgtaagagaaagggccagctctgtgtgtgctgatctcatttgaacacggaactatttgaacacaggaagacagactgtggcaataagattgctcacccaagcacaatgttgtccttaatcctcttggcttgctctggcctctgtgggctaccccttggtggtatggatgggttgactgcagtctgtctcttgccttttgaacttcaaagttagatggactttcaatttttactgtgactctttgaagtctaccctgctcagcctattttaaaaagcaccctgtataaacaattacccataatcctgattcctttaaatcatgctctccatttcccttttcccattgaacttatcacattatatgactatataattaactaattacatttagtgtttatctctccaactagttataagtgcagaaatctttgatttgttcattaaaacatcctaaacatctagtacatatgtagtaagtggtcaataaatagtaaatgaggctgggcatggcctgtaatcccagcactttgggaggccaaggcaggcggatcacctgaggtcgggagttcgagaccagcctgaccaacatggagaaacctcatctcctaaaaatgcaaaattagctgggcgtggttgtgcatgcctgtaatcccagctactagggaggctgaggcaggagaatcacttgaacccaggaggcagaggttgtggtgagcccagattgcatcattgcactccagcctgggcaacaagagcgaaactccatctaaaaaaaaaatagtaaatgaatgtttctgattaaaatcaaactttgttcaagtctgaaagcaatccatatagctggtttgggaaatagaagtatactctttaaaatatttttttccctcaacatttgaaataagtaggtataatataaaaaatgtccatgccttaccttgaaaaccatttttaaaatctgctccatttggtaagagatctggagtgtattcactgtagccacctacataaaactgactgaagacattgagaccaaccagtcttcctggggcgataatggatttatttttatgatcatctaccttcgaaagggaaaaaaaacctattaaaaaaggaattaattccccagggtgaaatgttaagatactcttttgttatttcccattaacttggcatgaaaaatttacaaagacctgaattttgaagaaataacatgataccactcaattctctgcttctctgctggtgtctgttaccagggatatattaatatagcagtcatggttttgcatttcaatcaaaatcaaagttcttcaaagattaggtgctggcatcctgctgattcccctccatttagccttcctcctctgctatcaattctccatagaaccaccagagtcctttatcaaaaattagaaatcaacatggtacccaccttcctaagtagctcttcatagttctttagataaaaatataaacttcttagcacatctaagccctttgataatatagaccttatctgtctctaaccacttctctagctcccccatcccccaacctaaaaaccatgctgaactacttgcattccttaagctaatactggccattgttctctttcttaactcctatttgaagttacgctcaagcatcaccttctctgggaagcactttctgaatcctctctctcacccttatctgtgttagtaatccctcttatttgttctcacaccacttaattgtaatcatctctctattcccctagttggtacaatagtctgtgaacttcgtggatgtaggcatcatgggctattcacctctgtatcttagcacagatctgacaatatactagtgctctcagtttgtggaagtgacgaaggaatgactctttaccttcagccagccctcttggaagaacttgcccagatgaacagtgtggactccaaggctcagattgaggggctcgctcctgatgcttgctatgccagaccccaggttataactataaaccacactgccattgagcaggcccacagccaggaagtcatcgccattcaaccctggaatgagaagacacatggggaatgctcactgagaggaaattcaggagttccgtcagctttattttactgactggttctgaattacagatcagtatggtaagttataatacatatttagtctctagtcagcatttaggtatatgtgcaactggctgttgttattcccagccccagaaacagagcaccaagagtttatgtctttgaagccatgagggttctggtcaacctggggaatgatcaatgatcaactaaaaagttgaatgggattaaaatctccttttgtcggagtgaaattcagtgtgcactttacaataaggagaacttcacaatggagtagaattgctccggtagctaacgagattcaaaaggctgagatgacctagcatcagctttgaagttctttctatgatttgagaataggataaagaccaatttattcctatgattgctaagaatatgttatcattattctattacaaaagctcttaaccatgccccatgaccatttaaaggtggattgtttctgtgttccctcttctctctctccttccattagttcagagccatccatgcagtacagtgagttccaggacccagaacactcaggagacagttcttaaagacccacgggacaaaggaagtggttgggagtgacccagcattaatcactaggggaaggtgctagcagtatccttggcgggattaagaagttctgggatgatccatcagtatatagcaagagatctgttcacaggaagcagagacccaaatacgtcacccagcttctgaaaggtgtgttagtgggtggggcaaaagaagaattcaatactgaggctagcagtcaggaaactgaggcaaagacttctgcttagaggaagaacgtaagaaccccctagaagtaagaggtttaagcatgggagaaaaagctgaattgagtccttgacatagaaaaaatttattatgagtatgcacagcctcctccttctgcatttataggaatgatgctttgtctgttgactgggcttctagtattactttgatcagggtaaaggagagaaagatctacagggaggtaggtttccagatagggtggagaggtgggcttcctgaggcactggaaagtggaagacagaaatattatttagagatacttgaacgctgcctctgcttttctaaagggtctgccatgggccctgagcagggttacttttgaaagctctctaggtgagtctaatatatacagtcatggttaagagcaactgtattaagtgacctaccatagaccgagtacattgggaacttatggcaagtctctttttcacttcctcacattctggtgatttcttcccacctgcaatgctgcatcaggttagctgggttgtatatttaaaacggaaagttcaatgtttcaagagaaaacatagattcaggaaggcagttagaaaggcagaaaggagaaaacaatactagagattggagatagtctttcaggcagctgttgggatatagaagaaattgggaggggtggaggaggaaacatgagatttttctgtgggttgtgaatgggaatttttctgagagattctggaggggatctgaattgtctttcaaattgtccaggttatgggagtggagccagtattgtgccagccgagctgtaaggtagtgggagggcatattcatttcagctgtatccttcctttctgtcttgtgctctccttcctccagttatggagaacccatttcatgccaggagcatcattattatccttaggtccttgacagcctggtcaggaggagataggaggtttgtttcaagttccacgaagagcagaatagaaacaaatgggggcagccattaagacatggtgaggaagagggttaggaaagcaaaaaggtggtttttgagtcagtttctgagctcacccagaaaatgacaagcaagagcttgttagatgaaaaaagaggatacagtgaagagtgctgtttaaatcagaagggagaactttgcagcaacccagaaggagaagaacagggtatgtttaagaactgctggggccgggcacggtggctcacgcctgtaatcccagcactttgggagaccgaggcgggcagatcatgaggtcaggagatcaagaccatcctggccatcctggctaacacggtgaaaccccatctctactaaaaatacaaaaacaaaattagccgggcgtggtggcgcatgcctgtagttccagctattcaggaggctgaggcaggagaatggcgggaacctgggaggcagatcttgcagtgagccgagatcgtaccactgcactccagcctgggcaacagagcgagactccctctcaaaaaaaaaaaaaaaaaaagaagaagaactgctgggatgtgggcttgactggcatttagtgcctgtggcaggaaaggaaactgaaaagggagaaagggctatatctttaagggtctaatatgctgcaatgaatgatgtaagtattttaccagagactcttaggaatcatgaaaggattttgaataagagaagtgtattagatctggatgttagaagaatcttctagtaatgttgaggatagaatatagaggtacataaggaggctcattggaaagtcattcaagtgattcagaagaggaaatgatactgaaatacattaaacacctaaataaattaaggtagtgacagaggggtcagaaaaatgggaggaaatttgcttgtgatttggaaggaaaatttgaaaggacagatcaatttgggtgaagagctgaggaagagttgaggaagagagagaaggtggttctgcagaatctggcttaaagaaccaggtgcagtggcagggtcagtcatggagttaggaccctaggaaaggaacagtctgggggaaaaggctgagtttagtttataggtgctcctgcctacagacctgtcccagggcaaaggactggggatgcaccaagaggaggggataaggagagccagggaaccaatcacccatcaagcagatgatagcatactattcccatgccatgagtccatcaggttgctttcctttcctctgctactccttcaactctagatcttccctgagtatcaactctggtagtaaatgatggagtagataagaggaagaaaagcagtttactgtcacagccggtacctagaaagtgacttggaattgttctagagtgtttccaaacctagaagtcctttacaatcatttagggaatggttcaaaaatacctaatgtaaatgacgagttaatgggtgcagtacaccaacattgcacatgtatacatatgtaacaaacctgcacattgtgcacatgtaccctagaactttaagtataataaaaatatatatatataaaaaaacaaaaatacactttctagaacctgtcttataccacttgcatgagaatctttgaagctagatcctagaaatattttttaacagaatccccaactgttttttttttcgtaataaggcctgattggtattagtaactgtaagagggccaaggcatgaaacttgtgcagttgcatggggctttaagttccaaagggccccgttgcttggtttaatgctctgtgtcactgtcttgaaattcttaatacttttatctttgaactgtgttttgaaagtgaagtccatgaagcaacaaacatgagtggtaacagaggagacccataaatacaatatgcatgtttgctctttcacatgtaaggcttgtgatatcccacaagaacaaagttcccacagtactgggagttcagtgataacgcaaaatgagtacaaggtaaatatattatgtttaatgactaagtgggggatctgacagccccaagaggccatgctccatttgggccagaacttacttcaaatgcaggaagaagggagtggtggtctaagaaacatgaatcatcaaggaaccctattatttcatcattactcctactacttttctgtattagctaattatttacactgaaaatgatgatagagaagaaaacagaaagagagggaagtccacaattccttttcctctcactcctaccttactcatcagtagccaaaggtcgagagtgttgatagaatgtgtgtatatcaagaactgaaataaagacagttaacttagatttgtgtagtgtttctggtgttctgttaagaaggaagtacatatgcatgcacaagctttgaaagatcaattgagtaattttggtgattttgcatgtgcattaaatacttttctatttgccttttaaagtggcgttgcacaatataaaaatgaatggtaaattttaatattttaattttttaacttagaatgacataaatgcaaataaaagacattatggtgactttctaagttaagcttagtcattctaagcttattcttactcattctaagtcattataatgttgagagatcagtgaagaaagaaaaatgctttatattttagtacctttaacggcatttctccctgctttttgaacaagggagtttgcctttttattctgcaatgggtcccacaaattatgtagctgtctctccttggtgtcatcataaaacaaatcaggaaagaacaaaatgaaaatgagaccttcctgaacatttgaggccgcttagagcctttgtatgtagatgagacctgaaacctgtcagggcagtatgtgtggggtgatgctgatgcacacatggatgtctgaaagcgatgtggctgctaggtggtggagtctgagtctgaagacagcctggttccagagcctgtgctcttaaacactgtccatgcagcagagaaggagaaacaagtctgactgtggttgtgcccctctctcccaccttcagcactcccttcccaaatgcttctctctgggaaataagaagggataataatatctcttcagattattctaaggattaagtgagatttaatgtgtaagcattagcccactgccaacctagcacatagtaggtactcaataaatgcatatttctttcctcttctcagtaactctggcctgaccataactttgtgtaccttatttcattcccccattttataaagtctgggaagcaggcattcctggctcctagttagcctcttgggtcgggaacagaagtagtacaatttttctttcttgtttttttgtttgtttgtttttgctatagcccaaattgcttcagtgcattactttgatccaactaaaaaattttggaggatcaaacatggaggtgaaatgaaatgacttgaaggcatcatttttaaacatctatttatgtcttatgtcactttcctggaatttcttgtaatgggacgttcttggcttaacagcccataataacataagcaatggcatattcaaacaaccaccaatgctatagaattatttcattctcaaattcagctttctataaaacattgttctatgagtagctttgggaaatatatgagcaatttatatttttatatttgtcaagtcacaaagcaacaggtgataatccacatttgtattgccatgtagaaatgtttagcaattgacatggtgagagttttttcatgaaaagaattggaaccaagctcatttggtatgcagaacacaaacccacagtgaatcttaatgaaatcagccctaggaagatttttagacaaggcaagagatacttgttggatattgcttcagagctggtgctaagaagaaaggacttagagagattatgttgtgcaagtagtaaaaagaggaggaaggaaacaataggaagtgactctacatgaatagtagttaagcatatcaagatctgggaagtgaataaaaatccttttagaatgcacaggaaaaaaaactggatctctctttggctagaaagaaaagtcataacaactccatcagcaccattaagcagtgagtttcaaagtaagtatgttgtggcaagccatgcttagcattataacagcaactcataagattggttagagcaaatctcatggggcaacaagatgagatgctgtggtcagaataccatctggcctcataatgcaccaagaatagtgatttattaatggaagcaaggatttagtctaggtgaagaagtggatggtggcattgttagggatgggaatgatgataaaacatggaaacaaggtaaaggatgctgctatgaatattctgaaagaaaagagcaaagtagttgagacaagagtgtcaggacattctaagcagtctcagatgggttttaaaagtttgatgcagaaggtatgggtggtagtgatagtaacagatcttaaatatatacaaccttgggagcaaatatgaaaaaatgtttttgtcacaagcctataattatagttaagcttatggtattttttccctaaattacttaggtctgcttgcaggatttttccgtaggtggtttgattttaaacctaaaggttttactatttatactggtagttctccaacctggctgaaccttgtcagcacagcctctgatttaatttgcatgtatgaacgagaaggggaaatctattatataggaaggaggaaaagaatcaaaggtttcagagagtaagcccaggagaaactgtgcaagtcagcttgacctgaaggaaaaagagagaaacataacaaggagagaaaattgtcagaactgtgcggcaaccctgagtgccttatggtaatcattatgaaattctcatgagaaaaaaaacatgcccatgaagtaactgtaattagaagtggtctaattagttccaccttgaaggatggcctggacaagagtagctagtggttcaagccatggattcattaatgaaaccctcaaaggaagcataaaactcatttattaaagatgtaattcaagtctgtgctttggagagactttcgaggcacacccgtcctgctgtttctcctactgattctcactaatcattgtgtgttgtaagttatgaagtggtacatgcttgtgttctcacttgatgtgcttagggcgtaccccagaaattagaactacttgtctggaagtggcagaagctcactctcaagttctttacataagggttcacaatggtttagaagctgttcctcggattgttctgaaggggcatattgggactctaaaacatttatatagacagtgctgtgagatccatgtgtatttcagcatattccagttaatgcaaaggttaatattgtgacttttaacatcatagaaacatggtaatcctcattcagatgatccaacagtcttttaattccaatagattaaatttcctaaagtatttcatttagaaggaaagacttaatagtaaaggaataatagttgtaatttgttatttcttcaaactattattctaatatggtaaaatagtatcatttattaaatttaatttattcctctaaatatgataatgtactttgcagagttcagcaaagtcccaagtagtacaaggacatgagcgtgtaatcttggacattttgctaatttaagttttggctgctcacttccagttatctcactcttttgaaaaaactggtaaagataacacctcataggattgtctctaggaataacttcaagtgttttaaaagatatttccaaatggattaagaaattctaagtgacaagtaaattttccttctcccttcttcctttcctgtcaaggctgaaagagaaaatgtaagaggagccacaacgatggtgctgtggttctcccaccaaatgaatattgcttacagaatggcgcttgattactggtgggagttcccatctggaggaatgttttgtgaagatatttttgcagccatatttgattatagttctagggcttgtaatgccttttgatttctgaaagaaggaaacgatcttttgattaaatattcttaatataacaaaataatgattctgcgacagagacacccagatgaacctaattgagtttcagttgtcttttcaactggctatgagagggtatattcagtttttaggaagaaagtgaaattagatatgaatgaaaagttaaataagtgtgaaaggtcttaggaaaattatagaagtttatgcaattagaatcaaaactaaagtaaaacaaaaaatatatatctaggtcgatacgtgagaaacaagacccaaacgagtgaaagtccttactgccggaacaagatgtatcgagtgatataggattctagacatttgagccatttttatcccatattcagttacagtctctactttaggggatgctaaactaaaattaagatgactaaagattttggattaactcttaaagagcatatagtctctttttatcttagacctgtatagctcctgttcatagtggcaaacttttggcttcctgttctgttgatgggactattcagttatggatattctagggttttgagagcattagaaccatgtacagccatgaccatgatgtttcatcattagccattgagcacaatggatacaatatagtgtctacctcatgggattaaaaccattaaaatgtaggcaatgtagactggctctttttgtggccaaattaatatggtgtcctgacttccatctgtgctagtgaacagacagtgtggaagggttgataggaacaacaaatccagtgctatgctcagagaatatgaaaatgtgataaaatgcatttcttggggctacatatggcccacatttttatatctcttgagcaaaaggaggtgagactagaaaaagtggcaaatctgtatctctcttgctgtcagagatgagactgtgaaaataagggatgtaagcaccagtttgtgggtaaacttaaatttccacaagatgaaaccacatgggcttactgcaagtatagtgttcccctgtgaaatcaaggttacccactttgaaccatccttaagtgtatattccctcttcagaaatacatttgaaaaaaagatgggggaagatttgcaagtatctgtatatctttgtcatttctaaccctgtttgaatactagtcacatgtgacaatttttatgtgtttctcagtcagtcgggaaagtgaatagcttaacttctttttaaactattttaaaagactcaaataatttaaaacagacaattttgacattatagtacaggatatttgattccatgaaaaccaagatttgataatttgaggttctcaggaagaaaattctcatgatttctagtcttcctggtgtgattacagaataaaataatgagcatttttctgttataaaaaattgaatataggcatacactgtcagttttgtttataaaatacctcagtgctgtgcaattgaactatgtgttacattagggaattggccatagcctgctctcattcatcaggcatcttccttctgcctgatccctaccagggctctctgaagaacaggctgagctgattgcttctgtgacactccctgcttcaattttctttttctgttctgtagggtgacattcatttcattttttttccacaggaaaataatcaagctatatttatgcactcttatttctgttacagtttataactaagggcttgaagcaaacaagaaattatttggcagaaaatatgaggcaacctttcataattaccacagcatagaagatctacatgctggtgactgacagctatgtgcataaagtgcttaggtgcatagatcaaatttccaggaagtcaaatatatttcttctaaaatatatatatatatgtatatgtgtatatatatatatgtatatgtgtgtatatatatatatatatatatatatatatatataatttttttttttgagacagtttcactcttgtcacccagctggagtgcaatggcacgatctcagcttaccacaacctccgcctcccgggttcaagtgattctcctgcctcagcctcctgagtagctgggattacaggtgcctgccaccacacccagctaatttttgtattattagtagagacagggtcttgccatgttggccagggtggtcttgaactcctgacctcgggtgatccacccgccttggcctcccaaagtgctgggattacagacatgagccaccgtgcccggctcctaaattttttttattactgtattatataattttaatacaaactacagttgagattttaacttatatttcaatgattcaaacagtgctacatgtttcccctcccccttcatttagatcagatcctaacttcttcactacaatccgaatcaatcaatgcctacacagcattattagctaactaggatagcctctgtccacagagagactttcagttagtgaaataataaataaacatgtaattattgatttttcaccaactatccagcacaggaatgatgcagctgggaatccaaaagaaatggaaagaatttatgattaatcttgttgagggacaagattaagattatgaaattgctgctattctaatgctttgatttatgaaaatggtaccttcatataattcaaagcagtgattgtaaatgacaaaacagtatttaattagataccaaattataggataaaaccacaagtgctatgtaggctttgtgtaggtagaatataagagatccaagtttgtcagagaacattacatgaatgagtaggtactgggagaggtaaagaggactagggcaggaattccaggcaagaggaagcttgacggtggactgaacgagagcgatggatctcaggtagcatgaactggttgtttatgcactgttggagtcgagaagctgagcctgggcgggggagaatggaacagcaaatatcagctgggctgctgtagcactaattgtggaggattgctcaaagtgaaagggaaggatgagaaacacattggaggatgtgttctgttctctgacggttctcactggatgagatttctactttctgacttccacgttttctatcacttacgtatatctttgcattcagtgctatttatattccagatacgtattagacattgtgatagaggttgtgtgtgccagacatggttcctggtttagtgttgttaattaacaaaactttaagtacctgtgttttgcttttctaaattgattgtaagttttaccacatcagggaccatgcatttttatattcattctttaaaaaactgttgagtatttatatgtgacagccactattgatataaaaggaatgtagtggttctggtttgcaagatatccagatagtttttaaaaggtatgagaattgttaccaatgaactgcagtgagattaattgttaaatttttctggaagaggctgggcgcggagtggctcacgcctgtaatcccagcactttgggcggctgaggtgggtggatcacctgaggtcaggagttcatgaccagcctgaccaacatgatgaaaccgcgtctctattaaaaatacaaaaaaacctagctgggcgtggtggtgggtgcctgtaatcccagctactcagaaggctgaggcaggagaatcacttgaacctggcagatggaggttgcagtaagccaagatcctgccactgaactccagcctgggtgacagagcgagactccgtctcaaaaaacaaacaaaaatttctggaagagttaaagactcaaagaagaatgatcttttgagttgagacttaaagggcagtgttttggaggcatgcctatgaagcatgggtggctcaggaaggtggaacagcctgcacagaagtgggggacacagtcacatgacacaggatgtacacatgtgctaatattgccaagtatggggtggaatgaaaccaaaggagattgtgcaaatgggtaggggcttgataagtgtctttgtatattatgcagaggagcttaggtggtatgctatgatgaaacatgttgattagctaagaaatgtttggacttgtatgttagaaccatcccatgtaacaaagaggagaatagaggggaagaaggacatgactgagcggagagactagaaatgaggctattgctattgcaatagtgtgtgacagagaagccaggagcaatgagaatagaaagaaggagaaaaaaacaaaaagtaactggaaagtaaaatggagagatcttgtgtttcatagaacatgggggatgaaatggagagagaccaggacctcgtctgtcttgttaataactgcttccccagcacctaaaagaaggccttatctaggtgcccaaccaatatttgtccaaatgaatgaaagggaaaaattgagatgattcctgggtttctggctgaagcagaatgtttataacagttaccaacagaagggatacaggaggggaagtcatgtattcatctgtggactactgtgggatatatagggtgggttctagaagagccagtctctaagatgtacattacaagagagtggagggcaggaaaggaagagaagctaatgaagaaaacaccaaatatgactgcagaagcataggaagaggcttaggttaggtaaaaatcataagtcaaagggacattttcatgatgaagtgtttgacaggatatttccagagagctcaatggtggtggcagtatttggtggcagtatttgcaaaatgagtgttcagctttgaaagactcagagaagactatcatcagtgttgtccccttgcttttttatggacatatcagaaattagaggttggcttactcaagttattttataaactctgggactttgtgcatctcttcacctgaggaagataaaggcagcatatggtatggtgatttttatagtaacaaccaatatgtaggttaaagatcaatattactaggcaataacatctaaatgtatatgtactactataataacattgacttgggtcatttcttctatagaatagataattgtaaattgtatggttaataataacgatatgttttaaaagactcacttctttaattcatagctttatgctatataaattgatgaataatccctatatatgatattatggccaataattacataccttagtccatacttgcatgtggtctaatttagctggctcctggagattttcagtagttgccttcaaatattacttgcataaggaggggaagaggagggagagcattaggacaaatacctaatgcatgcggggcttaaaacctagatgacagattgatagatgcagcaaactaccatggcacatgtatacctatgtaacaaacctgcacgttctgcacatgcatcccagaacttaaagtaaaattaaaaaaaaaaacaaatattagttgcataaaaagcacctaagattcttgataaaattttattttattttattctaatttttgattcaagaaggcctgggaactagagttttaacaagcacattcatgttattttaatatatgtgtgaagagctcttatttggagaaactctatcttaaatcattacacaatatgtatatattcaatatacatgattcaatatattgtatattgaaacatcacgttataccccataaatatgtacaattattgtgtccatttaaagaaaaagctctttagtatgatttgtatttttcagctggtcttcttgctccctcatgtggtgcaatgtgcaactgtatgttttagagctctcattttcagtttttagaaaatgaacttcacagtttatcaatctgttatctaacctttatttaaccatgcaataaacctataaatgcaaatgtagaattagcattaattcctctgcatacaaagcaaaatactagagaggactagaaaatgtcacatgtaagatttcacaatttagaaatgaggtggctaaaacattgctttatattttttatgtgtgtgttaaagattttgaaggagaatttggtagatgcgtactaaagggttttggtggcagtatttcagtatcatggtccaggtgtttgtcttttgcttgggttctccctatttgactctatcaggatttagaatatctgttttgaaacaagacagacctagggtctgcaatattcatttgaagttttcatttgccaggcttttttttttttcaaatcagaagggtttaattgataaatatatgataagtggtgtgcagagtaaagggttaggagtaggaattctttatttcccttcctgcgctatagtgggcacattcatagatatttattaaaaccattggagagaagctttgtgggtgatacagtgataaatcaccatttctataagtgagaagagaaatttagaactttgcagccagccaaagcctgtaacaaaggctccacatcctaatgcagaacaggctgtccatgctcagacaaaggggaattgatggaagagttgcgaggaggggaaccgctggggaaatactaatagaggacatagcatttgaactgagaatccctaagaatgaccactctttaggaatccttgtgaagctctgttgtggacttatatctcatgcaattatttgttcttattgtggttattttattcattcattaaatactgattatggtcagacactgggctaagcatgggtgtataaagttgaacagggctgacttgatctctttctatgtaaagctcccattctgttagtgaaaacagacaagaaacaactatattaaaaataaataaaaggatactaaattaaagtaatggcaatgaaggaagtaaataagaagctgaggtagagaataacttggatggggtgggacaagacttactttggtgaaggtggctacagaaggcccttttgagaaaagatacactaccgtgtttattgagtacaatgattttttttctttttctttttcttgagacagagttttgctcttgttgcccaggctggagtgcaacactgcaatctcggctcactgcaacctccgcctcctgggttcaagcgattctcatgcctcagcctcccaagtagctaggattacaggtgtgcaccaccatgcctggctaattttgtatttttagtagagacggggtttctccatgttggtcaggctgctctcaaactcctgacctcaggtgatccacccaccttggcctcccaaagtgctgggattacaggcgtgagtcaccgcgcctggccgagtccaacaatattttaagagcttcccatgtattaagttcgttattcctcacaacgctgtaaggaaatacactgttactatactcatttgataggttagaaaatagaggcacaaagacattaagtaacttgacacataatttgcacatggtggagactgattcatgtctacatcaccagtctctagagcctgctcccttgaccactatgatagctatttcctgtcaaggctgaggaaaaagcatgcaccaaacctctgagacaggaaagcacttggtggttaaggcactggaagaagagctgtaggagaaaagcacagagatagtgagagtggcctggttgtgttcagagatgcagactgggatctgatcctgaaggccctttgagaacatgataaggaggtttggattgcattctaagtgcagtaaaaagccacagatgggttttaaacaaggttcagacatgatctaataaaccttttaagaggctaactcttattacaatgtggataattaattgcaggcaggaaatcagtagggagaccagtcaggaagaggtcatgaggtttcagcatagggatggggaagagattcaaacaaattttggaggtagaatgaatagtactttacatgatagagtaccccatcctagcagacatggtgggagtctgaaataccacatttcatttggggtgtaggctcctttcagacatatgctgatacagaaaagagtgtttggtattaagagacagtcactgattgagttgaaaaaaacagaatatgttatttaccctagcaccgtagaaccactgacagctgagagaaaggtctttttctgttacaatatgttgatctcacagatgaaaacactgaactcagagaagttaggtgattaattgcttaactgttgattgcagacttaaaagtaaaacataggtaattttccttgacttagcacatgcataactagtttctacttaagagagacaaatgtaagttataagttgatttcccaccaattccagggcactagagtactttgttacaggctgagtactttcttaatttcttgctcctttaatttagaatggttttctttgagggcaacaaccatttccattttataacacatggaaaaatgagaatttcccttctctcttcagacatggaaacagaaagaaacagaggaaaggacaaatcaataaacttacttcccatgtgacttggtcaccttccctgtcctcatgtttgcctgtaggaattttttcttttgattatgaaaggtagctgatatggttaggttttgtgttcccacgcaaacctcatcttgaattgtaatccccataatccccaggtgtcaagggagagaccaggtggaggtaattaaatcatgggggtggttttcctcatgcgttctcgtgatagtgagtgagttctcaggagatctgatggttttataaggagaaattctcccctttactaggcacgtcttcctgctgccttgtgaagaaagtactctgcttcctcttccccttccaccatgcttgtaaatttccggaggcctccccagccatgctgaacagtgagtcaattaaacttctttcctttgtaaattacccagtctctggcagttctttacagcagcatgaaaactgactaatacagtagccctgatgcaaagtagagcttcagaaaggatcagggaactgctaagtactttggactacagcgaacatgctcaaggcagaaaacaggaggaggctgcatctaggcaaaggtcttttttttaccacagccaattagagtgtccctgaggaatctctaaagtattcttaaaggagcgaggcaagtcctagagggttcagttaatcttaccatggcctttctgtccagtaaaaaatatcaagttattttgcagtgctgagtggttgtttgccagctgaaacttcaggtggaattcataatggaagctgatgtctgagatccgtgaataagccaggaatgaggtgtatccaaaggcatctgtgccactgaaccttggctgagtaatattaatagctgtgaaaaaacccaaaccaaacagttaaaataaacctgtacatgtatttgtaaagtgagggttacgttttgctgatgcatctggccagatagtctgtttactattacattaattatactttagtgcccttcagcattgagcaactaagtgactcaacaggaaatttcaaaaccagaacaaaggaaatgcagtgttttgagatcttctatataatcctttcactagcatactctttctacataatggataatttacttaaaaagcaaacccctatattttgaaacttaattttagaaatagaaaagattactggcagccaaacaaagtatttactcaggtgcctcgtaaacatgatttggcatccaaaacctggatatgacttagagaggagctcacacctttgaacaaactgtgcttttctaatcctgcacctttatctgagccaaagccccaggtcagggctaggaaagtcaagaaataggaaggaaatcggtcagttttctatcatcattggtgagtgaccagagcttttctttaagtaaaaataattgtctaaaagaaatgttcattatttctttgctgagatgcttcttaagtaataaaaacatggaattcaattggtgtgaaagtgtagggagatttattaaaaacaggaaatggtaaaattagatgaagttcaagggccagtgtgaacaaaatagaatttaactgagggttgcttcttgtatcgaactcttctctttcattgtactgtttccttcataagtctccactggttttttaaatctccttacccaaagaggacaacagaaaatagaaaggggattttgacaccccattcctgtcttttatggatgatgtcaccagattaagggatgttcctaggatctatttttattggttggggacagctcggttgaggaaataagagcttatgttgtttccttctcaagagatgttggaactccagggaagctgtaaaattagaatttttacaagccttaagaaatatactcactctggtatgtaacacttaaaagagcttcttatgtctgtttataattgtgtatacagcaaataatttaggaaaaatgatgcttattatcaaaggcttgtatatctttgttttatatgactattaaactaagatatttgtgtgaataaactgaatactttgttttgatattttattaaaatcttatcagtttattatgactattaaactaagatatttgtgtgaagctgaatactttgttttgatattttattaaaatcttatcagtttattccctgggatgtgtggcataggttaaatgtaattttctcaaaactcaccagaatgtgaagtagggacttttgagacatattgcttcttatacttattttttaatctaatgaaaactttataatttgtgtccctgagataataacactctcaggtatatcactttcagtagtactatggggagggtgattgagggaaatgaaatgtactggagttgaaacagaataaaaatactgaccatcattcaatgttggcattaaaaactatgaaaatagaattcagttaaatttaatactaaaatagaaaaggaatgactatcttttgcttttaatatttcttcctgttaataatttacaactgagtctacctaaaggttacatttaggctagattgacaaatacgtatctcatatatatggtattttactgtcagaacctgtgctagatgctggtgacacaaagataaaaaagcactagtcactcaagggattagtgtgaagtcaatacatttattcagctgaactggactgaaagttgaggcctggtataagaactttcaggcagaagaaacagcatgttctagggtgtgaagaccaaaacagcatgtcatactcagggaacttatgaagtctgcaaattttagaatgaagaagaaaagtgagagtggaaggaaatgaaacaagatagacagtggtcaaatcatgaagaactatatattttctttattatcctaaagtagttgggcaatgatcaaagttgctttttagaaatattattctgttgatgaagtgtgaatcatagattagacagagagctggaggaccaaactttggtcaaggatgaaaataagaactttgatatcaagaaatctaacaatgaattaagcttatgcagaaatctaaatgtaaggcaatttatgagtaactcattaaggcaatggtgtgatatttaaacagctaatggaaatacattatcagtgcaatttcatgatataatttttactatcaaaaataagtacttttgaagtttgagaataataatgaagactgatgataaccatgacccataggaatggatctgtcaaatgctcagcatttcttagtctagtggtacctgcagctgttgagcatttgaattgtggttaggcctgtgtgggaagggctcagtatgaaacaaagaatgtaaaatatattattaataacattcccatatccgttaaacattgggttaaataaaatatattactaaaataaatttcacctgtttcttttaactttgaaaaatgtcgctactagaaaacaaaatgacataggcagctcacattctatttctattgaatggcaacgcagagagatccaagcatgttttgataggttaagttcttcctctaaaccgttagttgtgacttacttcaaggggctttttcttttggtaactttgaacctataaaaaggtagggcctctgtggggagcaataggaatcaggagaagaggtcaaagataatataatccatcactaagaggcttctatgtctgcacccacactgtctctataactctgaattaggcagaagaacgtgagggactcagactaggagaaagaagactttcaaccttacaaatcattcttttcaatactttaagcccttttccatcttccgccaggtaacatttggttaatttggttactctactgcataaattcccagatcagccttctggaaggatcagtcatcatctaatcaggaaattgaacagattgtaatgggactatttttgggctattaaatgtatatatttttttaatttttgcaatccctagttgcctcacagataccatgtgtaaagtcatgcatttttttgtcagttcttctaaagttacatgaatgaattggaaacatgaagaaaaaagggagatgctggaatttaaactaaaataaattgtttagtgtgtagaagaagaaagcaaaatcactaatgctctgggatcatttcaggcacagtcaaaaggtatccagacatcatctcggggcattaaaaattctaagagccttgagtaaagagggaatattgtgatattttcttttatattatagtgctatattataggctcaatgtataatctttttaaaatgttatgcttataaaacacttcttagcaaaagttatcacagaaagggtataaaattctattttctaatcatttactaaggcaaatttttctcattcccaatatggccgagaaataaggcattattgtgtttaatgtgactattttttccttttaaaaatattttgctgtggccgggcacggtggctcatgcctgtaatcccagcactttgggaggccgaggcgggtggatcatgaggtcaggagatccagaccatactggctaacaccgtgaaaccccgcctctactttaaaaaaaaaaaaaagaaaaaagaaaaagaaaattagccgagtgtggtggcacgcgcctgtagtcccagctactcgggaggctgaggcaggaaaatcacttgaatccgcgagacggaggttgcagtgagccgagatcgcgccactgcactccagcctgggaggcagagcgagattccatctcaaaaaaaaaaaaaaaacaaaaaaccaaaacaaagacaaaaacaacccccccccccaaaaaaacctgcggttaatcttttaatctgaattattaaagtttatgcacaatgcacagaagtggctaagatgaactattggaatgtggaaagaagacatataaatagttcagatttcagaacacctttcttcaactctgcagtgatgcatcctgaagcccaccggctggtagtaaaacatgagctactctatggcatagtgatggagggaggcagctggggctggccagctcaggcttgattctggatgtttttactttctgtgtaaacttgggtaagttatttcacttttctgttttagtttctttgttcataaaatgagaatgtaagagcacctaacatctgtgaagaatgagaaaagcccatggctgaagaaaacacactcgagctaaacatacaattcaagtgggcaaacctcttccaccataccagcaatcctactacatatttccagtcaagtcactttcccagcctctaaaatggctatttaatgcttcctctctcctcaaacatctaatatttattgtctcttatgaattaataatcttggtttttattttgctgagaaaaacccatcaacagagaactacctgatgctttcactgtcaaattctcccacccacaaatctttaatttttatccatatgctttgccttccctctgctgacaaggctgactctgcccgggtatttcatccaccccttctcatttgctcaagggcatcatttcagaaattctgtcctgcctcccaggagttaccaaattattcttctctactgcagcattccctttaacatgaaatatgctagaatgtccccatcataaataaagagcttccctccactccacattcccctctagctactgcatgtttctctgctcaacatactatcaaggggcttctagagagttgtctgtattgactcttacaaaatttattaccattcatgctcgattttattccagtcaggctatcttctctatcttttctttgaacttttgtatgttaagatcactagtgaccacagtctttctaaactaaatgtcaattctctgtttttatcttattcagtgtctcagaagcaactgacaaggttgattatttcttttctcttgaaatgctttctttacttggtctccatgaccactgcactgtcctgatattttttcctaccttaatgactgctgctcctcattctccttttcttccagttatctccatctaccatcattctgtatttgatcatgagtaccgtttacaggtggatgagtcctgagtaaacagtctctatccctgcttttttccagagctccagattcacatatccaaccaactactagataatgaacatatatttgtatgtctgataagaatttcaaactgatcatacacaaagcaaaactctttattccactatttgtattctttcccccaacccaaatcccttcccttcctttgcaatcaaatctgtttcccagccttccctctctttgctcagagcaaaactaggcatcatccttaaatggtatctttctctgctacctcaactgacaaactgacgaatatgttaacttcatcttcaaaatatatcccaaattacactgccgcttttcactgtgtctgttaataccatcaacgttcaatgcactgttctttgtagcccaaactataatatttgcttcttagctggtctccgtgttgctacctttatcactttacaatctcttttccgtattgtagccaaagtggtcttttaaatataaattgagtgtcaaagtttctccagcattttccattgaagtttgaaataaaatcaaaactcctgaacatagcctaaatctcccaatctccagatttattttatactcgtttcttctttctcattctgctgcagccatgctaacttcttcgtgtttctcaagcaaacctaacacactcccagttcaaggcttctgctcctgttcccggtgcctgaaccacattttccccaaaagctgcatggcctgctccctcacttccttcaagactcgctcaggtgttctctcctcacagggcctttcctgaccaccctattaaagtattaatctcctattaaagtagtaactccttgtgccctgcccttcccaaccccgtactctctagtctcttaacctgctttatttacatggcccaattccattatatgttatttgtttactttttattattttttctccccactcagattgcagattccactagggcagagagcttgcctgtccttcatggtctaattgggcataagatacatatttatcaaatggttgaatacatgtaaaaggttaaagtagtgttaaggacatagtaatatatattatgatagtatatctctgccattactgtttatctagtatcttcacaactctgttcttaagtgactaactattctgcacttatagagctactggatgaagttgtgaagtggatttctacactatcaccaatgctaatcattgcttgtttgaatttgttttttgtactaagtcctttcctctaaaaaatgttactaagtttttgcaataatatggaatcttaattcttctagtgtgggtaaaaattcagataatataatacatactgaaaatcaaggcatagggacccctaacctgacaaatcagtttattttttatttttttattttgaggcagggtctcattctgtcactcagactggagtgcagtggtgcaatcttggctcactgcaacctccatctcctggaatcaaacaatcctctcacctcagcctcccaagtagctgggactacaggcatccgccaccatgcctggctaacttttgtatttttttgtagagatggggtttcaccgtgttgcccaggctggtcttgaactcttgagctcgagcgatctgcccaccttggcctcccaaagtgctgggattacaggcatgagccaccaggcctggcccaaattgttgtttttaataattaagttgtataactagaactataattttatacattttgtcttataaacattagtttccatttaatatttgaaaataatgtcttctttaatttgtgagctaaaaatactgactaggtttcttgggacaattgatagtttttgacagaatattttgccttttacctgacaaaatatatgtatgatacctttaagatcatgcttaaaattttacatgtggtgttgaaaaaattttcttaagtgcatcaaaaattacttgaaacttttaagtgttttcaagatagattgtttggtctaaatatataattttttggagttcattgctgtttttaaacagatacaaaagacaaaaacctgtgggtgattttttcttggattctgttttctatgtaggctgctgtgtataacctcagcagagtggacaccagggagcgctgagctagtgaaaatccaattcagttcttccttctctatgatgtattttaatgaagcaagcagatggtaggtagatcttcccttggaaactgctgattttgaaagactccagaatgccagttttccaaccatcatgttcagcagtgtagcgtatcttgaaatacacatttaactttgccaggaaaattaatctacccttaggcagatggataaatttgcaaaaatacaagatgattgcttgcctctccagttttccttcctagctttgagtatacacgtctttcctctgtctttgttcttaacttcttagtaacacagcaccagatttagctcaatatcctgccgaaatgcaattaggttatcaaactatgtacgtggtcattgtctttgttgtttctgttttttgttgttgaacaaactccttgaggaatacactttcacactgttcagcattatcatttagaaataaaaatggcaacctacaaatgtgattattttttaaagggaatagaaataaatatgtccggagatatcgccaacagttataggtgatggtagcctgcacagaaaacatacagttaccttttccttctgaaccaagacagagatacccggtacatgaataaaatcaagctctctattcaaatggatatataatatcgaattcacccacaggtataaacatgaaataaatatgattggttggttgccaattcctgctcataataaattattcacgtattctatatagatatttaattactaccattctaacttctttatccaatcatcaagaaaaagctaagaacaaacagagttttacattaagatagaaaaactgttgaaaatgcagagcattataatttccaccagcaaaagaaataatacatgctagaatctgaagcattctttttagatgcataattcttagaaattagtgccatcttctggcttttcaaagtaactaggtactggtaggatgttttatagtatcacaaagtgtcagaaaaggggaaaaaatccctgaaacatataggttcaaatcataatcatagtatctgcaatacattacagttcatggcctaagctttgagcatggtaaaattttcacatcctctataattcatattacataagctgtgcaggtttatactggattacattcccttggttagtagtttattgtgataaaataagattcctagctattacacacacaggatattctggaactgatgtgttttgaataattttctcatttctaactcatgaatttcttcatgcccgtgaatatttagttcagaaattaagaaacattgaggttggagtgggttatcgctcaagttccgtggatacattcttttagtttgttactatatcatttttcaagatatggctgtttagatgcactattgtatattctaaaatattaaaaatagcaattatagtatctattatgtcccagctgctagatgccctatctaaattactttatttctcacagaacaccagtgagatgtacttctacctcattcctatcttatagatgaagaaattgaggctcagagatgttaagtcacagagctaagaaatgacagggtcaagatctgaacccctgttcatctgactccaaagcctgtgctctatgttacctacctcactatgatggttgggatactcatgacattggccagttaaaggccactggtaggtattttatgtaattattaaaatattacattattaaagttggcactccccacaaattgactatctaccactttactttcctcccaagtcctggccatggatgaataaaattctgtagaactcattcctccttctatatttaatagaaatgtaaacacatattaactactttgcagtgtcaagcatttaactgatattcaggatataccaatataccaatgaatttatcagcaaataagttttaatagaagctcaattgttttctaatatgcatagataataaataaaaaactggtttaaaagatccatatgtccttaaaggtttctaagtgcttgaacgtttggagacacaggcacacacatgcatacacaaatatacaggtcattgacaataatttttatttttgtttttggtattgtataaaagattaggaaaagcaaaaatctaataaggatgatttatcaaaaagcagtatgtactctaatcatgagagaaaaaagaaaaaaatcttaaccagggatactatagggaaaactataattttaagacaactgtggtttagctgttgaagtactagaagaaggcagtggcatcttgcaaaatactaactcatttctggggaccacaacaccacatgatgtttcaaaagcatataaaaagatttcatattaatatggtataagagattattctaagtaatactaacaaaataaaaatatcatacatgattcacaaggtataacatatattgagtactatttttaattggaaaggatcttgttatatctaatagccccaagattttgtgtactaatagtgagcaggtgcctatctcaaactataatggagtattatagaactacaaaagatgactggaataattaagaacaacaatcagaaaacataatgaaataaagtattttatttgctatagcatgaaatacttggaataaaactgtaccaattaggtttcttggttactggcaatataaactaaccctgaccatcttaagcaggaaaggagacagattacctcatggtcagtgggagggctggagaactagcagggaaagcaggaaaaacaaaggaacataggtagctcaaatactgccaagttcacattgtgtgaacagctatttcaggatgcagccactggtatttctatgactggggacagctgtgcaactacctcagctacaaataatttctaaatattactctctctctttggaccacttcttcagggtgcaaatcttggggagattatcccattggcttatcctaaggcatgtacatgtacgcaaataagaaggaagttcacgtgctacgtggccaaaatccaaaactgaaacaaacgtaatacccaataaatgtttcccacagacctttggttgctgagtgccaacgtgcatccttcttatacttgcattttcaaataacttccttttaacataatgcaacaatcccacatataatcaaaaaaagtgtcacccttctttcccaattggagacttcttaaagtcttttcttttattgcattttgttccaagtacagaaggaatctctgcataatggccatttgttctcatgtttatgttgtgatactgtcctgatatagactaaatttcagttactaaactcaaatgctttacagaaaccagagagcatatgacagctgtaatgtgatatggaagtatctgtgatttttcctggtgacagaatcaaaggtaatgctactattgtgcttttttgcttatcagcatccacaagagatagtcaaaaggaaagacttgatacagggagctaattatgaagggagagcaaacaggggatggtgaggccacctagaggatagcaacaactgaacagctgaaagcagctgctacctctatggctgaaagaacaaagggaagacacagtgctacaaaagcccaagagctgcaacctcctgacaggagctgggtccggtaatgggggctgctcatcaggacatgggaccacgggtagcttggggacctgttaagtggcagctggaaccaatcgcggatgcagctactagtggaggggagaggggagaaattctgtagcttctcttccccccagtctcctgtctcctgacaggaccttgccttggtaggagaaaatgtagtttgtacagggtgagaaatgcatctcagagctaacctgcaaatgactggcattcaccaggaagccctggggctaaactccagattcctggaactggtcataaggccacttctcatattagaactttcttctttggatgctctctcctttcacgtaggggaagcaaatttaaattctttcttctgtgtcctccttgcttgccgcctgccctgcagttggttggattctttatctggtgtggtgatgcaagtcatcattcctgagaggccaggccatggtgggcctgcggtcaggagcttcacgaggcctccattaactcttaccattggatgtgtgaagcactatcccaaggcaggcttctcactgtgtgtgtgcatgtgtgcctgttaatgtatgcatgtcatggacctctatagcagtctagggaagctagtgggaaccctcctcagaataatgtttttaaattcatacagtaaaatacctaagattataaaacaaatccacctttttgaaatacaattaataaattataacaaatgttttgtcatgaaggaaacagtatagtcctttcataatgtatttaaatagcaaaatctagcagcaggtataataactacagcagtttcacattgagggggcacaagcatattttaatacagtatataacaactgtcatttgataaaaagggatctgatttctcttggtgacaaagttgcaggtgctgataatacaactgtgattttatgctgattttcatagttaagaatacattaagtttctgttggagttcacagaaagatgtagtttttttttcctcatccatattcacagcttctttgactgagagggttacctgggttttaccagaacactttttcacctgctggctaattctctcaccttcagtgttttttcaattccacccttctccttctccctgaggcctatcttgtcctatcctgtacactctatttacttctaaccttcctctgtgtggtaaggttttttaagaaatgctgtcttaaacccagtctggggccctggttggaggctagtcatttccctggactctcacattccaggccaccacactcctgtcctaattgccctgggacaggcaccagacaactagggacacaccttggagccctcagaattattccaattagccaatctacagagagccctcaaaacctaactaaccccacctgacttgccacacaaaagccctttccaagggaaacctccgtgtggccctgtggcagtcttctcccatttgaagctgtaagtaacaaaaagttctgccattcatctatccaagtgagttgtctccttccatccaaaaatatcttgaattcttataaaaacaccttgatcccctcccagggatttcttctctttttcttctcagcatttttgtttttgtttttccatagcacttataatctaccttctcacaaatcactagactgtctccccacctcactgaaatgtaaggtccgtgaaggcaggattttgtcatttttgttttctgctgcatcctaagcacttggaacagtgcctgcccataggaggctctctttattgaatgaataaatgaatgcatgactctcctctctgtgcctattgtgatcagtcactcggggcaacaccttcaagccccttcatacctgtttgtgtggtttcatggaagcctgaaagggaggtggatgatgtaaattctgattcaataggactatggctatgtctcttgagagctttacccttttgggtgccaaaagcctctgaatgagtggagctcagagtcacagagagaggaaaaattgtgagtgggtctttagggatgatcacgagacagactgctcttctgctcccccttggtttctgaatctgtgtagtatgattgtggaaaatatagcaccacgtgtcagttaaagtttcacagcatacatgacatctttcagaatggtgctgttaccctgaaggttggcccagttgatgctgccacagagtctttaatatacgatatttctattttataaggccaataacttttgggtgataaatttcataagttcagtatctctccctgccttatttctttcactgtgaagcctgttgtttagaagtaatattgtgcaggataccataatgacacactgtattgatgaactccctcaaaagaaatggtagaagaaccatgactagtagggaaagaaaatccaaatccagaacaagtaatcaggagaataaggacaaattcctgccaatcccatgatgtaatcaacctaccactaggctgactagtccccctttcatccctgggattatatcaggggtccgggttgtttgtagccatggggaaatgaggattcaacagtgacacttctgaagtactacttcttaagggaaagtccacattgaggccttgcatggcctctaattcttgcatcacagccatttccacatactgtcagattgcattctaaaattacaattcatgtttccataaaaaagtgcatataatcttcttgaattccctccagtaatttatatcattgctctttctaatttttgacagtctgatgagggtggtttgtccagttattactttaattgtatttccctgattactagtgagtttgagcaccttttacttgttggccaactgtatacccttcagtgagatgtctgttcatatgctttacttatttttctttgattttatctttattttgacaatactaaagagctctttgaatattatgttaatcctttgtcacctcacaaatagtttcttcaaatctattgtttttctactgactttagatgtgaaatcctttgcaattcaatagttttaaaaaaattgtccaaatgttttcttttacagctccagaattttctctcttggttaagaattattccttcatctctaggctattccaaattcttagatttggtcctgagatattcactgattcatgtttcatctttaagtctctaataatcccaggttttattttaatacataatataaaagaagcttaattttgttttcttccagtggagaataagttgtgccagtttcatctattaattaaaaccttatctcacaactgaataaaacagcaattttgtcatcaattgtactctcatatatgctggggtcttttgcttaattttctcttcttcctgttgatctatttgtatcttactatgccagtaccacactgataacgatgatagtagtttaacatatgttctgatacctagcaaggcaaggccaggcaaggacatttatttattttttatattttcactaggtattggtgggttgttgttatacatattattctagatcagactcaaaagctttgaaatgttatgaaattatgtattaaaatagcaattttctcatgtaatccataaataatataatttcagaaaattatattatgaattatatcttctcatctgctagcatggcaaagttttgtaagccattcatatataatattattaaagttttataattttctacatagaagtcttgcacctttctcatcaaatgtattcaaagtgttttgtaggttttttttttttttggttaaagttgtgactggaaaatttcttatttctaattctaggttgggcttgaaagtgtaacaagaggttaaaatagaagttctagctgaagcacaaagaaagtagaaacaacacatcaaagtgagggatttataaagcaggagactgaaaaccagctggtgactcttgaattcctcacccttattgagagtataaaaggcttatagccctcaccctttcacctcaaatcaagagggaagggttttagaaacacaacttggagagcttaatatgtatccctgaagtttgaggaaaggggacgtagtgtactgacttctgcctggaaagtctaacaggtgggagattaattgactgcaatgaaggagaaagccaatgacaggttgcttcttgactggaattgttcagcactccagaggctgtcagggaaaggatgtgagcatgctgcctggaatctgatgtggctcagctgtaggacaaagatagtgtgttttcttaagttctgaccaaatgaaccaccttaagagacaaagatcactcagcaaggaaagctgaagatgctatgagatgccagaggttggggaaggagcaaacaaccagctggaatggatatgccttttctcaaagaaaattgcaagtggaagaattccagccatggggtctccaaagcatccgtgaaactgttccacaagacaaggatggatgactgaatgccaaacccagagagcagtgaagctaaatcaactcaatcatttcagtgaagaaagaaatctcctgtcctttcctgtccctgaactccatgatgaagggccatgtgctgtaggtagcaaaacaggggagaaagaatttcagttttccttttcccttgaaattttctagctaaatcagtccgaaatgtggaaggaaaaagcatgaagttttttatttttattttttgagactgagtcttgctctgttgcccaggctggagtgcagtggtgtggtcttggctcactgcaacctcctcttctcgagttcaaatgattctcctgcctctgcctcccgagtagctggaattacagccgtgcaccaccatgcccagctaatttttatatttttagtagaaacaggtttcaccatgttggccaggctggtaatgaactcctgacttcaggtgtctgccagccttggcctcccaaagtgctggaattacaggcatgagccaccacacctggccacatgaaagcatgaaatttaatgcagatagatttacctatcatataaaaatggaaaaccgaattactaagtggaactgatattttgtgatccaggaatgaccatgtctgaactttcatttgaggggaaaaaggataattaacaccattgaacaaatttaaagggagaatggaagacaaagtaaagttgttttatgtttacatacagctgtgctattaagaaaagctaccgatttttattttttgtctcgtacaaatttttctcattaaagttatacaaccaacaaaaatagatttgtatcttcttttctactatgagtattgattatttttatctcattgcatttgcttggaccttctcaagaatatggcaaataataatagttatactaggcatccttgtcaagttctgattttaattgaagaggttttagtgtttcaccactaggaatactatgtgcttttggtttcaaactaggctttattaaattttagtattttattccagtttttagtttctgttttctaattttcttataaacaataaaacaattatgtctgttgaatttgattggatgtcttatttgtaactatctgatgacattttagtattgattaatcaaaaaatattttcctttagtttattttttgattttgcattatgttgataaatttcctagtattgaataaccttggtattcttagaacattcctaacttagtaataatatatattttggtacattgtttgattatatttgctaatatttacctttttctcccccctacaggcatttagtgaaattggtccatagttttattttcttctgctaatgctatgctgagttaataaaatgaattgagaagcactcacctttttctgtggtctggaataagtaacactgaaataatctgttcttaatacatacgatgaaatacttacaaatgtgcattattgtggtgacttttaaaatagtacatgtttaattacctttgaagatgctaacgtagcaattaaaaatgttttttcatttatgagtcaatttgaataattatggttttctagaataacattcattttctccaagtttcaaagtttgtttgcaatggacatgcatattttattctctaagaaaaaaatttctcatttatctatgattatgccacattctcatttctaatcatatttttcatctttttactctaatcataccttgaagaacttattttctttagctttaataataaccaagttcttttatactttatttatttcactttcatcaataattgcctttttgtaatttattttggtttatttctatgctttacatcttaaaatgggtacttcttatatttttatcttttgtctttttttctatttcatttgtttcagctacattttcaatgattcccctttcctaagttacttttatttgcattattgttctttttttctaatttgttaatatatgccccaagtccttacatttttcttctggattcactttcctccaattttgtctaggttaatctctagcctcttgcccaatgcaaaggaaagcagaatagatactccaatttctataactcaggaacctacttccaccaagcttcccactgacttcagaatatgcatcttacaagtgacagctagattggagttggaaataaaggaagatagcatcccacaatctcgtctctctttcatttataacgtaactataatatgtcacaggcaagttctaaataaagaaaaccttaaatcattgagggacataaagtaaattattagtaagtagaaatactttcaaataggaaattttaatataatagacatgccaattcccactaagtgattttatgaattcaatgtgatcttaatggaaacatgacggtatggagtgagtccagcataagacacaaatatacctggaagatttttactgtgagtggcttttcaaattaatgagaaaaaggaagatcattcaataaatattactgataaattgatcattaccacatattacaaaataaaacttagcttcataaaaaattaaatgttactgcaagaacaaaccagcaatccccagaggacccacagaccctctgaaggaagtggactgctgctgcaggacgcggagacaccccaaattctgtgagcaccccagctgcggaagtgggaaaaggagaccctcctctcccgagcacatacctccattggagaagctgaaggtccaggtccgtttgcaggagaagttgccgagtttacctggagccaagtcaagttagagagccgagccaagtgaaatacaggggtagaggaagcagcagaaaggccctgggagcttactgggtccccaagcagcccattcctgcctggcaccacagggatccatcaggagggtggccagaggaacgggggcaaaactccaaagggagaaggaattctgtagctgaactttgtaacaacttgaaccaggcgagaagcctcctggccagaacttgggggagggcgccaatcccgcttgcagagttcacaagcaggggaagaactaaagcccttttcttttgcagctgggaggcagaaatctggcaagttttcaagcccctctcacccgccacctgggaatagactcggggctgttgttgggggcatggtgggagtgagactggcccttcagtttgcatgggagctgggtgaggcctgtgactgctggctttcccctacttccctgacaaccttcatgactaggcagaggcagccacaatcctcctaggtacacaactccagtgacctgggaacctgtcccccatcctccacagcagccacagcaaaacctatacaaggagactctgagcttagacatgcctagccctgcccccacctgatggtccttccctacccaccctggtagtggaagacaaagggcgtataatcttgggagttctagggccccgcccactgcccatccctctccacactatagctgttctggaaaatgccacctctgggcaagaggccaagcagcacaaaaatagagcattaaaccaccaaagctaaggaccctcacagagtccatcgtgcccttcgccacctcaacgagaacaggtgctggtatccatggctgagagacccatagatggttcacattacaggaatctatgccgacaatggccagtatcagtccagagttaggtagactcgctggatggttagacccagaagagagacaataatcaccgcagttcagctcacaggaagccacatccacaggataaagggagagtactacatcaaggaaacaccccatgggacaaaatgatctgaacaacagccttcggccctagaccttccctctgacagagcccacccaaatgagaaggaaccagaaaaccaaccctagtaatatgacaaaacaaggctcatcaacacccctcaaaaatcacactagttcaccagcactggatccaaaccaagaagaaatccctgagatagttgaaaaagaattcaggaggttagttattaagtgaatcagggaaggaacagagaaaggcaaagcccaatgtgaggaaattcaaaaaatgatacaagtagtgaagggagaaatattcaaggaaatagatagcttaaagcaaaaacaatagaaaaaattcaggaaactttggacacttttagaaatgtaaaatgctctggaaagtcttaacaatagaattgaacaagtagaagaaagaagttcagagctcaaagacaaggtctttggattaatccaatccaacaaagacaaaaaataagaaaatatgaacaaagcctccaagaagtctgggattatgttaaacaaccaaacctaagaataatcattgttcctgaggaataaaagaattctaaaagcctggaaaacgtatttggggggataattgaggaaaactttcccagccttgctagagacatagacatccaaatacaagaagcacaaagagcacctgggaaattcattgcaaaaggatcatcattgcctaggcacattgtcatcaggttagccaaaattaagacagaggaaagaatcttaagagctgtgagacagaagtgccagggaacctataaagaaaaacctatcagattaacagcagacttctcagcagaaaatctacaagctagaagggattggggacccatcttcagcctcctcaaacaaaacaattatcagcgaagaattttgtatccagtgaaactaagcatcatatgtgaaggaaagatacagtcattttcagacaaacaaatgctgagagaattcaccattaccaagccatcactacaagaactgctaaaaggagctctaaatcttgggaaaaaaatcctgtaaacacatcaaaacagaacctctttaaagcataaatcacagaggatctataaaacaaaaatacaagttaaaaagcaaaaaaaaaaaaaaaaaaaggacaaaaacaaaaaaaaaatacataggcaacaaagagcacaatgaaagcaaggctacctcatatttcaatactaacattgaatgtaaatgacctaaattctccacttaaaagatacagaacagcagaatggataagaactcaccaaccatctgctgcctgcaggagactcacctaacacattaagaactcacataaagtaaagggatggaaaaaggcatttcatgcaaatggacaccaaaagcgagcaggggtagctattcttatatcagagaaatgaactttcaagcaacagcagttaaaagagacaaagaaggacagtatataatgataaaaggccttgtccaacaggaaaatatcacaaacctaaacacatacgcacctaacactggagctcccaaatttataaaacaattactaatagacctaagaaatgagacagtcagcaacacaataatagtgggggacttcaatactccactggcagcactaaatacttcatcaagacagaaagtcaacaaacaatggatttgaactataccttggaacaaatggaattaacagatatatacagaacatttcatccaacaaccacagaatatacattctattcaacagttctggaactttctccaggaaagaccatatgatagacaataaaatgagcctcagtaaatttcagaaaattgaaattacatcggccgggcgcggtggctcacgcctgtaatcctagcactttgggaggccgaggcgggtggatcatgaggtcaggagatctagaccatcctggctaacaaggtgaaaccccgtctctactaaaaatacaaaaaattagccgggcgctgtggcgggcgcctgtagtcccagctacttgggaggctgaggcaggagaatggcgtgaacccgggaagcggagcttgcagtgagctgagattgcgccactgcagtccacagtccggcctgggcgacagagcaagactccgtctcaaaaaaaaaaaaaaaaaaaaagaaattacatcaagcactctctcagaccacagtggagtaaaacttgaaatcaactccaaaaggaaccttcaaagtcatgcaaatacatggaaattaaataacctgctccagaatgagtatttgataaaaagacaatcaagatggaaatttaaaaaattatttgaactgaatgacaatagtgatacaatctatcaaaacctctggggtacagcaaagacagtgctataaggaaagttcatagccctaaacacctacatcaaaaagtctgaaagcacacagtctaaggttacacctcaaggaaatagagaaacaagaacaaaccgaacccaaaaccagcagaagaaaggaaataaccaacatcagatcagaactaaatgaaattgaaactaaaaaatacaaaagataaatgaaatgaaaagctggttctttgaaaagataagtaaaattgatagaccattagcaagattaaccaagaagagaaaaaatccaaataacctcacgaagaaatgactgacaccactgaaatacaaaagatcattcaaggtgactatgaacacctttaagcacataaactagaaaacctagaagagatggataaattcctggaaaaatacaacccttccagcacaaatcaagaagaattacataacctgaagagaacaataacaagcagcgagaatggagaaaatcttcacaatctatacatctgacaaaggactcatatccagaagctataatgaactcaaattagtaagaaaacaaacaatcctatcaaaaaatgggctaaggacatgaataggaagatatacaaatggccaacaaacatctgaaaaaatgctcaacattactagtgatcaggtaaatgcaaatcaaaaccacaatgtgataccactatactcctgcaagaatggccataataaaacaaattttaaaaagtagatgtttgtgtggatgtggtgaacagggaatacttctacactgctggtgggaatgtaaactagtatggaatgtaaactaatacagaatgtaaactagaaaactgtgtggagattccttaaagaactaaaagtagaactaccatttgatccagcagtacccactacagggtatctattgagaggaaaagaagtcattattcaaaaaagatacttgcacatgcatgtttatagcagcacaattcacaatcgcaaaatcatggaaccaacccaaatgccatcaatcaacaatgagtggcggaggttccaagatggccaaataggaacagctccagtccgcacctctcagcgtgagcaatacagaagatgggtaatttctgcatttccaactgaggtaccgggttcgtctcactggggcttgtcagatagtgagtgcagcctatggagcaaggtggggtatcacctcacccgggaaatgcaagaggtcagggaattccctttcccagcaaagggaagccatgacagatggtacctggaaaattgggacactcccaccctaatactgtgcttctccaatggtcttagcaaatggcacaccaggagattatatcccacacctggattggagggtcccacgcccacagagccttgctcactgctagcacagcagtctgagattgaactgcaaggtggcagcgaggctgggggaggggcgtccaccattgctgaggcttgagtaggtaaacaaagcagctgggaagctcaaactgggtggaaaccactgcagctcaaggaggcctgcctgcctctgtagactccacttctgggggcagggcatagctgaacaaaaggcagcagaaacttctgcagacttaaacgtccctgtctgacagctttgaagagagtagtggttctcacagcatggagtttgagatctgagaatggacagactgcctcctcaagtgggtcactgacccctgagtagcctaactgggagacacctcccagtaggggatgactgacacctcatagagctaggtgcccctctgagacaaagcttccagaggaaggatcaggcagcaacgtctgccattctgcaatatttgctgttctgcagcctctgctggtgatacccaggaaaacagggtctggagtcgacctccaggaaactccaacagacctgcagctgagggtcctgactgttagaaggaaaactaacaaacagaaaggacatccacaccaaatccccatctgtacgtcaccatcatcaaagaccaaaggtagataaaaccacaaagatggggagaaaccagagcagaaaagttgaaaattctaaaaatcggagtgtctcttctcctccaaaggaaaacagctcttcaccagcaactgaacaaagctggacggagatgactttgacaagttgagagaagaaggcttcagacgattgctatttacagactcctcccagctaaaggaggacattcgaacctatcgcaaaaaagttaaaaaccttgataaaagattagacgaatggctaagtagaataaacagtgtaaagaagaccttaaatgacctgatggagctgaaaaccatggcacgagaactacatgatgcatgcacaagcctcagtagccaatttgatcaagtggaagaaagggtatcagtgattgaagatcaaatgaatgaaatgaagcaagaagagaagtttagagaaaaaagagtaaaaagaaacaaagcctccaagaaatatgggactatgtgaaaagaccaaatctatgtctgattggtgtacctgaaagtgatggggagaatggaaccaagttggaaaacactcttcaggatattatccaggagaacttccccaacctagcaaggcaggccaacattcaaattcaggaaatacagagaactccacaaagatactccttgagaagagcaactccaagacacataattgtcagattcaccaaagtcgaaatgaagggaaaaatgttaagggcagccagagagaaaggtcaggttacccacaaagggaagcccatcagagtaacagcggatttcttggcagaaactcttaaagccaggagagagtggaggccagtattcaacattcttaaagaaaaggattttcaacccagaatttcatatccagccaaactaagcttcataagtgaaggagaaataaaatcctttacagacaaacaaatgctgagagattttgtcaccaccaggcctgccttacaagagctcctgaaggaagcactaaacatggaaagggaaaaccagtaccagccattgcaaaaacatgccaaattgtaaagaccattgatgctaagaagaaactgcattaactaatgggcaaaataaccagctaaaatcataatgacaggatcaaattcacacataacaatattaaccttaaatgtaaatgggctaaatgccccaattaaaagacacagactggcaaattggataaagagtcaagacccatcagtgtgctgtactcaggagacccatctcatgtgcagagacacacataagctcaaaataaagggatgaaggaagatctaccaagcaaatggaaaacaaaaaaaagcaggagttgcaatcctagtctctgataaaacagactttaaaccaacaaagatcaaaagagacaaagaaggccattacataagtaaagggatcaattcaacaaaaagagctaactatcctaaatatatatatgcacccaatacaggagtacccagattcataaagcaagtccttagagacctacaaagagacgtagactcccacataataataatgggagattttaacaccccatgtcaacattagacagatcaaagagacagaaagttaacaaggatatccaggtattgaactcagctctgcactaagcagacataataggcatctacagaactctccaccccaaatcaacagaatatacattcttctcagcaccacatcacacttattccaaaattgaccacatatttggaagtaaagcactcctcagcaaatgtaaaagagcagaaattacaaaaaactgtctctcagaccacactgcaatcaaactagaactcaggattaagaaactcactcaaaacggctcaactacatggaaactgaacaacctgctcctgaatgactactgggtacataacgaaatgaaggcagaaataaagatgttctttgaaaccaacgagaacaaagacataacatatcaggatctctgggataaatttaaagcagtgtgtagagggaaacttatagcactaaatgcccacaaaagaaagcaggaaagatctaaaattgacaccctaacatcacaattaaaagaaatagagaagtaagagcaaacacattcaaaagctagcagaaggcaagaaataactaagatcagagcagaactgaaggagatagagacacaaaaaacccttcaaaaaatcaatgaatccaggagctggttttttgaaaagatcaacaaaattgatagaccgctagcaagactaataaagaagaaaagagagaagaatcaaatagacacaataaaaaatgatgaaggggatatcaccaccgatcccacagaaatacaaactaccatcaggaatactataaacacctctatgcaaataaactagaaaatctagaagaaatggataaattcctggacacatataccctcccaacactaaaccaggaagacgttgaatccctgaatagaccaataacaggctctgaaatagaggcaataattaatagcctaccaacccaaaaaagtccaggaccagacggattcacagcctaattctaccagaggtacaaagaggagctggtaccattccttctgaaactattccaatcaatagaaaaagagggaatactccctaactcatttcatgaggccaacatcatcctcataccaaagcctggccgagacacaacaaaaaaagagaattttagaccaatattcctggtgaacatcaatgtaaaaatcctcaataaaatactggcaaaccaaatccagcagcacatcaaaaagcttatccaccatgatcaagttgacttcatctctgggatgcaaggctggtttgacataagcaaatcaataaatggaatccatcatataaacagaaccaaagacaaaaaccacatgactatgtcaatagatgcagaaaaggcctttgacaaaattcagcaggccttcatgctaaaaactctcaataaactaggtattgatgggatgtatctcaaaataataagccctatttatgacaaacccacagccaatatcatactgaatgggcaaaaactggaagcattccatatgaaaactggcacaagacagggatgccctctctcaccactcctattcaacatggtgttggaagttctggccagggcaatcaagcaagagaaagaaatgaagtgtattcaattaggaaaagaggaagtaaaattgtgcctgtttgcagatgacatgattgtatatttagaaaaccccatcgtctcagccccaaatctccttaagctgataagcaacttcggcaaagtttcaggatacaaaatcaatgtgcaaaaatcacaagcattcctatacaccaataagaaacagccaaatcatgagtgaactcccattcacaattgcttcaaagaaaataaaatacctaggaatccaacttacaagggatgtgaaggacctcttcaaggagaactataaaccactgctcaacaaaacaaaagaggacacaaacaaatggaagaccattccatgctcatggataggaagaatcaatatcatgaaaatggccatactgcccaaggtaatttttagattcaatgccttccccatcaagctaccaatgacttccttcacagaactggaaaaaactactttaaagttcatatggaaccaaaaaagagcccacattgccaagacaatcctaagccaaaagaacaaagctggaagcatcacgctacaggacttcaaactatactacaaggctacagtaaccaaaacagcatgctactggtaccaaaacagagatacagaccaatggaacagaacagagccctcggaaataataccacacgtccacaaccatctgatctttgacaaatctgacaaaaacaagcaatggggaaaggattccctatttaataaatggttctgggaaaactggctagccatatgtagaaagctgaaactggattccttccttacaccttatacaaaaattaattcaagatggattaaagacttaaatgttagacctaaagccataaaaactctagaagaaaacctaggcaataccattcaggacataggcaggggcaaggacttcatgactaaaacaccaaaagcaatggcaacagaagcaaaaatagacaaatgggatctaattaaactaaagagcttctgcacagcaaaagaaactaccatgagagtgaacaggcaccctacagaatgggagaaaatttttacaatctacccatgtgacaagggagtaatatgcagaatccacaaagagctttaacaaatttacaagaaaaaaccccatcaaaaagtgggtgaaggatatgaacagacccttctcaaaagaagacattcatacaggcaacagacacatgaaaaaatgctcatcatcactggccatcagagaaatgcaaatcaaaaccacaatgagataccatctcacaccagttagaatggcaatcattaaaaagtcaggaaacaacagatgctggagaggatgtggagaaatagaaacgcttttacactgttggtgggagggtaaattagtttagccttgtggaagacactgtggcgattcctcaaggatctaaagctagaaataccatttgacccagccatcccattactgggcatatacccaaaagattataaatcatgctgctgtatagacacatgcacgtgtatgtttactgtggcactattcacaatagcaaagacttggaaccaacccaaatgtccatcaatgatagactagattaagacaatgtgtcacatatacaccatggaatactatgcagccataaaaaaggatgagttcatgtcctttgtagggacatggatgaagctggaaaccatcattctgaacacactatggcaaggacagaaaaacaaacaccacacgttctcactcataggtgggaattgaacaatgagaacatttggacacagggtggagaatatcacagaccagggcctattgtagggtggggggaggggggagggttagcattaagggatatacctaatgtaaatgatgagttaatgggtgcactacaccaacatggcatatgtatacatatgtaacaaacctgcacattgtgcacatgtaccctagaacttaaagtataataataaaaaataaaaaataaatgagtgtataaagaaactgtggtatgtgtctgtgtgtgtatatatatatacatatatactctctatatactatatacatacatatatactctatatatacatatatactctctctctatatatatatacacacacacacacacacatacaatggaatactacacagccatagaaaggaatgaattaacagtatttgcagtgacctggatgaaattagaaactattaattctttcgttctttaagtgacgtaactcaggaatgaaaaatcaaacatcatatgttctcactgatatgtgggaactaagttatgaagatgcaaagggataagaatgatacaatggactttggagacttggagggaagagtgggagggaggcgagagatttgactacaaatatggtgcagtgtatactgtctggatgatgggtgcatcaaaatctcacaaataaccactaaagaacttatgtaaccaaataccacctgtagcccaataacttatggacaaataataataaattaaatatgaaactataacagttttagaaataagaaccataggtcaacaaacttattaatccttctaactttgacataatagaaggaagtagaaaaaagtgataaatttggctatttaaaacttcttaattcttaaaactactgaaagccaaaaatgtgggaaaagaaagtcaaaagacaaatggattccattctataaatataacaaattttggttatatcatgtcaatgttcatctgttggcagacatttgagttgctcccattattgggctgttatgaataatgctcctatgaaaattattatacaggtttttgtatggacatattttatttctctggattatatactttggagtggaattgctgggtcatatggtaactctaacactttgagaaattgctaaactgttttctaaatttattgcaccattttagactcctaccagcaatgtatgaattactgatatattctgtaacatggatgaactttgaaagtattttgctaagtgaaagaagccaattacaaatggctaatggtttctggtaaaacagaaattctgtttgctcttaggtgaatgtaaaatttgccttttaccaaaaaaatttggtaaaatatttgtcttttaccaaaaaatgacatttctagcaaaataagaaaaagaaaaaaaagattaacagaaagttatttgcatcaacacagactgttctaggagcatggaattgttaaaaaaaattcaatattagtttaatgttagaaacagaaggaaaaaagtgagcataataaactttgtctattagaaattaatggtcagcggtagaaaaagtcattgttctaaaaagtagaaagaaaatatcaaatatatctatgtaaaaaatcatatggtatgggaagaaactaaggaacatttataaaagagtacagatttttaaaatattaaaaaaaattttttggcattaaaatggcaattccttttgcaccaaccaaatagttattgaaggactgggttcatgaagatctctgttgcttggggaatgaggacatagtcctcgtttgaccatagcacactcattaatgcaatttattcagtaaatatttagtagtctgctaacacagatgtaaaaatcatacacctaataactctgaagaacataaagataactaagacatagtccttggctataacttggccttgtatcattctctgccttttttttgaaatgaaaagaatattttttctccttttgaaacagttaatttgagggttgggactatttttgttttgtattctccacagcgtctgatactatgatgttccatcaattcacatgtgacattcaatcaatattttttgatagtactgtctcatattgacactgatttgaattcaaaaaaatatagaaacattttatgaaaaagaacactatattttgagtgattcctagagctgtaacttttatagtgacaatggtgactttgttttctacatgctactcataggctatccttctagagcaccctggttaaaattaaaaacagtttgcaaattgatggggattttctcatctgtgtagagaattttgttacggatttttttttcttgctgcatggataaaatcttagtgaatcatctaaaatgaggcagcttatctctgtttatgtcattttcagttagcattctgaagttgaggtggcaaatatatgtccagagagtgtcctgaacaagaccccagaaaggggtaaaaatatgttaattcataagtgattgcaatttaaccaaatggtactctaaccttctaattaggcaaagagataaagtgaaggttgataatttagctaattttttctatttaactttctattgaagtataacacatatccagataagtttacaaatcataagtgtacattctaaagaattaaccaagtgaatttattgtggtttcagtgtaactatcgtccaaattaagaactattggactctgttattattttgtttaggattttgtatcaatatttatgactggcttgtgatgtctttccttgtcaacatcaatatcaagattatattcccctcacaaaagaggttgagaaattttgtctcttgttttattcccttgaagagtttacgtaagattggaactatttcttcctagtcagaagagtttatcagtgaaggcacatgaattttgagttttcttgtcagaagattttggatgatgaatttaattacaggactgtttattttggtatttcttcttgtaagagttttaattaattttgttttactctgattttatgcactttatctaattttttaaatagattgataggaagtggttcatcatatcctcttaatgtctgcatgatttcaagtaatgtttacatcttatgtattttagaaaaaaattcccagataacaaaatatctgtcataaatgagtctggtggtgatacttgcttccaactgtgtttcttttcttttctttttttttttctgtcttttagcctgccgtgtaatttttcaaatgtgttaaaagctggaagtgatgtgtaataggaactaacataaatagacgttagtataaagatttatgtaaatctgattaggagctggattttgttaaacgtttgctaaagccaaagatgctaaaggcttcaaattcctctagggtccttgactttgccttcccctttgatctgggcttccctaagggcttctccagagacagtcggcatcttgaagctctttcagttgtgatccactattattatactgcggccctgtatatgtggtgataaggtgtggaggagtggaaatgttctatagtcttctgatttaaaccctgtcttttagtaggcagtgttccttcacaaaagtttcttagcatttttcccctgtaggtgagagaggaaggccagtgggggctgaagtgggaaacatatccatctcccacataggataaggccttttctcctaaagagtaggcctctcttggcttctgtgacaacttgcactccaggtttttatgctccctccatgaccacatcttctcagtctccctttcttctctatctaaattctagatattatagctctctctacagtctcttcataagtgatctcatatatttccatgagtttgaatactatttatacgctgacaatacccaattttttcttttattattattttaaattgatacatgataattgcacatttatggggcacagtgtgatattttaatacatataggcaatgtgtgattatcaaattgggaattagcatattcatcatgtttaacatttatcatttctttctgttgggaagagtcaaaatctcctctagctttttgaaaatatacaaaaaattattgttaattatagtcactctgtagtgtcatagaatgctagaacttttctctgctatctaacttttcttttgtatccattaactaacctttggctatcccccctctctaaaaccttttcagcctttagtaatcactattctactttatagttttatgagatcagctattttagcttccatatatgagtgagaacatgcaatatttatctttctgttcctggcttatttcacttaacataatgttatccaagtttatctatgttgctgcaaatgacagaattaatttctctttcaaagatgaatagcattccattgtgtatatgtatgacattttctttatccattcatctgttgatgggcacttaggttgattttatattttggctttatttatttatttaaaatattaaaatatagaatagaaacagggtctcactatatggcccagagtggttttgaactcctgggctcaagtgattctcttgcctctgcctcccaaagtgctgacattacaggtatgagtcacagtgcccagccttggttattgtaagtagtgctccagtaaacacgagaagtgcagaacatccctttgacacactgctttcctttctttggatacatacccagcagtggaactgttgaatcacatggcagttctatttttagttttttgaggaccctccacactgttttccacaatggctggactagtttacagtttcaccaacagtaatgtaagtgtacatcctcgccagcatttgttatttttcctatttttgataataaccattttaactggggtaagatgatatctcattgtggttttggtttgcatttccttgctgataaatgattttgagcattttttttaatataccagttgggcatttgtatatcttcttttgagagatgtctattcagctcatttgcccatttctttttttttttttttttgagacggagtctcgctttgttgcccaggatggagtgtagtggcatgatctctgctcactgcaagctctgcctcctgggttcatgccatcctcctgcctcagcctcctgagtagctgggactacagttgcctgccaccatgcccatcttattattattattattattattattgtatttttagtagagacagggtttcgctgtgttagccaggatggtctccatctcttgacctcgtgattcacctgcctcggcctcccaaagtgctgggattacaggcatgagccaccacgcccagccccatttcttaattggattgttgtttgttttgctattgagttgcttgagttccttgtatattctggatattaatccctggtaggctgaatagtttgcaaatattttctttcattctgtaggtcgtcatttcactctgttgattttttttcctttgcggtgcagaaatcttttagtttgatcgaatcctatttgtctatttttgcttttgttgtctgtgattttgaggtcttctctataaaatctttgcctagactaatgtcttcaagaattcatcctatgttttcttctagtagttttagagtttcaggtcttaaatttaagtctttaattcatttttagttggcttttgtatatgctaagagagaggggtctagtttcatttttctacatagggatatccagttttcccagcaccatttattgaagacactgtcttttccctagtgaatgtccttgcatctttgtcaaaaatctgttggctttaaatatatgaatttatttctgggggaatctattctgttccattagtcaatgtgtctgtttatatgctagtaccttgctgttttggttactctagctttgactatattttgaagtcagctttgttctatttctcaagattgccttggctattcaaagtctttgtagttcaacttaaacagataatttctagtactaagaaatataaagcatgttaatgtcaaatttaatacatatctgtgctaacggctcaaattataattgataattaacatatcttcccaagtgcttaggtttgtttaaatataattttagtcacatggtaagactagattaatgattcataattctatacttaagttatctttaaaaagatagttatttcagtttttgctaacataatcagtaatcatttctatattaggttttcctttaaatacaatataacagaatcattgtatttgaaacatattcatgggattcagagtaatataaaagttaaaaccacaggttttaagggttctaattacaactttgccactaattagccagttcttgtattagttacatatcttctctaatttttggtgttcttatctataaaatggggataatagtaatagctaacttttgtgaactttgggattaaatgagataaactgtataaagcacttagaacagtgtccgtattgcaagcattcaagacctgctaactcttactattttgtaatgaactgcaatgacttctttgtttcttcaccttttattttattttttatattatactttaagttctgggatacatgtgcagaacgtgcaggcttgttacataggtgtacatgtgccatggtgctttgctgcacccatcaacccatcatctatattaggtatttctcctaatgctatccctccctttgccccccgccacccaacaggcacccgtgtgtgatgttcccctccctctgcccatatgttctcattgttcaactcccacttatgagtgagaacatgcggggtttggttttctgtttctgtgttagtttgctgagaatgatggcttccagcttcatctatgtccttgcaaaggacatgaactcattctttttttatggctgcatagtattccatgtatatgtgccacattttctttatccagtctatcattgatgggcattcaggttggttccatgtctttgctattgtgaatagtgctgaaacagtaaacatacgtgtgcatgtgtctttatagtagaatgatttatcatcctttgggtatacaccagtaataagattgctgggtcaaatggtatatctagttctagatccttgaggaatccccacactggcttccacaatggttgaactaatttgcactcccaccaacagtgtaaaagcattcctatttttccacatcctctccagcatctgttgtttcctgactttttaatgattggcatcctaactggtgtgagatggtgtctcattgtggttttgatttgcatttctctaatgaccagtgatgatgagctttttttcatacatctgttgcctgcataaatatcttcttttgaaaagtgtctgttcatatccttcacccactttttgatggggcttgtttttttcttgtaagtttgtttaagttccttgtagattctggatattagcccttgatcagatggataggttgtaaaaattttctcccattctgtatgttgcctgttcactctgttgatagtttcttttgctgtggagaagctctttcgtttaattagatcccatttatctatttttgcttttgttgccattgcttttggtgttttagtcatgaagtctttgcccatgcctatgtcctgaatggtatgcctaggttttcttctagagtttttatggttttagttcttatgcttaaatatttaattcatcttgggttactgtttgtataaggtgtaaggaaggggtccaatttcagttttctgcatatgactagccagttttcccaacaccatttattaaatagggaattttttccccattgcttgtttgtgttaggtttgtcaaagatcagatggttatacatctgtggtgttatgtctgaggactctgttctgttccattggcctacatatctgttttggtaccagtaccatgctgttttggttactgtagacttgtagtatagtttgaagtcagggtagtgtgatgcctccagttttgttctttttgcttaggattgtcttggctatacaagctcttttttggtttcatatgaaatttaaagtaggtttttctaattctgtgaagaaagtcaatggtagcttgataggaatagcattgaatttataaattactttgggcagtatgaccattttcacgatattgattcttcctgtccatgagcatggaacgtttttccttttgtttgtgtcctcttatttccttgagcagtagtttgtagttctttttgaatagggctttctcatcccttgtaagttctattcctaggtattttattctctttgtagcgattgtgaatgggagttcactcatgatttggctgtttgtctattattggtgtacaggaatgcttgtaattttcgcacattgattttacatcctgagactttgctgaagttgcttatcagcttacagagttttggggcttattatctcaatagacgcagaaaagatcttcaataaaattccaacactccttcatgctaaaaacactcaataaacttggtattgatggaacgtatctcaaaataataagagctatttatgacaaagccacagtcagtatcatactgaatgggcaaaagctggaagcattcccgttgaaaaccagcacaagacaaggatgccctctctattcctattcaacgtagtattggaagttctggcaagggcaatcaggtaagagaaagaaataaagcgtattcaaataggaagacaggaagtcaaattatctctgtttgcagacgacatgattgtatacttagaaaacctcttcaccttttattttaagttctggggtacatgtgcagggtgtgcaggtttgttacataggtaaacacatgccatggtggtttgctgcacagatcaacccatcacctgggcattaaacccagcatccattagcaatttttcctgatgctttccctcagcccacacaccctgacaggccccactgtgtgttgttcccctccctgtgtccatgtgttctagtcattcagttcccacttgtaaatgagaacatggggtgtttggttttctgttcctgtgttagtttgctggggataatggcttccaactccatccacgtcccggcaaaggacatgaattcattcctttttatggctgcatagtagcccatagtgtatatgtaccatattttctctatgcagtctatcattgatgggcattttggttgattcaatgtctttgctattgtgaatagtgctgcaatgaacatacgcatgcaagcatctttataatagaatcatttattttccttttggtatatactcagtaattggattgctggctcaaatggtatttctgcctctaagtctttgaggaatgtccacactgtcttccacaatggttgaactagtttacattcccgcccacagtgtaaaagcattcctgtttctccacaacctctccagcatctgttgtttcttgacttcttaatagtcaccatttggactgatgtaagaggatatctcattgtggttttgatttgcatttctctaatgattagtaatgttgagctttttttttttcatatttttgttggctgcataaatgtccttttggagaagtgtctgttcatatcctttgcacgctttttaatggggctgtttatttttttcttgtaaatttgtttaagttccttatagattctggataatagtcctttgtcagatggatagattgcaaaaattttctcctgttctgtaggttgcctgttcactctgttgatagagtcttctgctgtgcagaagctgtttaatgtaattatgtcccatttgtcaatttttgcttttgttgcaattgcttttgatgtttttatcatgaaatatttgctaatgcctatgttctgaatggtattgcctagattttcttctagggcttttatagttttgggttttacatttaagtctttaatgtatcttgtgttaatttttgtataaggtgtaaggaaagggtccagtttcagttttctgcatttgggtggccatgaactgtaatgacttccaaggaaggagacacaaaatacagctgcatttaaaatgagtaagtttaactcataatttattttccctattgtaaacctaaaggtactgaagatgggggagcatttattccaactctttcattagctatgaagaaagtgagatgcaaggagtcaaagtgacttgttcaaggccatgtagctggttatttcacatctttgttctcaaagtatagagccttcccattacacaacactaacagttcaaactgccaacttcaatttaatcactataaaatgatgcaaggatttttttttttttggttaataaaactgtatctgtttgagtttgtttaaagagtgatgttcattaattaaggcatgcagatgttaaaggaataaaccgcagcaccacactgccctttactctagagaatggagggtgaaaaaaaaagaggtgttgttcttttgctttctagatataaggctgtgagtaacacttcttttcaattttacctagcagcacatttgggatgtaatgatttctaagtttgttcttaaagaagctgcttctttggaaatgggtttttgtctaggggacttttttttatcaagttataattagacttcacttaatacacccataaatttgtagccttttgtttattgcacaggtgttctgatattctcctgttccaacagggctagtttgaataaccaaaagagcttttagatattggcagaaaggcaccttaagtcctttaacttgcaggatgggaaattgtataattccctagctatcataatatgtgggagaaatagctgttgaggctttcaattttgcttctgctctactggtgtaaactaaaacgcagaagctcagaattcaggatcctaaagatgcacttttctcagaagtgtttattataacaagtcataaaggagagaggtttaatggcagtaagaaactggcaacattgtaaagggattttacaatccacaaacatacaacaaacctctgaaatatgtacttcctaaacattgtatttttaaagcttacatagacatcaaacttaaaatgcaacggatatagctatctcaggaaaaatcaactctccatagttaagaaagaaacaaccctgacgtgtatttaggggactcactcagcagggcagccactgtggtattcctccgggaagccccctttggtgtttgctgtcaacaaggtgcatgttaaggcatccacctggagagtgacagggatacactccaacaagcagaattatcagccactcaccctgatgacagctcttctttctccagagcttaaagacttggggcagacaaagtctcactttaacaatttcaagttggtttaatacacaagaacaaaaaaagatgagattcaaaaatacccttggccactttagaatggcaaagagaattacaaaatgtcattgttgaaactgaatcactaggtgcaatattcagatttatcctctggaaaagattggatgttccctgccaggtgtttaatcaagaatacaaatcaaaatgggcagtaaaatgcttactttcaaagagctgtgttaactttataatctactcacacaccagttaggctctatagtgactgactgatggcagagacagaaaagagttaattcactgctggcaaaaatcccttactcaggacccacacactatcttattagaacaagagaactacaaatagacctacatttgtctgtctttggggtcaataaaaaaaatttaaaatatattaatacatgagcttttgcaagctattcttgtttgcttttcaaactttttaaaaatttaaattctaaaatttattttttttaattctagaaataaatgtgaagcctggtttttaggaatacctgtaacaatctctccctaggaaaataaagactcacatagcccttcaggaaacatggataacattaaataattcatatgttttgagacatgagttatatttctgatattgggtatttataactcccttttgaagttcatgttcagattcagattttacaatatcaccattacagcaaaattgggattgtgacttgattatataagaccacttatccttacctttggacttatattttgtttttcagttaaacaaaggaaggcgtgtggaacactcaacattgtgggaaaacatgtagattttggatacactggataatcttaatgcaatgtaggtacacatgaagtcagaatttggttgcaagctataattaattttcagaaatactttccctctctccctctcctcttccttcctctccctttttctcttttctctcctccttgccatcccctctgtttgctctccctttctctctttttccaaattaatttttgtcttagaaatgcataatgatagacatctgagaagccagtggtaaagtcactaataatatacataagccaagagattattggaattacccagttaaattattttgactgggcaattctacaataactgggagtctttctaaaaatactctgttgccagactaatgtttttctttaagaaattgttttttgcctgagttgacaaaatcaatgaagctctctactttggaattttccaattacatgatgatgcctctaaaagtttcagtctattcaagtttagttgatcttatcaaaatatatgagaaataacttagtgtctatatttgtacatacccaattttatgagtgaagattcatattaaatgattttgtggctctttgtcaaatgttgaatacttttcaatgtacttaaaatgttgaaaagccatcatttggtaaaaggagaaataataaagcaagggtcaagtcatttgactcattgggaaaatcaaaacaaaccgagtgatatatacataatgcaatttgaagcattttttatttttattaaattacagcacagagaagggagtaaaagtggtttctgcttggtttaggctgaaatgaccttattttgttcttactgtttgagaatgcccaccataaatgaatacatttccataaaatgcccgtaaaacatacatgcatgtttaatccttgactttttacgatgagattgctgtattagctgaagttttagtcactcttctgcatccatagtcttaaacattgtattttcacaatgtttaatcttttccacatctctgttagtatgagcttagagaatttaagtaaacttaattgtattggggtctgtggatagttttaaaaactaaaaataagcaggttttaaatatgccactttggggattggcaagatggccaaataggaacagctctggtctgcagctcccagcaagaccaacggagaaggcgggtgatatttctgcacttccaactgaggtacccagttcatctcattgggactggttagacagtgggtgcagtccacggagggcaagcagaagcagggtggggtgcccctcacccaggaagtgcaaggggctgggaactccatcccctagccacaggaagctgtgaggggctgtgtcacgagggatggtgctatctggcccagatactatgcttttcccatggtcttcacaaccctcagaccaggagattctctcaggtgcctacatcaccagggccctgggttccaagcacaaaactgggcagctgtttgggcagacactgatctagatgcaggagttagttttcataccccagtggcacctggaaccccagcgagacagaactgttcactcctctggaaagggggctgaagccaggcagccaagtggtcttgctcagcggatcccacctccatggagcccagcaagctaagatccactggcttgaaattcttgctgccagcacagcagtctgaagtcaacctgggatgcttgagcttcgtcggaggaggagggttgttcaccattactgaagcttgagtaggcggttttcccctcacagtgtaaacaaagccattgggaagttcagactaggcggagcccaccacagcaccacaaagccactgtagccagactgcctctctagattcctcctctctgggcagggcatctttgaaagaaaggcagcagccccagtcagaggcttacagataaaactcccatctccctgggacagagcacctggggagaggggtggctgtgggcccagcttcagcatacttaaaggttcctgcctgctggctctgaagagagcagcagatctcccagcacagtgctcaagctttgctaagggacagactacctcctcaaatgggtccctgaacctcgtgggtcctgactgggagatacctcccagcagtggttgaaagacacctcatacaggagagcactggctggcatctgtctggtgcccctctgggatgaagcatctggaagaagctttactattctgcagactccactggtgatacccatgcaaacagtgtcaggagtggacctccagcaaaccgcagcagacctgcagaagaggggcctgactgttagaaggaaaactaacaaacagaaagcaagaacatcaacatcaacaaaaaggacacccacataaaaaccccatccaaaggtcaatagcatcaaagatcaaaggtagataaacccacaaagatgaggaaaaaccagtgcaaaaatgctgaaaattccaaaaaccagaatgcctcttctcctccaaaggatcaagacaccttgtcagcaagggaacaaaactggatggagaatgagttacacaaatggacaggagtaggctttagagggtgggtaataacaaactcgtctgagctaaaggagcatgttctaaccaatgcaaggaagctaagaaccttgataaatggttagaggaattgctaactagaataactagtttagagaagaacataaatgatctgatggagctgaaaaacacagcacaagaacttcatgaagcatacacaagtatccatagctgaattgatcaagtggaagaaaggatatcagagattgaagattaacttaatgaaataaagcatgaaaacaagattagagaaaaaagaatgaaaaggaacaaacagagcctccaagaaatatgagacaatgggaaaagaccaaacctatgattgattggtgtatctgaaagtgacagaaagaatggaaccaagttggaaaacacacttcaggatattatccaggagaacttccccaatctagcaagacaggccaacattcaaattcaggaaatacagagaacaccaataagatagtcattgagaagagcaacaccaagacatataatcatcagattcaccaagattgaaatgaaggaaaaaaaatgttaagggcagtcagagagaaagattgggttacccacaaagggaagcccatcagactaacagtggatgtctctgcagaaaccctacaagccagaagaaagcgggtgccaatattcaacattcttaaatgaattttcaacccagaatttcatatccagtcaaactaagcttcataagcgaaggagaaataaattcctttacagacaagcaaatgttgagggattttgtgaccaccaggtcagccttacaagagctcctaaaggaagcactaaatatgaaaaagaaaaaccggtaccagccactgcaagaacatacgaaaatataaagaacaagagcattatgaagaaactgaccaaacaatgtgcaaaataaccagctatcatcataatgacaagatcaaattcacacataacaatattaaccttacatgtaaatgggctaaatgccccaattaaaagacacagactggcaaattggataaagagtcaagaccccttggtgtgttgtattcaggagacccatctcacatgcaaagacacacataggctcaaaataaagggatggaggaatatttaccaagcaaatggaaagcaaaaagaagcaggggttgcaatcctagtctctgataaaacagactttaaaccaacaaagatcaagagagacaaagaagggcattacataatgtaaggggattcatgcaacaagaagagctaactattctaaatatatacgcacccaatacaggatcatccagattcataaagcaagttcttagagacctacaaagagacttagattcgcacacaataatagtgggagactgtaacaccccactggcaatattggacaagtcaatagagagaaaattaacaagaatattcaggatgtgaactcagctctggaccaagtggacctaatagacatctacagaactctccaccccaaatcaatagaatatacattcttctcagcaccacatcacacttattctaaaattgacacataattggaagtaaagcacccctcagcaactgcagaagaatggaaatcataacaaacagtctctcagaccacagtgcatttaaattagaactcaggattaagaaactcactcagaactgcacaattacatggaaaatgaacaacctgctcctgaatgactactgggtaaataaagaaattaaggcagaaataaataagttatttgaaactaatgagaacaaagacacaacatatcagaactttgggacacagccaaagcagtgtttagagggaaatttatagcattaagtgcccacatcagaaagtgggaaggctctaaaactgacacccaacatcacaatttaaagaactagagaagcaacagcaaacaaattcaaaagctagcagaagacaagaaataactaagatcagagcagaactgaaggagatagagacacaaaaaacccttaaaaaatcaatgaattggccgggcgcagtggctcatgcctgtaatcccagcactttgggaggccgaggcgggcagatcacgaggtcaggagatcgagaccatcccggctaaaacggtgaaaccccgtctctactaaaaatacaaaaaattagccaggcgtagtggcgggcacctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaatcaatgaattgaggagctggttttttgaaaatattaacaaaatagaaccctagccagactaataagaaaagggagaagaatcaaatatacacaataaaaaatgagaaaggggagatcaccactgatcccacagaaatataaactaccatcaggtaatactatgaacacctctatgcaaataaactagaaaatctttaagaaattgataaattcctggacacacacagacactcccaagtctaaaccaggaagaaatcaaatccctgaatagaccaataacaagttctgaaattgagaccataattaatagcctaccaaccaaaaaaagcccaggaccagatgaattcacagctgaattctaccagaggtacaaagaggagttggtaccattccttctgaaactattctaaacaatagaagaagagggtctcctccctaacacattttatgaggctagcatcatcctgataccaaaacctggcagagacacaacaaaaaaagaaaatttcaggccagtatccctgatgaacatcaatccaaaaatccttaataaaatactagctaactgaatccagtagcacatcaaaaagcttatctaccacgatcaagtcgacttcatccctgggatgcaagggtggttctacatatgcaaatcaataaatgtaatccatcacataaacagaaccaataacaaaaaaccacatgattatccctacagatgcagaaaaggcctttgataaaattcaacaccccttcatgctaaaaacactcaataaactaggtattgatggaacatatctcaaaataataagagctatttatgacaaacccatattcaatgtatactgaatgggcaaaagctggaagcattccctttgaaaactggcataagacaaggatgccctctctcaccactcctattcaacatagtattggaagctctggccagggcaataaggcaagagaaagaaataatgggtgttcaaataagaagagaggaagtcaaattgtctctgtttgcagatgacatgattgtatatttagaaaaccccatcgtctcagtccaaaatctccttaggctgataagcaacttcagcaaagtctcagaacacaaaatcaatatgcaaaaatcacaagaattcctatacgtcaataatagacacacatagagccaaatcatgagtgaattgccattcacaattgctacaaagagaatgaaatacctaggaatataactgacaaaggatgagaaagaccacttcaaggagaactacaaaccactcttcaaggaaataagagaggacacagacaaatggaaaaacattccatgctcatagataggaagaatcaatgtcgtgcaaatggccatactgcccaaagtaatttataaattcaatgctattcctatcaagctaccattgactttcttcacagaattagaaaaacctactttaaatttcatatggaaccaaaaaagagctcatatacccaagacaatcctaagcaaaaagaacaaagctggaggcatcacactacctgacttcaaactatactacaagtttacagtaaccaaaacagcatggtactggtaccaaaacagatatgtaggccaatggaacagaacagaggcctcagatattacaccacagatgtataaccatctgatctttgacaaacctgacaaaaacaagcaatggggaaaggattccttatttagtaaatggtgctgggaaaactggctagtcatatgcagaaaactgaaactgaaacaacagttgctggagaggatttagagaaataggaatgcttttacactgttggtgggagtgtaaattagtttaaccttgtggaagacagtgtggtgattcctcaaggatctagaactagaaataccacttgacccagcaatcctattactgggtatatacccaaaggattataaatcattctactataaagacacatgcatacctatgttcattgcagcactattcacaatagcaaagacttggaaccaaaccaaatgcccatcaatgttagactggataaagaaaacgtggcacatatataccatggaatactatgtagccataaaaaagaatgagttcatgtcctttgtagggacatggatgaagctggaaaccatcattctcagcaaactaacacaggaacagaaaaccaaactccacatgttctcacttataattgggagttaacaatgagaacacatggacacagggaggggaacattacacaccgaggcctatcagggggtgggtggcaaggggaggcataggattagcacaaatacctaatgcaagtggggcttaaaacctagatgacaggttaatgggtgcagcaaaccaccatggcacatgtatacctatgtaacaaacctgcatgttctgcacatgtatcccagaacttaaagtataataataattacaataaaaaagccacttcattgtttcctccatcaatcacagctagttgaaattatataataaattatgtatataatatatgctaaatcccaagcagtttaagcataatttaaccataatttgaaatcagttacttgaaatcagtcccatgaaatcaatagaaggaataaaaatctcaaattatgtttggaagataattgtctagattagtggtctccaagcttgtttaatcttgcttcacagacattatttacttaaaattctatacatcttctcatataatgtagacctcatgaaacccacaaaaaatagaaattaaaggatcgagataaaaagagaattaatattttcttccaatatcacaatggagtctgtatactccactctgggaaccattagactggtatactctttgaaagccttgtcatgtgagaaagaagaattccttggtttaatgctgttattgcaggaattcttagagtttttactgtgctaccgcacatggtgaattcctgaaagggcaatagagtactgtgtagtgatctaaagaaagacaagtcagagattccagatctgggtctgccactcatgaacaatatcactttagactggttatttaaactcactgaacttcagtttttccatctgtacaatggcaataatgatgtatctccttgggttattacacagattatataagaagatgaatgtaaagcacttagtccaatgcctagcttatgggtatcttatcgcactagtgtactgtgaaaaatacttctggaaatatttcagattagactattcactcactgattatattattaagatactttttaaaatttcacaaatacttatgattatctcctaagtataggtgtagtagtaggctcagggcaacagcatacatagctgaatattctgaaggacttttaaattatttttaactcagaaaaaaatttcagaacctaccatgtgtcagacaccatgtactgctctgcagatatgatgatggccgaggcagatagggtgtctaccttcatgaaacttagagtatgaggaaaggactggtatgatttatggccagtgtttacaaggtaaatgcaaaatagtttaaagagtgttctgataaagggtgaagaagatgggggctattgggttagctgaggtctgcccatgcaaaacttgcacatcattttaaacagttcttactttatcctaaggaaaataggccactttcaaggtcaaagggatgaagggacaaaatattagaaaacacacaatataagcatgtcactgaatataaacaaaagcttgaacaaaataacttcacagtttttcctgtggcaaaaatttactcagactctaattaattttttgtttcagtgaagttttttttttttttttttatgtatcacaaatgtgtttgtgccttccgttgcttgctaactggcaggtgcatcacattaacatagctcttaaaccaaccaagcagagcctgataggtgtggtgggatctgacagtattcatttgatatgaagcaatgactctttgctaaagggcctggactgacagacctgcaaggtaaaagtctctggtgagcttgagaataaactacagaggtttactttccacacatggtctgcaagaccaatttgccataagtatattcaggagagaccactctgccttctgtgaatatatagtctctctattttagacctttttaaaaagcaggaaatgcttctgtcggaagggagaattctgtgaggttgctaaataatgacaaagtgctggaataaacagaaaggagaacatttggccttgagagtttagtgttctactgacagtcagtgttctgacagaggcaaacagtcagagtttgatagtgaatagtctgttctctgtgtaaaagtggacaataacagatgtgtagctccctaggaattgagatgtaaaaatctgcaaactaatttggtttccatttagtgtaagtagaaactgcctcatggaaatagttttaagatgagaggtaatggttcaaaagaaatatataaaatatcttttcttattattttgctaacttagaaaaatatggttgtatatttttctgcttcccatgatatttctttggattaaaaaattttaacacagtttcactggattgcaaaaatgtattttataaacttataatttatcaaatctattagactgaaataagataaatataatacaagaaatcctggttttgtttgagaaggagtctaagagtttatgaacaaaatcagatacacttaataaaacatattgaaatatgtagttcagggaaatcttgacacttatatcacgattagatttagctccatataacagacaacttattaaaaagcagaggtttaagcaaaataaattatttctgtcattaacagaaagtttcttactgaacatttccaggctagtatggtggttttatagttaaggatttaaacttctttcatcattttgcttcaccatcttagcatgtatctttaattctcaaggtgacttcgtagtccgagatgacttctggaattcaagacatctcatggacattctagacttcagaaagaaggaagatttggaggtcatgctactcttcaagagattttccagaggtcaatataatactctaacacttctgcttacatctgattttccagaatttagtcccatggccacattttaagctctaagggaggataggaaacttagctgggtacattagtgacccacgtacaatcaagagtgcactaatacagtatttgtatctgtatgagatgagtatctctgggccagtgtccagaggattccctgaagtgcccggcttactcttcaaagccataagtactatttctctgacatgcacgcaattgctagctctgtcaagtggtagaactttaagtgtatgtttcctagggtgctccatgaccaccgtgtgatggggtccacgtgtgctcagtgtgcattttctggagctggagacttgaactggatgctactcaagcactacttgtttgccaataagtttgatgtggatgttgacctttttgccatccaatgctttgatgagcatctgagacataaaactttgaagacattacaacactgacaattacaggcaattttatgaataataaggaggatacacaaaaaatatccttatctggttcctcttccttgtcagcaagcatcgggaaaatggtatgaagtcctctttggggtggggactcttagttttcttgtcagagaagctgcatgttttctgcagaacaccattggctagatatgtgatagcattaaatgttcacctaaatttaacgtgagggggagtaaaagtagccttgaggccagagcaggtagcattctggaaagaggggaccagggtgcctggggaagaggccgatgcataaggtcagcctgttcaaagagctcagggacttagcaaaacgagaagatttcacctgtgccaaaactattaagaattttaaatgtgacaattttcctggtatcaataaatttatagcaacaaacaaccataaagatacaattgatctgatatgttgtattgaaatagaaatttgattttactgtaaattatttggctaggctggtcttgaactcctgacctcaggtgatccacccaccgcggcttcccaaagtactaggattacaggcgtgagccaccatgcctggcccatcaaagctattttttaagaactgaaatgtgtacactgaaatacacatttataagtgctgcttttaaatatgtgccaacctaactttttctctctacagatgctgaagtagagggaaaaagtgaaaggcaggaggtgctcactttttccctgagcaagaggaaaggcaacttccctcagttcttatggaataaaaagtgcaggccattcaaagtctgccttcaacagagagaaagaggaatcactttcttgagcactttttttctcattcctgtctccttgctcctgtctgggattaggcttgaccttttagtatttctttgtaacaaggaactggaaaataaagattaaaacatggtgggaaatgagggatactaagatgtgttgaacggtggggcaatcaaacagctgttgagttggagagagaaagctggatcatatcagagtggatgctatcaaaagagttatgagcttaacatgacagaaaattgcatgttcttgaaatatgccattacaaaatgtcagcctgacattaagctgctttatagaggtatcatgtccctaaatagcctggtgattattcgtgtccctggagctctactttcctccctgattttgtaataccttggcttgtctttaatcactgcagagtgtcaccatcttagaaaaattcttaaaagaaaattaattttgatttccattgatgtcctagagagttttttttttttttttttttttttttttttttttttaatagctgggatggagatgcagccttctgtcccacaatgacaggaggtagcagtttcctgtaagggtaaggatcctactttgaccacccttaaaaaacaaaagcattttctatatgcccattatgtgttaagcactttacatgcattatctcatttaattctcataaaacctataaggtaagttctattattagactcattgaaattgaagtacagagagaccaagtgacttgcccaagtcactcagctggctagtcagtactaaaatggaaattttaacccaggcagattgattctggagcctattcttaggtagttacactgctttcctcaaggaccatgttccattgagaggcttaagttgggaagataaggtaaattattatgaaatatttatagaaaggacaaaagagagcaagagataacgcattccacctttgtctttagaatggtgtgattaagaaaacaaaaaaacctgggctgggctttatacattaagagaacattctaataaatgctactgccaccagaaaaaaaaaaaaaaaagaagagattattcttgcataaggagaggcaacaggaagtgtgaatgaggagcacaaatgtggaaagtaaagctgtttaaaaaggaaagcagctgcaaacttcccatctgcagtgtttgtttgtctcggctccggccatcactgccacgattacccctggatgaattcctcagtggaaatatcaacaaggtaggaaatgtgataattatattttctattgtcccccaaagaacatattaagatggtagatatggacataatttggaagaaaagtgctatgtagtagacacaattgctgatgaaataaaactagctgatttttcatcctctggtattagcaaaaaggcaaagtcccagatgttattctgtgcctcttctacagtgtagttgtaattgaacaacagctaggcttattggattgctttttgcctttctttataaaataaatatatattaagtatattctagacaatcttctagaggtcatagtagtaacagtgaatgatccaatagatggcttgggatatcacctcatactagttggtggggtatagaaagtattgatgcctgttgatgtaaaaaaggtttctggagggagctaacactcgagggggatttttttgtgactcaaaaatattgaatattgatatgtgatggaatattgatatgttaagctctctttctataacctccagcttttctgatgctgtcacctaagatgcctgctaaagcttgtactctcagcagtcttgcatggcaatctagaagtgtgggaatattaatgtcttgtagggaaaccttcaatcaaaaagaaccatgagacaatggtcaaacatttctctcttttgccccttgggcagccaattgtgagactttttgtatagctcctcataagatctgagtgaaatcacgcacaagttgcccacagtgatgttcaatgccctgtgcgcctttgcactgactttctctcctaccccattttattctcactagatcttctctcctatttcctggaatcatttcctaagtaaacgacctgaatgcaattcttatccaggttctatttttatggaggtcccagactaagacaatgccacatcataataggagcaacatctatgggctgagagatgagaggagtgtttgtcagggtatggtactggcatttaatatggctttctctcctctaccagatatctaaatattggcattgtggaaggtttctctaggatttatctgctcttttaaaatcttcttttctttatctacactttctcttctttatatttctcttctatattttctccttagacaatctacaattctgtggttttaaacaccacctttattttaatgattcccctggattatacctttagtccttatcttgcttcagagcaccagcatcatatatccaattgtctacatatcatctccctttggatgtctaactggcatctttttcttcatttgtacaaaataaaactcttgtttacctcccaatataataaacggtttcctacaaaagaagctgttatgcctctattctttttcatggcaccaccatctacactatagttcagacaaagaaaacctgatgttgttcttggttctaaccttttcacactcttcccagcaagttctgaatattatatctccagaagagatttaaaatttgtccacttatctacatccccactgccattgcccttgtcctaggcataattatcttttgtcaggaccactccaatagtcttataaaatctgttagagataataccatcagaatagtttaaacagatacacaaaagtcactagcccttttcaagcctttcaacggtttcctaaggcatctggaaataaaagttaaaaatctttccatgttcccaaggccctatatgatctaggccctgctaacattagattttttcttcttgtacactattgctatagactgagtgtttatgtgccccctagaatcacatgttaaaacctaactgccaatgtgatggtatttggaaatggggtctttgagaggtgatcagatcatggggcaaaggtttcataaatgggattagtgcccttataaaagaaactccagggagctagttagtcccttccatgtgaggacacagtgagactgctgtctatgagccaggaagtagtcctcaccagaaccaagttcactggtgctttgatcttgaactttccagcctccggatcagtgagaaatacatttctgttgtttataagtcacccagtctatggtattccattacagcagctggagtgaatgaagacatttatgcaccagctacagcagtatcttttcattctccaaaaagcccagcttctatctttcctcagggtcttccatttccaaaccttctacctggatagttccttttcctgcttttcatgggccatactccttattctttaggcctcagtacaaatatctcctcctctgagagtgattcttgtcttggtgacctgttaaaatgccctccatcccagttactgtctatcactacttgtttatttccttcataattcttctcagaaattttgtattgtgttttgagccatttttattttctttttatcttttcaattagaaggtaagctctgtaaggtcagaagtcttatctttcttgacaagttttacattgctaaactagatctggcaactttgtggaatataaatgaataggataattattttgagaaattcttccggatgggtgcatgtaggaatctttttttaaaaaaaaaaatttacactgaggcaaagaatctaataatgtcaatttttcctgtctcaataatctatacatccttgcatctttgaaaccctaatgagaccaggagagggaagtaaacaatcattttttgtgtatgtgtgaatacacaaagacattcttctaaatctttacttcttattttatatggtcagtattattttcaagtaggaagcaaaaccgatgattcatctcttagtaatcaaatttattataaccaattatattttttcaatagcttttatctaaatagaatgattacatctgaaaagcatgagatttttatgggaaaggacacaacttcaattctattcagtctataatgttttctctttttataaaaatgacttggctaacttcttgtaatataaccctgccacacacagaatgaaattcttagtacttcttaactcttcccctcttaagtcattctgtctttcagatacacacaaattcattgtctcaattcctttcaaagacccatgtatccgaaacttcaataccttttatttacaaatgcttcttttactctcgtttcagttttcatacctgccacatcaggatgtggtgcccagctttttcatgtcatcacaggctggatgtatttgcttcattttgtgattctggggcagagggccctgagttcactttggtagccttattctaaaatttggtgccaaatatcacaagtgtcaaaggaataaatgttttttatttttatggtgaaaataatgataaagcaagtccagtcctgtgttgattaactattaataccaatttttattatttctgaaaatatctacacacatttatgtatatcacagctaacattaaattcttaggcaatttttttcttaaaatcttatattagagcatcttgcagctttttgtaatttaggatttctcatactgaattttcctaaagagagacgcatgtctattgtttatgatttagtttcttgatatgtaataactgtatcatgggttttgtaaagcaactgggctgtaatgcatagatttgttaatattgtactctcggtttgccaaaatgacatgaaataatttgattttatatattgctcttgatgccccttgttactctcttatacctagctagactttgagattttacaatacatagattttctgtactctaacctcagggaaaactcattaccactttttcttttcttttcttttcttttcttttcttttttcttttttttttttttttttgagatggagtctctctctgctgcccaggctggagtgcagtggtgcaatttcggctcactgcaacctcaccctcctgggttcaagcgattctcgagcctcagcctcctgagtagctgggattataggcgcatgccaccatgcccggctaatttttgtatttttagtagagacggggtttcaccatgttggtcaggtgggtctcgaatttctgacctcgtgatccacccgcctcagcgtcccaaagtgctgggattacaggcgtgagccactgtacctagccaccacttttgttaattacttgatgggtatgagaagtacctgcttggtgatcagtctcactaatgggtcttgtctcaactaacttgaaaagaacccagaagaagatttgatgtatttgatcagtcaagtgctatccttgattcatctgagtgatttctatcctcttcacctctttctgtctgtgctccatgtttaataatcaaatgctcttaccatcagtgcagaggggtccagacctcccatatgggcagaggcagacaatatctgttccggattttggaacacaggtggcaccatttccacatgggttgttttcacaacttgcaaactggcacagcttgcctgaatacagccttggacactcacaaaacagattttcattatcactgagaagggaaaaaatttaaaaattcattaggaaacaactgatattttctacacacatacacatatatacacatgcatgaacacatatgcaaataaaattataattgcatcttttctaataagtgacttttttctccctcttttctgtttcaacttttgaatatttgtagctgtgtgctttccactgaaagcagattaatagctttatagattatctgaagccatgaattctattttaagccatctatttttatttttgatttgtctcatcttttatttcacactgggtgccttttcagggcttcattgaatatgtgtggtgctgccttaataaagtgcatcaaatgtctattagcaaaaaacatcttagactcaaagctcagaggagaattttaagctggtgataagcttccccactctgaggacaaagtcctccaagagctgcatttgtagtaattctgaaaataagacacagtggggagctataatgactatataactcttcagcttaaaatatggtttggtggccccaggctgtgagtgtgcatgaaagcagagctcaggaaaaatactcctcttacctgccagggaagcattctcaagagggagaagtgacttggagtttgttatttctgcctctctgcatccattgccccatttaaagtaacagatgccttcgttttcctttccaagacccacccctccaccattctcagcccatgttgtctgggagacacagtctccactcggtgccaatcatagtgtatagtgcagggtggatacatgacacgctaggccaactggccaacctctgctagaactctccagagagtactctttttatctgctggtgttgctacactggtaattgatggtggcgtgtgcctgtccagagggaagagcctagctgagaataaatagctaatacttagcaatgtaaatataagtgacagagaaatatagattattgattatctgggtaccagatctagccagtactctgtagttatgtgagacaatatattccactgcttttacatttttaaagccagtttgatttgggattttgtcacttgaagttaaagaattccatttaatcttttctttttttttttgctctcttattacattagttcatacaccttgccatatacagatcttaggagtttacatcttatcttctcaatgcgactgttagctcttaagcataggtgccaggatcagccctgataattgggaaactaacatatttttatgtttttatgacacagcctcccagtctagttgtagatcttacccataccatgaatttttccccagctatctgtatggtttctcaataccttcctcatgtctttgaatccccttactccaaaatttgtgtgtaggaaagaaccatttttttcatcataatgagacctgacttagaaatatgaaggtgtttccttttctaaaaatattcatattttaatattctccatgataatgttgtgaaacactatgaaagtttatgtatcagatagcagataaagctggctttggtggggttgtaaggctttgagaccttcagattttgccaactcataaggcttatcctgtaagtaatcagtaatttatgcattttataaccttcatggaaacctgcatagcattctacacattgcagacagatatggaatctcataagttttcagaattgggaaaaaattatatatcgatgcccctaagatggttataaagtatcctgagcaagattttctgtttccgagaaataaagttttgaggactgcttagctaatgctgttccttgtttcctgagaatagcgataaaagcacagccggaccacctagcaggtacagaaatatttctggtgtgacctaaagtatacgttagaaacttaatgttgtttgggggtaatggataaatctgatataactttgcttccactgaccttacttggagttgaaaggtcagtattaagcatttgtattctgggataaagtctaggaaagtagcattcttgagagctgccttctggaaggaccaaattagtctttttcagatcaaggagaatgcctcatatgtgaaagtcaaactaatctaagcattgattgatttaaatgctttaatcatataaagctaaacagatttggcatgcaggaaagatgattttatggtgaaaaccaaggaaagcactatttttaatcaggtcctattgataaatcaagccccatttcctctttctgctttcatcaggtgttgtcagaagttggttgtgtaaattcatgcggagacgactaactgtgtgcatctgtatgtcagcaggcaactagagtagagagagaactagaaattttatagaaaactctccaagaaaagggaagctcaccatatctaaccaagggcaagtgttcagagtcttctggcctgtcttgatatcccattagcacctcattagcaagagtcagctttactcaattgagatgttgccagatgatggcacttcaaattgtacctcaaagttccaaaagacttcttggagtgtcagacatttcaccagtagtttttgttttctaaatctatctttgctatcgtctgtgttatacctggactcaaaggtttctcctatccagatcttgtcagatcctgttattaaatcacaacttcttcaaaagctaccaagcctgctgttttctctgccacttgacctactttgatgtctctctacatcttgtagcaaaaggcagtgttgacccagaaagggaatgctctaagactgatggatcttatgtaagacagttgacttttggaaatagttttcaaaacagtgtcaccctcttttgctcagtttactttaaatattacattattgctgtgaattagtcactgcttattataattagctttgagagaatatatttatatgaaatatatttttttcatggaatatatcttttcatccctaaatttttaaaaattttatccttcacaagacctgtaaaccacatagaaacctttttttggaaattgtcctgtaagcaagtcaggagatttttctgaattaaaagtaggtctgcgaaataatccagattatggtgaagtttttacctatacaccagaggaccatatttattttggcaattgctgccatccaaagtttgttgtgcacctacatcatggatggatccatgtgccaagtggtgaataagactcgcttttgcattctttgtaggagacatcataaaggcacgaacaaatctctgtaagatacatagtatgtgacaaaggaatagagaaagtatcaagtattttaaggccttagctctgtaatatgtggattcagatgacagtagttactaaaagctggtctgtgaactggcaccaaaggattaccagggactctcctgaatgcgtttgctaaatgcagatttccatgctcctcttgccctctgagattctgatttagaatgtctaaagtaaggctcaagagtctgcctttaaaaaatgtcattaggagactcttttgcatagcctacttttacttaaacccatccctctgagacaaatattctctccagagtgaaagcttgatgggcattagttattattgtgtccttacaggatattataattttatttctgtttttgggctatgttttgacttttgaccaacatatatctgaaaacacatatatccgtcaaagtacaaagatgagaaggttttcattttaggagtgccatatacagtctactgcatgtgcattatgtttaacttcaacataaaagaggaaaaaattcactcggtcattttaaagcttagttaaaaaaataccacctatctaagcatatgccaacaactatatattttggaattgtaactgctacgggatatttgattacaagtctacaatacggtaagaatattaactgtcatttctatgagtattaaaagttacctttagaaaaatttagctgattaaaaaaaatcaaagaagctggcttgaaaagggtgcccactacttatataacacagctagatgccaaaaatcttctagaactaaaaggactcctgcatgtattaacttaaaaaaataaataactcttcttgcactctttgtatctaacagatcattagccgatttcaaagttggccacccacagtgtcaagagagggaggttctcagcaggaaagagtgcagaaatgaatccttatgaataatgtctccagatagttctgaaaaataaaattgctactggcggaaataacccatctctatgtatcggctctgatagcaccacagcccaggctttaggaggtatgcaaatgagatcccaagtagctgtggttcaagtagaactttccatctttttcatgaatttcacaacaccatgataagagcctgctaattacaaagaatacttcccctctcccctgcaagaatcttccttaaaaaattggaatttctgtcaaatgagttgttagctgtgtgtggagactctggctctagtactgtagatagatttttctttgtctgtttctaggacagaactgcctaaatggatgttattttgtgctgtaaggcacaccactacgtgtgtcatttttcatttataactttttaaaagtagccaagcatgaaaataatgggaaaaaaatgcaaaaccaaaattactttgtggtggcctagaaagtgaacttggagaaacatagtctatataatatacccatgaacagagagctcagggaaaatgtcctctgctatagaaacttttttctttatatgaaagggtttttctaaaggcaggaacaagataagaaagggtaagagcaaataaaagtcatagaatgacataggaataaataatacataaaatggaaaatccataaacaattaaaaacactttttttcttgttctagtatctgtccaatttaatcttgtaggcattttgcaaagaaaaatggaatatatggtataatctctcgccttctctcttccctcttccttctttctttctctctctgacaggcatggttcactttacaaaaaaataaacttcattggtaaagaaaaatgaccaaaatttcttccccagcaagtgcatcaggatctcctttccagaaagagatatcttttccatatctctggccttgtgaccctctagttcttatgaaatgaaattaaagttttgcttccaagggagcagacttggagaacatgaagcccaaaaggggagctaacatagtaaacatggccattatctaaatacattaaatgaggtatgtgtgagaatgtgcccagcacagtacttggcattgatcagctgctcattatatattaggaaaaggaggtaagaataaatgaaacatgtaattagttgtgtctgaatcagttaatggtggaataagacaaatatgatgaaatctggtacaaagagaagtgggttgggaaagaaggataaggtgtagggtattgtgggtgaaaaaataaaataatgcattaataattgtttgtcaaatgaatgtatcatttcagtgtctagaattaccctccccccataaaaaaaatctcaggatcttagaattatactctgtgcccaaactacaatttcataataaatttttctcactctgtgctcactgtaaaattagccagtctccagccccctgcatggtaagggcaatctgggcaggattcaatataacagaatctgtaaatgcagtgcttatgaagctctggagctctcaggtaatttcctgtaaagataatgtgcctattttgaagctatttaaggctagaagagttggtatgagcttttaaaatgttattttaatttccactaaaaagacataaaaaattatcttaaaatatttaagccagcaaagtgccatttcacccattcccctgacctcagtaatgttcacatacacacagtttctactcaactgttaccatggtgaattcaccagttatcaggaaggtagaaacacagcacacaacgtcgatggttgttcttttctgatattaagaattatttacaaaattgctgtgggtggaaaatttattccttaaaaatgaatagtagataacaactctctagaaaggtatacatttatgaacccaaagtatcctttatgggtattcctatgttgaatttgcaatgagaatttaattttttttgcagtttctcacttattccacagcctttcttttgtcaaatctttacactccaattttgagttggaaaaaaagcaagaaatttagaggtgttcttgcttctaaatatgttgatttggcaggcttgctctaaaagtagtttgtgtctgccacttagagcaagcaggtgacttttggaattgtcccaaatctctttatatagagtcagtgtactgagcaatgtaaaccagagattactaactggcaagatgtttaatgcctacctcttgaaccccgtggtatatttagattataatctgaagcctagagatgaagttaggtgcacagttgtaagggacaatataaaattcaccacttcatcaaaattcatcaaatttgattaaatatcaaattctccttctacccaatcgttgttcagatctttcccagtcctgtgatctctgctcagaggaagtgacttcacttcctactctatagataaaattttagccttcagcacctctcttgacttccacattatctcttccagcacttattctccatccttttttcctcttaccccaattcccaataacaagtatttctttccaatgctagaatttcacttaatttaatcctatcaatatatttgaagcatagagtataagtagatctgagctgagatgcaagaagcggccttggtccttttaagaattttcactttaacttattggcaatagacattgaaacgtttttgatgagggaatgaattatattatgttttagaattattattctggggaaaatgtctggagaacagtaaacccagggacagagttttccccgttattaatttatcatctgctgggcgtggtgactcatgcctataatctcagcattttgggaggctgaggtgggcagatcacttgaggtcaggagttcaatcccatcctggccaacatggtgaaaccccatctctactaaaaatacaaacaattagctgggtgtggtggcacatgcctgtaattccagctactcaggaggctgaggtgggagaatcactggaacccaggaggtggaggtttcagtgagccgagatcatgccactgcactccagcctgggcaacagagtgagactccatctcaaaaagaaagaaaaaaaaagaatgtgttgtttgttagttccaaatctaccctttataatccttccttgtgatgctggagctggaccctgtaaacacattccctttgccaactggggggatgttaagctttgtcagtagagggcacttgggacactgaaggaagaagaggttctcttcctagctctgccgttctttcctgtcttcttactcctgctggaggcacgcgcaggaaactcagtgctgctcacccccagcaagttccacagcacctcccctggagaattaccaccaggagacagcccatgacccacccaactttccagcttctaggtgtcccagtgggcaaattcttagcaagttcagcagcaccttcaagtgtggctttctagtaagttttcctggaccttatagtgagtggcttgaaacagtttcatagacgccccagtgggcaggaattctagcaagttcagcagcatctttgtggtggcttctcagtgagctccctagagtcccagagggtagcttcccagtgcatttcagcagcgccccattatatggcttcttctttcccagtcttggactggggtatcacagtgaacttttctgtcactcaatggccacactctccatcgtgctctgcataccaggtggtgtgtgtgtgtgtgtgcacaagtgtgtaggtatgtgtgtgtaagtgtgcatgtgtgtgtgtatgtgtgtgagtgtatatgtgtgtcttctgatttgttccttggagcactgtttctcagccctagaggtaggaatggctcctacatccactatacctaaatatggtttttttttttttttttttagacctagtctcgctcttgtcacccaggctggagtgcagtggtgtgaattcggttcactgcagcctccaccttctgggttcaagcaattctcctacttcagcctctcaagtagctgggattacaggcacatgccgccatgcctggctaatttttgtatttttagtagggatgatgttttgccatgttggccaggatggtctcaactcctgacctcaggtgatctgcctgccttggcctcccaaagtgctgggattacaggcgtgagccaccatgcctggcccacctaaaatatttaatgtactctttgcatcttaaaaattaatcccatgttactggataataaatcttcatattaaactttcctaaattactgtgtggctctgtctcttgaccaaaccctgagttatacacagaaatccaagcagaagtgtagataagcttagtggaagtgggcatggagagaaataatttgagagatgctcagggagaaaaatatctttttttgttttttatttttttattatactttaaattctagggtacatgtgcacacgtgaaggtttgttacatatgtatgcatgtgccatgttggtgtgctgcacccattaactcgacatttacattaggtatatctcctaatgctatccctcccccctccctacaccccatgacaggacacggtgtgtgatgttgcccacactgtgtccaagtgttcttattgtttaattcccacctatgagtgagaacatgagatgcttggttttctgttcttgtgatagtttgctgagaatgatgatttccagcttcatccatgtccctacaaaggacatgaactcatccttttttatggctgcatagtattccatggtatatatgtgacacattttcttaatccagtctatcattgatggacatttgggttggttccaagtctttgctattgtgaatagtgctgaaataaacatacatgtgcatgtgtctttatagtagcgtgatttatattcctttggatatatgcccagtaatgggatcgttgggtcaaatgggatttctagttctagatccttgaggaatcccccacactgtcttccacaatggttgaactagtttacagtcccaccaacagtgtaaaagtattcctatttctccacatcctctccagcacctgttgtttcctgactttttaatgattgccattctaactggtatgagatggtatctcatggtggttttgatttgcatttctctgatggccagtgatgatgagcatttttttcatgtgcataaatgtcttcttttgagaagtgtctgttcatatcctttgctcactttttgatgggttttttttattttttcttgtaaatttgtttaagttctttgtagattctggatattagccctttgtcatttgggtagattgtaaaattttcctcccattctgtagggtgcctgttcactctgatggtagtttcttttgctgtgcagaagctctttagtttaattagatcccatttgtcaattttggcttatgttgccattgcttttgatgttttagtcatgaagtccttgcccatgcctatgtcctgaatggtattgcctaggttttcttctacagtttttatggttttaggcctaacatttaagtctttaatccattttgaattaatttttgtataaggtgtaaggaaggaatccaatttcagctttctacatatggctagccagttttccgagcaccatttgttaaatagggaatcctttccccatttcttgtttttgccagatttgtcaaagatcagatggttgtagatgcgtgctattatttctgagggctctgttctgttccattggtctatatctctgttttggtaccagtaccatgctgtttttgttaccatagccttgtagtaccgtttgaagtcaggtagcatgatgccaacagctttgttcttttggcttaggattgtcttggcaatgtgggctcttttttggttccatataaactttaaagtagtttttttccaattctgtgaagaaagtcattggtagtttgatggggatgtcattgaatctatagattaccttgggcagtatggccattttcccgatattgattcttcctatccatgagcatggaatgttcttccattgagcagtggtttgtagttctccttgaagaggtccttcacatcctttgtaagttggattccgagatattttattctctttgaagcaattgtgaatgggagttcactcatgatttggctctctgtttgtctgttattggtatataggaatgcctgtgatttttggacatcgattttgtatcctgagactttactgaagttgcttatcagcctaaggagattgtgggctgagatgatggagttttctaaatatacaatcatgtcatctgcaaacggggacaatttgacttcctcttttcctaattgaatactctttatttctttctcctgcctaattgccctggccagaacttccaacactatgttgaataggagtgatgagagagggcatccctgtcttgtgccagttttcaaagggaatgcttccagtttttgcccattcagtatgatattggctgtgggtttgtcataaatagctcttattattttgagatatgtcccatcaatacctagtttattgagagtttttagcatgaagacctgctgaattttgtcaaagcccttttctgcatctattgagataatcatgtggtttttgtctttggttctgtttatatgatggattccatttattgatttgcttatgttgaaccaggcttgcatcccagggatgaagccaacttgatcatggttgataagctttttgatgtgctgctggatttggtatgccagtattttattgaggatttttgcattgatgttcatcagggacattggtctaaaattctctttttttgttgtgtctcggccaggcatggtatcaggataatgttggcctcacaaaatgagttatggaggagtccctctttttctattgattggagtaatttccgaaggaatggtaccagctcctccttgtacctctggtagaattccgttgtgattccgtctggtcctggacttttttgggttggtaggctgttaattattgcctcaatttcagaacctgttattggtctattcagggattcaacttcttcctggtttagtcttgggagggtgtatgtgtcaaggaatttatccatttcttctagattttctagtttatttgcatagatgtgtttatagtattctctgatggtagtgtgtatttccatgggatcggtggtgatatcccctttatcattttttattgtgtctatttgattcttctctcttttcttctttgttagtcttgctagcggtctatcaattttgttgatcttttcaaaaaaccagctcctggattcgttgattttttgaggagttttttgtgtctctatctccttcagttctgctctgatcttagttatttcttgccttctgctagcttttgaatatgtttgctcttgcttctctagttcttttaattgtgttgttagggtgtcaattttagatctttcctgctttctcttgtgggcatttggtgctataaatttccctctacatactgctttaaatgtgtcccagagattctggtttgttgtgtctttgttctcattggtttcaaagaacatctttatttctgccttcatttcgttatgtacccagtagtcattcaggagcaggttgttcagtttccatgtagttgagcggttttgactgagttttttaatcctgtgttctggtttgattgcactgtggtctgagagacagtttgtaataatttctgttcttttacatttgctgaggagtgctttacttccaactatgtggtcagttttggaataagtgcgatgtggtgctgagaagaatgtacattctgttgatttggggttgagagttctgtaaatgtctattaggtcctcttggtgcagagctgagttcaattcctggatatccttgttaactttctgtgtcatggatctgtctaatattgacagtggggtgttaaagtctcccattattatggtgtgggagtctaagtctctttaggtgtctaagggcttgctttatgaatctgggtgctcctgtattgggtgcatatattaggatagttagcttttcctgttgaattgatccctttaacattatataatggccttctttgtctcttttgatctttgttgatttaaagtcttgtttatcagagactagaattgcaacccctgctttttttttgttttccatttgcttggtagatcttccttcatcccattattttgagcctatgtgtgtctctgcatgtgagatgggtctcctgaatacagcacactggtgggtcttgactctttatccaatttgctagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgattttgcagcggctggtactggttgttcctttccatgtttagtgcttccttcaggagctcttttagggcaggcctggtggtgacaaaaatctctcagcatttgcttgtctgtaaagtattttatttctccttcacttatgaagcttagtttggctggatatgaaattctgggttgaacattcttttccttaagaatgttgaatattggcccccactctcttctggcttgtagagtttctgctgagtgatctgctgttattctgatgggcttccctttgtaggtaacctgacctttctctctggccgcccttaatgtttttttccttcatttcaactttggtgaatctgacaattacgtgtcttggagttgcacttctcaaggagtttctttgtggcgttctctgtatttcctgaatttgactgttgggctgccttgctaggttggggaagttctcctggataatatcctgagagtgttttccaacttggttccattcttcccaacactttcaggtacaccaatcagacgtagatttgttttttttacatagccccatatttcttggaggctttgttcatttctttttactcttttttcttaaacttctcttcttgcttcatttcattcatttgatcttcagtcgctgttaccctttcttccacttgatcaaatcggctactgaagcttgtgcatgcatcacgtagttcttgtgccatggttttcagctccatcaggtcaattaaggtcttctctacactgtttattctagttagccattcatctaacctttttgaaggtttttagcttctttgcaatgggttcgaacatcctcctttagctcagagaagtttgttattaccgatcatctgaagccttcttctctcaactcgtcaaaataattctccatccagctttgttctattgctggtgaggagctgtgttcctttggaggagaagaggcactctgacttttagaattttcagcttttctgctctggtttctccctatctttgtggttttatctacctttggtctttgatgatggtgatgtacagatggggttttggtgtggatgtcctttctgtttgttagttttccttctaacagtcaggaccctcagctgcaggtctgttggagtttcctggaggtccactccagaccctgttttcctgggtatcaccagtggaggctgcagaacagcaaatattgtagaacggcagatgttgctgcctgatccttggtctggaagcttcgtttcagaggggcacctggctgtatgaggtgtcagtcggcccttactgggaggtgtcttccagttaggctactcgggggtccgggacccacttgaggaggcagtctatccattctcagatctcaaactccatgctcggagaaccactactctcttcaaagctgtcagatagggacgtttaagtctgtagaagtttctgctgccttttgttcagctatgccctgcccgcagaggcagagtctacagaagcaggcaggcctccttgaactgcggtgggctccacccacttcgagcttcctggctgctttgtttacctactcaagcctccgccatggcagacgcccctcccccacccttgctgtcacctcgtagttcaatctcagactgctgtgctagcagtgtgtgaggctctatgggtgtgggaccctctgagccaggcacgggatataatctcctggtgtgccatttgctaagaccattggaaaagtgcagtattagggtgggagtgtcccgattttccaggtactgtctgtcatggcctcccttggctaggaaagggaattccccgactccttatgcttcctgggtgagacgatgccctgccctgctccatgggctgtacccagtgtgcaacaagccctggtgagatgaacccggtacttcaggtgcaactgcagaaatcacctgtcttctatgtcattcacgttgggagctgtagactggagctgttcctatttgtccatctgggaacctccccctatttcagggagaaaaatatctaacttgatgattggtttctggtttgtctagctgagtagattttggtgccattcttgaaactgaagaatatataaatttagaaagtcgagggagaatataatgagttcatttataggcatatattatttgatgtatccatggacatgctagtaactattttcagtagtgtaggaataagttatcaatataacttattttaaaaataacataaacataattaggcttttattataattaagaaaacctctggattacaatgctggttggtggagagagggagaggctactgaagaaaaataaactttgactcaaataccttacaaattcaaagtactagagcagctacttacatatcaacaaaacagtaaagtttgcactaaaagcttttatccattgtacttatctaaatagaaagatccccatgtgtatggggacatggtgtggcagaatcctttttaggcttaaatgcatatatactctttctcttataaatgcaattaccacgcatgaaatagctatgaaatatctgttcatcctggggacagtttggttagcttcttgggaatagttgtgaagatgaaaactatgtccatgaaggaaagctgactgagtagaaagtatttcagctcgtttccatacaactgttgttattgttgatgatgatgatgatgattcattataaaatgaagcatctggggtgactgcctaactggacaggatgccaggataacaggggtaaacagggactatcccagctaaaccaggggtgtggtcaccttctatttgaagtcataacattttttccttaggttattgttgtactgaacgtattaaatatagagtttccatcttaaactaattctgaagtagagatgctgtgattttattttaactgttgtattatctggaaactcattctactggggctcaaatttacatatatttagggcatgagcatggtgacggttaatactgagggtcaacttgattggattgaaggatgcaaggtattaatcctgcatgtgtctgtgagggtgttgccaaaggacattaacatttgagtcagtgggctgggggagacagacccacccttaatctggtgggcaccatctaatcagctgcaagcgaatataaatcaggcagcaaaaatggcctagtcttccagcctacatttttctcctgtgcttggatgcttcctgccctcaaacatcggactccaagttcttcagttttaagacttggactgcctctccttgctcctcaagcttgcagacagcctattgtgggaccttgtgatcatgtaagttaaaacttaacaaacttcccattatatctctgtctatctgtctgtctgtctgtctgtctgtatctatctatctatctatctatctatctatctatctatctattctgtccctttatggaaacctgactaattcaggcttggaccaatattttgtgttaagttgttgagactgagacacaaagatcagataactgaaaacagttttcctgaagaaggaactactgataataaatcactgctttgctgcctttgaaataatgtgcttcctcctaccccctttctctttctttttcttttttaatcctgaaaggggtaatttcagttttaaatacaagaggctgaaagtggcttcaggctttttcaattaaaagatttagtttgcaacttctttgcactggaaaagactaaatctcttggaatcagttgacatgatgttaaaatggactgtgctatttctttaaaagccatgtacaatggccatttctcatcaaaaggtgttttggctgtaggcaagcttcttagttccataaccttatggatggtaaaggacagtttcaaaaggcatttatacctagttaacactttttttttttgacacactattagatgtgacaattttcttttacaataaatggataaaagaataaaaggaacaaccaactttccctgctgtttcaatagtttcaattagtttatttcccctcaattgctccttcagatgggctagataagatttcactatttggggggatcgttttaagcttcttttccagcagtttgttatttttaaagctccagtgattcactataaaatgcatctccatctgcaggaagcaattcctaaattgcttcactcaacaaatccaaaactgctaggctcactatagcacagaaatagaactgatttggaaagggattacctattgggttcagaaaaacctcttctgagagaggttatggcatggagcagatctctgaatgccagagggaacttttattttattgtatttagcaagaatcgtttgaagttttgtttattggtctgaactatttcctggtaaaaatatactttggtaactaatatatataaattatgagttattgcaaactccagttccgaattaaaattttctaagcaacttaaaattatgtctgaatatacatacttaaatacgtttttttccagaacttactaaatcttaagttgaatttatttcacttaaggttaatccttttccccacctccccttggcacaaatatgcaaaatattaacctttagcctgaaaatgttatttccattacttatagaatagggtcaaatatttggcatatattttatctacattaaagtgtaacatgggttagaaaatcttggtttatattagttgttttcaatctaattaaagtaaaatagaaacaagaaaaaaatgcaggtcaagcgacaaggaattgtttgctagtttaatcacatataggaagctattgttatccttgagacttagacaagttgactattctataggatttttaaagacaggacatgatttatcttaatactgtgtcagcattttcctgaaactgatttagccttttgcattaaaaagaagagacacactagaacttttaattgaaaaaacctgcagctactttcaacctctaatatctaaaatcaagttatctctttctgaaaagaacaaaaaggaagtagctaatcttgaagttgttcaggagtcatttattaccaaaagtatttttactgactgtcccaattcctttaggaaacttcaagctatgaagagcataatatataaaacagactatttaagggatactttgtcttattacaaaagttgtcactcaagtctccaataaatagcttcatacaaattttttttcagggatacaccatttgccacaggcaaaactgtcacatcgcatttggttttacactggagttccttgatgttgttccataagcctccatgaggggcagaggagcaggccttccatccactctgccatgcctcgaccagagttagtttgctttatttattcattcattcattcacccactcaacgtttactgaactttttccctattccaggcactgctaggcactgtacaactgtgttgaatgaaatagatatcatcccgttttgcattgagtttgcaatctagatggtgagacaagaattaagtaactaaatagaaaatgacacattatattaagtcctaaaagagaatatcacattggtgctatgggagagcacagcaggcggcctattttagataaatggttgggggagagttttcagtggaattaataattaatccgaaacataaaaaatgcaaaattgggtaaggtgaggaataggaaatgtttaaatagtgaacaacagatatgaatgctaagatatgagagaaagtctgacatagttcaggactggaaagtagccacttttgcccagagttcagcaaaaaggagatttgaaaaactatacagaggctagatcatgtaggatgtctttgataacaaaatgtactcaacatgtaacttaaccataattagtgtgattttactccccagcagctgaaggcaatactctacaaaaaattccaaatatatattataacatagtattcacctttgttcaaagaattgattcagcccataatcagtcacaacacctcctagcatttagagcaatggcttcctttacatatggaaccaaattttggaagccgaagttggaactttcttactaaggcctccagggctggatatgatctggcccctgttccactctgtgactggactctttccactctctcactgtgctcttgcttcacatgtccttggtgtgccatgccacatcaccacggctccaactgacttttaatgtaactatgctgacagttccctgggaactcagactcactgcactctgacaacttctcaccataaacagcaaaccatttcttctacccttgtgaaaacacagtctgaaggagcagagtcaatgccccacgggggaaactctcaaccaacgtggctggaagtcagcagataattgcttctgcctttaggtgaacacttcttgcagataatctgtaggctactcaggatgtcccagcagaatagaatcctcgaagtagggactctacaactctgcttaatgccggcttttccctctgccctgtcttcctgtcccgagtctttcccttgctccttgggactgcctccaataaattgcttgtaactaaacctgtggtataacctctgcttttgggggaattcgaagctatggttctggtctttttaatttgcatacagtctgtgtttgctccccatttagttcctttgtgcttggcctagaaccttctttctcttttgtatgatactctcatggctgacgccttctcatcattcagtttcagcctcaatgttatttcctgagaagagcctttcctctaatccagtgttgttctcaactgcttgtcactacttcattacgtaactcttagtatgtttattataactgatcacttttgagatgtgcgtattttcttattaacttattttattacacatttacttgtattgtacctagaattataagctccaggagagcacaacccttactatgctgtgaaggattgtgctcacaaagtctagaacaatggctgtcatataatggtcatgcagtaaatatgagttgaaggaattaacaaatgaaattcaatgtgttttcaaggtgggataatagaatatagaataatgcttttcttttaagagcatgcatttgaaacagtctcttatagtgtttccattactaagaagatacatctgaagcttccatcaagtaagtaaaaagaataaaaaaaaaaattcaaattttagatgcagctgtcctttactggtaacttttcacttatttttagttttactaaaatgtcctaactggatagtaattacccttgtgagagagggtatgtactatcaggggacataagagagcctcctggggtgctgaaaaatgttacctagcttgatttgggttgtggttacatggttttgtacatatgtaagaattcattgagatttgtgtgctttactgtatgtatgttatcttttattttaaaaatcttgaccaagttcgtgcatggggagcaaaaatacgcaccaattttgtaagttttaaaaatataaagacctctttagtgtcaaatttatttttcagatagtccgtcaaatcctgattttcgaaatcttagtttggttgttaaggaataccttgatcatatttttacattgaagttatcaaatactttatattaacatagggaaaaatcaatctatactatgtaaattcttggagaggcggaatctttcttcttcaatacacttttttttttgaaaatgtacctttttttagtgaaaattgtgtatcaattggaaacactttatcagctgtcgtagaaataatacgctatcttaatcttctttgcattggtcctgtgaagaaattttataatgggtaggtggagtgtttccatttttattaaatttgtatttgcttgttctttccatttgcatctcatgctaaattacatggcaaaattaacaccaactgaagtgcaggttctaaatggaaatctattatatcctcccatattttaatcaggacttatgtgttttataaatggcaattaagcttttcatggagtgcactggtaatgctcatataacatgaagcaccaaacatataggagtaatctcatagcattagggtagatcccaattactggccaagtaggctacatcttttgtcatctgggttgagatgctggatgttctccattctgaaagtatctgctcattgtcccatagctgctccatgaaaatccatttttggtgtttgcttcattttaggaagagaactaaacattcttctcataatttaaggactcttccagtgccaacatgtcaatgatactcatggccaatgagtatctcaatgatactctttttctttgatgcaatgatttcattcacttattgattcaggcattcaataaatatttatgaagttctgatgtgttaggcacaggtttgctaaggtagaaagacacataaggtgtgaccatatctgatcaagattttagtctaaattagtagttcttaaagttagttttgcatctgaattactagtcagaaatacagatctatagttctcaccaaggagctacttactagaagcagaatctgggggcatgggaactgagtgagttcctagattagagatacacagctttgatggccagatttttagctctccataatattccctttgcaagaacttgacccaattcgggactaaaaagaaaatctttatattgatctgagtctcccaactgttgtagatgtaatcattggctagacttgtactcttttgagcaatattcttcttccaatgtgaatggcatgtagttaatatcaaataagtatttgttgaacaataaacgactgactgacagtctttcaaccattcaaactcagctgtcttcaggctaatcatttcttatggtatggcttcaagacctatataggaacttgaatgttggcatctgagatttcctggtagttagggtaagaatgggaacttgatgctcaatgcttttaatcatgctttgattttacaatgtctaaataatttgtaaattttatgttgagcaaaaggaaatagccctttatctactggcttgggccatacaaggatcatcttaaatctatttatctattttatttcaaggaacattgaatattcttttgagtacattttacagggttaaaagttgatatattttaagtttgtattttaagatatattgtctacagaacaaggcctatggtcagttttctaggttagataacataaaaatgaagttataattggaagtcccatagtttgtacagactaaacaaaaggaaaaagttgtatatgtgtggctgcattccaaaaaaaagtgatgttattactttagatcattttgttaaacgtttggaacatttcaagaagtaatgctatgcaagtttcaacatagcacattctcaaaatgaaaaacacttcagggaatttggtaataaggtgataacaagatgatgaggtgctaaagaagttagtttctgctttgaattttttttagtccattatccttattgatgtcttataacacttcgatctatatactgaccttttattctgactgctaccttcactgtgcctatcacacatttttgggagatggcgatatattatgaaaagttgaaagtgcccccaaaagcattaaatcaaatgctataaaattgagtgctgacatttttcaaaagtgcaaaaagtacaatagtgagagtttcagagtgtcgaatattaccatggaaggaaactggccctgggagaattaaatctgagtatagaaaatgaggcaactttaatatttgacacaaaaggttgttttcttactttttgctaatggaatataattaagcattaattgctcttattctcctttgaatcagacattcaaagggcaggtaggtcaggatactgtctggctcatttattagaaaagcatgcaaacagttgacctagaaacacattgacagaacaagggcctactagtgggacagcatctgcaggcataagcaccagttagatattaatataagctccaaatatgtaagtacactacttttctccagggacatgctacagtttcacttctttatgttgagcatggaatataatgagaatatatccagaccattaagtgactaaaactgagaaaggccttaactaaaagaggaaagaggaataaaaggtgttttttttttttttttttgtctttgaaaatagaatggagggattcccaggcaagatagccaaataggaaaagctccagtctgcagctcccactgagaccaaagcagaaggccagtgatttctgcatttccaactgaggtaaccagttcatctcgttgggactggttagacaatgggtacagcccacagagggtgggcagaatcagggaggggtgtcccctcatccaggaagcacaaggggtcggggaactccatcccctagccaagggaagccctgagggactgtgccataagggacagtgcactctggcccaaatactacacttttcccatggtctttgcaacctgcagactgggagattccctcgggtgcccacgtcaccagggccctaggtttcaagcacaaaactgggcagccgtttgggcagccactgagctagatgcagaagttttttttcataccccagtggtacctggaaccccagtgagacagaaccattcactcccctggaaagggggctgaagccagggagccaagtggtcttgctcagcagatctcacccccatggagcccagcactggcttgaaattcttgctgccatcacagcagtctgaagttgacctcggatgctagagcttggtggggggaggggcatttgccattactgaagcttgagttttcccctcacagtgtaaacaaagcttcctggaagttcaaactgggtggaacccactgcagtgcctcaaagaaactgtagtcagactgcctctctagatactgcctctctgggaagggcatctctgaaagaaaggcagcagccccagtcaggagcttatagacaaaactcccatctccctgggacagagcactgggggaaggggcagctgtgggcgcagcttcagcagacttatacattcctgcctgccagctctgaagagagtagcagatctcccagcacagtgctcaagctctgctaagggacagactgcctcctcaaatgggtccttgacccctgtgcctcctgaaggggagacacctcccagcaggggttgacacacacctcatacaggagagctctgtctggcatctggcaggtgcccctctggggcgaagcttccagaggaaggatcaggcagcaatctttgctgttctgcagcctccattggcgatacccagggaaacaaggtctggagtggacccccagcaaactccagcagacctgctgaagagaggtcagactggtagaaggaaaactaacaaacagaaagcaacagcatcaagatcaacaaaaaggatgaccatgcaaaaactccatccaaaggtcatcaacagcaaagaccaaaggtgataaatccatgaagatgtggtaaaccagcgtaaaaaggctaaaaattccaaaaaccagaatgcctcttctcccccaaaggatcacaacttcgtgtaagcaagggcacaaaactggatggagaatgagtttgacggattgacagaagtaggcttcagaaggtgggtaataacaaactcctctgagctaaaggagcatgttctaatccaatgaaagaaagctaagaaccttgataaaaggttagagaaatttcaaactagggtaaccagtttagagaagaacataaatgacctgatggagctgaaaaacatagcacgtaaacttcatgaagcatacacaagtatgaatagccgaattgatcaagtggaagaaaggatatcagagattgaagatcagtttaatgagataaagtgtgaagaaaagattagagaaaaaagaatggaaaggaataaacaaggcctccaagaaatatgggactatgtgaaaagaccaaacctacattgattggtgtacctgaaagttatggggagaagggaaccaagttggaaaacacacttcagaatattatccagaacttccccaacctagcaagacaggccaacattcaaattcaggaaatacagagaacaccacaaagaagagcaaccccaagacacataatcgtcagattcaccaaggtagaaataagggaaaagatgttaaggggagccagagagaaaggtcggggaagccacaaaggagagcccattagactaacagctgatctctgcagaaaccctagaaaccagaagagtgggtgtcaatattcaacattcttaaagaaaagaattttcaacctagaatttcatatccagccaaactatgcttcataagtgaaggagaaataaaatcctttacagacaagcaaatgctgaaggattttgtcaccactaggcctgccttacaagagctcctgaagaaagcattaaatatagaaaggaaaaactggtacgagccacagcagaaacaaaccaaaatgtaaagaccatcaacactatgaagaaactgcatcaactaatgggcaaaataactagctagcatcatagtgacaggatcaaattaatacataacaatattaaccttaactgaaaatgggctaaatgccccaattaaaaggcacagacttgcaaattggattaagagtcaagacttctcagtctgctgtattcaggagacccatctcacgtacaaagtcacacataggctcaaaataaaaggatggaggaagatttaccaagcagatgaaaaaaaaagcaggggttacaatcctagtctctgataaaacagactttaaaccaacaaagatcaaaaaagacaaagggcattacataatggtaaaggaaacaatgaaacaagaagagctaactatcctaaatatatatgcacccaatacaggagcacccagattcataaagcaagttcctagagacctacaaagatacttagtttcccacacaataatagcccactgtcaatattagacagatcaatgagacagaaaattaacaaggatattcagaacgtgaactcagctctggaacaagcggacctaacagatatctacagaactctccaccctaaatcaacacaatatacattcttctcagcaccacatagcacttattctaaaattgaccacataattggaagtaaaatactcctcagtaaatgcaaaagaatggaaataataacaaacagtctttcagaccacagtgcaatcaaattagaactcaggattaagaaattcactcaaaaccacacaaccacatggaaactgaacaacctcctgaatgactactgggtaaataacaaaattaaggcagaaataaataagttatttgaaaccaatgagaataaagacacactgtaccagaatctctgggacacagctaaagaagtgtttagagggaaatttatagcactaaatgcccacaggagaaagcaggaaggatctaaaatcgacaccctaacatcagaattaaaagaactagagaagcaagagcaaatatattcaaaagctagcagaagacaagaaataactaagatcagagcagaacttgaaggagatacagcatgaaaaacccttcaaaacatcaatgaatccaggagctggttttttgaaaacattaacaaaatagaacacaagccagactaagaacaagagagagaagaatcaaatagacacaataaaaagtgatagaggggaaatcaccactgatcccacagaaatacaaactaccatcagagaatactataaatacctctgcacaaataaactagaaaatctagaaggaatggataaattcctggacacatacagcctcccaagactaaaccaggaagaagtcaaatccctgaatagaccaataacaagttctgaaactgaggcagtaattaatagcctactgacaaaaaagtacccaggaccagacaaattcacggccgaattctaccagaggtacaaagaggagctggtaccatcttcttaacctattctaaacaatagaagaagagggtttccaccctaactcattttatgaggccagcatcatcctgatacctaagcctggcagagacacagcaaaaaaagatcatttcaggccaatatccctgatgaacatcgatgcaaaaatcctccataaaatactagcaaactaaatccagcagcacattaaaaagcttatccacgaccatcaagtcagcttcatccctgggaggcaaggctggttcaacatacgcaaatcaataaacataatccatcacataaacagaaccaatgaaaaaaaccacatgattatctcaatagatgcagaaaaggccttcattaaaattcaacaccccttcatgctaaaaacactcaataaactaggtattgatggaacatatctcaaaataataagagctatttatgacaaacccatggccaatcatactgaatgggcaaaagctggtagcattccctttgaaaaccggcacaagacaaggatgctctctttcaccattccatttctacatactattggaagttctggccaggggaatcaggcaagagaacgaaataaagggtattcaaataggaagagagaattcaaattgcctgtttgagatgacatgattgtatatttagaaaaccccattgtctcagcccaaaatctccttaagctgataagcaacttcagcaaaatctcaggatacaaaatcaatgtgtaaaaatcacaagcattcctatacaccaataatagacaaacagagccaaactatgagcaaactcacatttacaattggtacaaacagagtaaaattcctatcaatacaacttacaagggatgtgaaggacttcttcaaggagaactacaaaccactgctcaaggaaataagagaggacgcaaacaaatggaaaaacattccatgctcatgcacgggaataatcaatattgtgaaaatggccatactgcccaaattaatttataaatttgatgctattcccatcaagctaccattgactttcttcacagaattagaaaaacctactttaaatttcatatggaaccaaaaaagagcccatatagacaagacaatcctaagccaaaagaacaaagctggaggcatcacactacctgacttcaaattaatctacaaggctacagtaaccaaaacagcatggtactggtaccaaaacacatacatagaccaatggaacagaacagaggcctcagaaataccaccacacatctacaaccatctgatctttgacaaacctgccaaaaacaagcaatggggaaaggattccttatttaataaatggtgttgggaaaactggctagtcatatgcagaaaactgaaactggaccccttccttaaatcttatacaaaaatcaactcaaaatgaattaaacatttaaacataagacctaaaaccatgaaaaccctagaagaaaacctcggcaataccattcaggacataggcatgggcaaagacttcatgactgaaacaccaaaagcaattgtaacaaaagccaaaatggacaaatggggtctaattaaactaaagagcttctgtacagcaaaagaaactatcgtcagagtgaacaggcagcctacagaatgagagaaaaattttgcaatctgtccatctgacaaagggctaatatcctgaatccataaggaacttaaacaaatttacaagaaaaaaaccaacaaccccatccaaaagtaggcaaaggatatgaagagatacttttcaaaagaagacgtttatgcagccaacaagcatatgaaaaaaagctcatcactggtcattaaagaaatacaaatcaaaaccacaatgagataccaccttacaccagttagaatgatgatcattaaaaagtcaggaaacaacagatattggagaggatgtggagaaataggacacttttacactgttggtgggagggtaaattagtttagccttgtggaagacactgtggcgattcctcaaggatctagaactagaaatgccatttgacccagcaatcctaatactgggtatatacccaaaggattgtaaatcattttactataaagacacatgcacacatatgttgcttgcttcactgatcacaatagcaaagacttggaaccaacccaaatgcccacaaatgttagattggataaagaaaatgtggtacatatacaccatggaatactatgcagccataaaaaaaggatgagttcttgtcctgtgcagggacaaggatgagtctggaaaccatcattcttagcaaactaacacaggaacagaaaaccaaacccgcatgttctcactcgtgagtgggagttgaacaatgaggacatatgagcacagggaggggaacatcatgcaccagggcctgttggtggttggggggcaaggggagggatagcattaaggaaaatacctaatgtagatgacggactgatgggtgcagcaaaccaccatggcacatgtatacctatataacttgcatgttctgcacatgtatcccagaacttaaagtccaataataataatagtaataaaaacagtgaaaaaggggagtcatcagtccaagctttaaatttatcttcagagctaaaattcagagcagatgtttttatgccctactcagctgacacagctcagacaggggtttgatttgatcaatcctatttgaaatttggaacttctcctgtccactaagaatataagttgtgtatccctttcctggagatctttaaaaagtggtgagaactctaatttcctgggttgaggggggcttacgcatttggacttctgagagacctgactgtgtgaggagcctgaggggagacagcaagaccatcacccttcccatctgcctagagcccttgctaaactgtggaaggggtgtaatattctgagtttaagaaagcaaactgtctttaaaaaagagcccccacttttccctggcacagggtgcatttggagtctagacaagattgaatattatcccccaaaatgtatatccacccagaacttgtaactgtgaccttctggggaaacaaggtttttatagatgtaatcaagtcaggatgagaccatcctggattagggtgggtgttaaatccaatatgactggtatccttataagaagagggaacttcagacagacagacgcagacatacagagacgtccatgtgaagacagaggcagaaactggagtgatgctgctaggagtcaaggaacactgaggatgccagcagccacaagaagctggaagagacgaggaaggatcctaccctggagccttcagacggaggatggctctggcaacaccttttgattttacatttctgacttccagaactgggagggcataaaatctgttgtttttttttgtttgtttgtttgttttttttttgagatggagtctcactctgtcgcccaggctggagtgcagtggcacaatctctgctcactgcaacctctgcctcctgggttcaagcgattcccctgcctcagcctcccatgtagctggcactacaagggcccgccaccatgcccagctgattttttttattattatttttagtagagatggggtttcaccgtgttagccaggatggtctcgatctcctgacctcgtgatccggctgcctcggcctcccaaagtgctaggattacaggccttagccactgcgcccggccaaatcctgttgttttaagccactcagtttgtggtactttgttatggcagccccagaaaactaatacagcatctgatgtgtccatgttggctgtactaagacagggccattgagacttgcctggccgtcttctgtggacagctttctagatgcacctaagtcaagtccctgaggcccaccgagccattattctgttctgggtcaccccccatggcctcaccctcactgtcttgcctttcattaaacatgcacttgtgagcgataaaaaaaaaaaagaatggaggcattgtacataaatatttgatgatatagcctatttaaaatttagatagcatcttttcccacaatctcaatgatttcatttttttttcagttgttaaatcagctaaaattgtatccaactactataatatagtattaattactgtacaatataagagaaaatggaggcaataatcattgaattggcattttggatttcaggagacataaaaatcatttaacacctgttttattttagagataaaagaactgagaactatgaaattatcacagctagttagcagagttggaatcaggaactaaattctctgttaaaaagcaataactttagatcataagtggtcaacctgtgctagccattctatgaaatttgtgtactctgtggataattttaagattaatgttgggttttacctattctggtcataatcctattctgcttttggtctacatggcatctttcagtaagatagatcttccaaccacctcatcacatacagagtaaaatatggtctcccttgcttgccttacatactatttaacctcatgtattgctacctgaaaccaagcacttaattcttccttcagtgaagtactaagccatgtgtgtagtcctagttcccacccacacgtctgtccttatttgctgaactcttcctccgcttaatacactctttctccaaatcttcctctaatttatgtggacaattcttatttaatcgttgagatcatgatttgttttttttttttttttttttttttttttcagaaagctttttataagcttgacagaacttcaatgaacttgggctaaatgtttctattactgaaaaaatactttgtgaatattttaatattagtgtttaccacattattggaatatggtatctgtctgtccaactatgttgtaaatttcttcaaagaccagaaacacttgggctgaaacatcagtctccaacgattttttaaattgttcgtatgattttcataactccaaccatctcctgttgcttatgagttccaaatctctatgtcctttctggatctatctcttgagtaccaagatttaattccactgtatcgtgtaagcagtttcctcattacatatattacaatgcactgaatcatttgtttttaggttggacttatttatgtgcccctcagattattttgtataactaatttttatgtattcaaggcatgtacctgtttgcttagttattttttagtagattttatttttcagaggaattttatgttcacagcaaaatagagtgggaagtacagagttcccatatacctcctgtccccacacatgtacagccttcctcaatatcaacatcccacctcagagcggtacatgggttacaattgatgaggctacactgacacatttttataactcccaaatccatatcttacattcatgcttactcttggtgttgtacattctatgtgtttggacaaatacagaatgacatatatgcaccattcatgcagaatattttctctgccctcaaaattctctgtgctctgcctattcatccattcctccctgctctcctctggcaatcaatgatcttttcatcatctccatagttttgccttcttccaaaagtcatatcgttgaagtcatacagtatgtagctttttgaaatgggcttctttcatttagtaatatgtatttacggttcctctatttttttcacgtctcaataggtcatttccttttccattctattatctggatgtaccacagtttattcacctactgaagtatattttactgcttccaagttttggaaattatgaataaagctgctattgcttagttatttttcataatgcaaaaacacattataaatgattacaatatgcagaagtatatataaagcagtaagtactgatgtcgtgatctctcctttcctcctcatctgtattccactcaccacagatgatctgttaagagtttagtgtatatccttccaattaccttcaatgacaagtttattgaatatgtgaaccagcttaaggccaaagatgttactgaatttatccaaaacatgtattgaggcatgtagtaggctgaacaatggtcttcaaagatatcagctcctaaaccctggaacttgtcaatgttttatctgtgtttgcagttgtgattaagttaaaaatcttgagatggggagactatattttggattatctgggtgccctctgaatgctattacaaggatccttgtaagggagagacagagagattacccagactgaagaagagatagcaatgtgaccacagagatagagattggagtgatgcatccacacgtaaggaatgctggcagccaccagaaactgaagaggcaagatatggattctcaccgacagcctctggaatgagtgtgccataagccatctttggtttcaccgcagtgaaattaattttggattcctggtgtcagaactgtgagtgaagacatatctgttgttttaagtcactaagtttgtggtaatttgttatagcaatgactaatacaagtccttactgtgtttctgcactgggccatctggttcaggtaaaaagacaaatagaaaactggccttgactttgaaaactttggagtagagtttatatgacaggttggttatggcttgcaggtctatacaccagggtatggtgcttttgcatttcccagagatgaataaggagccagcagagattgtaaagcagggaagtggaatcatcacctttgtttctgagggagatgaagcagctggaagcagagacattaataagattatcactcatgaaacctgaggagagtttacactgtgaccgtggcagtagcaccaagaagaatcttgagtttaggagacttttctgaagtagacgtaaaaatatttggcaattacatcattttcgagtcatgttaccacgctgggccaaacatcttgtccctaataacgatttctgtagtgatatttgggttttttcctaactaaatcacagcagttctgcataaaaatattttgagtattggctgggcgtgatggctcatgcctgtaatcccagcacgttgggaggctgaggcgggtgggtcacgaggtcaggagttggagaccagcctgaccaacatggtgaaatcccatttctacgaaaaatacaaaaaaaatttagctgggcgtggtggcgcatgtctgtaatcccagctgctcaggaggctgaggcaggagaatcttttgaacccgggaggcggaggttgctgtgagccaagaacatgccactgcactccagcctgagcaaaagagcgagattccatctcaaaataataataataaaaataaataaataaaataaaaaatgagtattattttgaaattttaaaaatcagggataatattcttttaaagatataatttttaaacaatctttttccaaattcttgatagtgtttattcttaatctataaaaaaagaagtaacacagaaatttatatcacacacaactttcatcaaggaaagattactaatatggtgattttattttagctgaactcaaatatcactcgaatgatgaatcaaattaatgtgaaaagtcataactatcttagtattaaacctcagagaaaagaatgtaagattaaattaatagcattttaagtatatattgatggaatcatttttccaataaatagactagtcagattaagaagcagtgagtttttagtgcatcattatgaagaataagtgcaaattttgttcaaatgaaatgaataaacatgcagtcacaaccaggctgctctgtattcctagtaataattactatataaaaggttaataaatgtcaagtaaaagcagctatgacctgcctaaaggttaagctgaaaacagctaaaatggaaaaaaagagagtgcagattattacgtttattgactgacactggttcttagagaacagacaattctggaatgattaattgataattaaatttcaaacaagtacctttaacctctaaacatgaagataattcaaggtccctaccagactcatactgcctattaatgtacttcccttcaccctgttttctgagaattagcaaagtctgtggctagttttttttctgagtatcttcacaacatgttgaattaatgaagaagatatccccaactagatcctcaaggcacagggttggggcaggcagggcaccaaatgtcactctcctttctaaaatctagcagagatttccagagtggaaatgatgccaaacatttggcttgggatataaggtactttatgatatgaatctgccttcatttttaactttctttttcacaactccttccaaatcccatactgcagctagtaaactacttactgttcccccactaatgccacaattttgcctgtacccagaacactatgtcccttcttcaaaggctgggccaattcctgtttatgcctcaggattcattcaggctgcctcttctggaaagtgttctttgatccttccaggtaacatttctttctcatagcactgagcacagtgcaccctcattttaggtttactcatgcctctcccttgctcaactgtaaggcctgttaggacagatgctgactcatatgctctatatatcaagaatatttatagcagagtgttttgcccctgccaggtgcttgatgaatgtttgttgaataaatagattccttaaggagtaaagagaagatattcagtaacaaaggaaagaggagtagcctttttgttaattttggctgaaatctacatttatagcataagtttgtaagaatatttttcagtgaaaggacacctactcatttacctattgtcaattgatggcctttttttccttagtgcagtaattggaaaataatcacgtagagctacggtttgctttgtaccttcctatgaagtcaaacctgtttagattttttttacctgctacttctttctagcatggctattaaaaaacacaatcttttttcatgacattgaacagcctgcaggtattatttacttatttatccttagcacagaataataacaataaaaatgcaataacaaatgcattagtagaagttcatgttaggtatattaaaatatatacagttttggtggtgccttgttgggaaatgcccttgctttataataaccctcattatctaccagaaaataagtacaatgggggagggggtgtgaagtccaagagaaatcaaattacacttaatttctcttaatagcaaacaagaacattcggctttttaaaaatagcacacaactttcccatatatttagaactcaagcagatcttaaggattgaggctgtgcacacgcacagcagagcttacagaagtcccaggtcactcacctctccccagctgacagaacctgcacacaggtgtagaggagatatcagagaacttggtgaggagttaaaagcagggaaagagtgaaaaattatgtaaagtttaatgtgcttcacattcatacacagatccatcagcagaaaatggaaggcttattggcttgaggtgttggagtgaaagctctgatttttttttctttgctgaatgataagctatacaaatacaggaatgacctacaggaaggcaagcttaaaaataaaacaacaactgaacaaagatattggtagctgcacattctggaggagacagacgtcataaatttaggcaagtttactaaacaaatggaagaaaacaacaaccgtgaggtggaaaatagaatccagagttgctacaatatatcatataaaaaggccagtactcaacaaaaaaagtatgagacctgcaaagaaacaacctgtgatacatatttagactatagaagtcgtcagtagaaattatctctgagtgtcctcagatattagatatagcatacaaacagtcaaaagcagctgttataagtatgtccaaataactaaagaaaattgtgatggcaaccacttagtgaatataaaaccccagtgaagagttagaaattattttaaaaatagagaatcaaatggaaattctgtagttgaaatgtacaaagacaaataaaaaatgcaccagagggcttcaacagaaactgagatgttagaagaaatagtcaataaatgtgaagatagacagagattatctaaactgaagaatagaatgaaaaaggattgaagtgaaataaacatactgttcgagatgtataggataatatgaactatacagacacatgtgtaatgcaccgaggagagcaaataaaggcccctagaactttttgaagaaaaagtggctaaaaacttttcaaatcgtatgaagaatataactttacaaatccaagaagtttaatgaaccccagttagaataaacacaaaattatctacaactagacatacaatagtcactgttgaaagctaaatccaaagaaaaaaacttgaaagcagcaagagaaagccaactcttcaaatatagggaacaaatattactaatagctaacttctcattagagataatggaagccagtcagcactggaataagatacaagttgaatatcccttatccgacatgtttgggatctgaactatttcaaattttggattttttgaactttggaatattttcattagacttactgttcagcatccctaatccaaaaaccagaatccaaaataagtttcagattttgaagcatttcagattttggatttttatttatttatttattatttaattgagacagagtctcactctgttgcccaggttggagtgcagtggcacaatcttggctcactgcaacttctgcccccctggttcaagtgacccttctgccccacccttctaagcagctaggattacaggtacccaccaccacacttggctaatttttatattgtttagtagagatggggtttcaccaggttggccaggctggtcttgaactcctgtcctcaaatgatcttcctgtcttggcctcccaaagtgctgggattacaagcatgaggcaccgtgcctagcccttggatttttagattagggatagtcaacttgtattcacattgctgaaaaaaccaaaccaaaaaaaattctgattgtcaatcagaattttatgcccagcaaaaactatttttcaaaatgaaagtgaaataaagacattatagataaataaagactgagaatttcttgttagtagaaatattaaaggaattctttcaggctggcaacttaagtcctcaggaagaaacaagtgtactggaaatggtaaatgtgcagcaaacaaagggatctatattttttctcatttcatctttaaacttctttaagagaaaataaaattgtataaagcagtaattataacattgtattttttgggttacaacatataaatgtatattatgtatgataataataatgaaaagtttgggaggaaaaaagctataaaagagaaaagtttataatttttattggaattacattagtattctgaaatagattgtggtaaattaagatgcacattgtaatccctaaaaaacactaagaaaataatacaaaataatataaaaaatccaaaagggaattcaaatagtatgctaaaaatattgactgtagaataaggcataaaaatggcaatagagcaagagtttactgaaagaggggcatgggcggtaacagtatatgaataaagatgtaggttgcttatggaggtttgttggaagttctcttctgattatgtataccagggtaattggctaagcatgaagtaggggagaaggtgctaggtgttagagaagaaaggagaagtactaaatgtcacctaggagaaggaaagagtgaatagctttgggaaatttaagattttggaggtgcactaaggatccatcagaagttggtaattatgaatttaatgcgcaaccagttgtcacagtcatatattttttgccagactaggtcagctttacaggtgtaggtgcagtggaggagaaagaaacacagatttgaggttatatggaagaatgaacatattgatcaaatatggaatctaagctgggagtggaatctgagctcatgaggaagaaaaaatatccttcacgctaatacatgtgaggggtaggaaggtcatcaagctggagattcagggagttgagaaacaatgtgagcaaaagcatagagtagaaataaacacaatatgtaaaggaaaggaatgagttagacctgactgatgtgataggtatggaaagggaaatttgtaagaataaaattggttagggaatatagactgaaatggcacttaggtacttaacttcattgtttctctagtttatctatctaataatctttggtggcaatgaggcctaacctgaacctatgtcaaatggaatactcttcccttgctacccctgccttgtgaaagcacttctccttccctttaccctagtccccctaccccgctacacttataactttctcataacttaccaatttatggtttcttttctacccctaggatgtaagctccatgaaagcagggatgttttgtctgttttattcagtctatagaacaggaccctggatgtagtcttccccaatagatattgatggaacgcagacaggaggtatcctcttgtgcagaaatagctatcaggtgaggcagattagaaaatggacatggtcaatgactccaatttagtctcactgtgtgagaaggacacacaaaagactgtaggtagaatctaagatgttctgaaaaggtgaaattatacaaacatctttatttataaccctcgattttgtccttttctacatatagccctcctcctgccaaaagcttactttaaggcaaagataactagcgttgctccagtcttatccactgtttatttttctatagcttttctcatgtagtgtcttaaatatatgaagagttccatttgtaatcatggcagccagaagtgggcctgcgaggctcagctctcttttctgcttggctggggccctgtgtctcaactgtccttgcttcatgctcttggagtagtaaaggatgtgcagcttgtgtttcctctgaatgactccttgacccgagttgtttccagtaactcagtctgatacatttatttctcatattcatcttaatacattcttactttgacttacccaacctttttttttctatcttcacactatagtgacccttgttatgacttagcaactgatgatatagcaatgtatccatgcccgatagctcccaagattagcagtttaagcataggttagggttcaatatacctggaagcatgcacactcaacctgggaaagcagtgtcaggccttcggctcctcatcctggataataggggaagtctttcaaaattgattcaatgctgtagaaaatggtgaccttccaaatcacctctgggaagatgagcaagtattaactgggaacttaggccagataatgggactctcctctctgcagttcttggggaaggaactgagaggtgtctgtcatgaagccatggaaagacgagcctcagggcccttcacttgcataagttttgcctggagaagcaacaggcattttgtatttgctattctgaattatttttcttagaagcctctccaaattgcaaagcttcagggactgacaagatctagatctggaagaaatttttgtatgagtcaaaccagacaaattagaaaggcctcttttgcatctgtggtaaaatacacataccataaaattcactgtttaaaccattctaaagtgtatagttcagtggcatttagtacattcacattgttgtgcaactgtcaccactatctagttctagaatatttttatcaccccaaaggaaacaccatgcccattaagcagtcactcgtcatttcctgctggctcctgtcctctgcgatcactaatctgctttctgtttctatgggtttacctagtatggatgtttcatataaatggaattcaacatgtggccttttgtgtctgtgtctggcttttctcacttagcatgttttcaaggcttcaaggcttatccatgtcgtagcatgtatcagtactttgttcccttttatgtggaaaggcctttaaataaaagatcattttagagaggatgtagccagttaaataaggggatttctttttttttcttttttttttttttttttgagacggagtctcgctctgtcacccaggctggagtgcggtggcacaatctcggctcgctgcaagctctgcctcccaggttcacgccattctcctgcctcagcctcctgagtagctgggattacaggcgcccgccaccacgcccggctaattttttgtattttttagtagagatggggtttcaccatgttagccaggatggtctccatctcctgacctcgtgatccacccgcctctgcctcccaaagtgctgggattacaggcgtaagccaccgcgcctggccaaataaggggatttcaggagtaaaatttaatagaatgactcaaatactatcagcggcacattttatggtactgtattgtgttaaattctctaacccagtggactagaatttgcctgtcgattttgatctttacactgattccaaccaaacgatcatggctaacctgtaagcttttcttgacatatacctattctgctcagaaataattttgtgtcagttgtctctcctactcctatccccgttatggcctttcttgtctgggtcagcatccagactaagctggataattgaaattccagaaaaaaacatttctcctgattttagtgaggacatttgaaaataacctacgtgttgctcaatccctgaagctcatttgaatgtctgctcttatatttaaaaagcaatgtatgccacctggaagcaaaaaataactgtagtttgctaatgttgtcactatgctgcgtcaatctctaatttgttataaaatgtaggaagatatttcgagtaagagggtgtctacctcaattcttcaaaattatacccagttttccttgttatgaagcataattactttacaaagctataaaatgccataaagttttagtaattcacttagcatttcattcactatatttttagtctactgtactgcaaaggttgaaagacattttatgttttatctgaggtgccatccacaaattacggcacctattatgcaaataatgcctgcaaaagaagtctgctgcatttataatagggcagcttattagaatttggcttgattttctttataccttgcttctcatctcttgctataactgtgtccattgtcagtgagatgctagtataatcttcatgtttattcaaaccaaagcctctaaatacatacattttagattttggattcaaatgatggcctagtttagtttctgtgttagaacttaagtattctgtatttgcaccttactgaacgcttttgaaaagcttttagttctaatgttacattttagcattatttaaaatttcataacattttacttatattagctttgcaaatctcctgtattgcttgggtaacagaggtatgatagtaaaatcagcttctatctgtttagctcattgagaatgatgagggtaaaactgttcccaaggagtgaaaactgtttcttgcttttatacatatatataaaaacacagatatacatatactatgtaaacatatattcggtatattgatcatattgaaatatcttggatgggtcagttaagaaaaaaaaaacctaaaaaaaggacctggaggggagcaataatgaaaaaacaatagactgaggaacactggtctagctctttaaagtttcatagtgtgtttatccttactacttcttttgacaggaaagccaagattgcatagtgtgtacacagcagatccatgcctggactctggtgttctatttccataactgtgcttctcctgctgtggcatgtagacttagactagggcttgatgggctcttgcaaggaagaaatatcttccttgttaccttttctttcaggcctagtttataaattaagaatattgggtcctcaaacttatcaagtttattcgttttcccctttctttctaatatatgtgaggcctatacctctcctttggcttaagtggggcccatatatctctagatttacaaaggccatggataaagacaagtgtagacacatggctgtgggagtgaggggattgcttctatcccccatgatccaaatcactttggatcttcaggatcaaggattcctaaagctttgaggtactcaatttttgtctccttttcctctttctaaccctcaagatctcctaagccagtttctgattttagtaataacatggtctctaagaacccatagatatagcccttttctgtgttcctctttacgacagtccaaatattttaaactatctcctcttagcataacttgaatatataagtaccaaggcattcatttttttatctgtataaatttaagggacaaaagtgcagttttgtttcatgaatagtggtgaagtctgggcttttagtgtatctaccacccaaataatgtatgttgttcccattaagtaatttctcatctcttactcccctcttaccttccacccttctgcagctccagcgcctatcattccacactctgtgttcatgtgtatacattatttagctcccacttataagtgagaacatgtaatatttgccttttgtttgagttgtttcacttatgataatggccttcagtgccatacatgctgctgaaaaagacatgatttcattcttttttatgcctgaatagtattgactgtatatatgtacacacacacacacacacacaaacgtatatatatatatatatatacgtttgtgtgtgtgtgtgtgtgtgtgtgtgtgtaaatatatctgtctcagtctctatcaatctataacattggccagtcatcacatgatagacaggttgattccacatctttgctattgtggatagtgctgtgataaacatacaagtgcagatatcaaatgtttaacaagcatatgaaaaaatactcaacattgctaatcatcaagaatgcaaattaaaaccacacgagataccatcttatacagttagaatggctattattaaaaagacaaaaatttaaaaatgctgatgaggatgcagagaaaaggaatacttatacacttttggtaaatgtaaattagtacaacctctatggaaaacagtataaagatttctcaaagaactactcattgccttggaaaaggcattatttttgtttgttcttttttatttttttgagatggagtctcgttctattgcctaggctggagtgcagtggtgcgatcttggctcactgcaacctccacatcccgggttcaagtgattctcctgcctcagcctcctgagtagctgggattacaggcacccaccaccacgctcggctaatttttgtaattttagtagagatggggtttcacaatgttagccaggctagtctcgaactcctgacctcaggttatccgccctcctacgcctcccacagtgctgggattacagatgttagccgctgcacctagctagaaaagacattcatttttaataaaccatcattttctatctaaatggctattttctatctaaatggctatagcatcagccctgacctcacttcttcactaaagagagaatagggagtggaaaaagatgtttctgggactgaaagaaaatttctgctttatataatttgctactaaacctaagactgtttcaggggaatggtgggatcattgaaggctattttttttttaaggggaagcagaatacaagatgtgaacactggattattggctgtgcttataatgttaaacgtgaggtgagatatggaggaaatgaggctgaaaaggcccatagagccaggtcatgaaggggatgcatatgcgaagatgagaaatttgggttttattctgtagggcagtggttctgaaaatgccctctatgtggccttctgatttttatggaaatccttaatatatcaccacagagggcaaaaaggaatagcaagtgaatgaaactcttggtttcctaactcattttatcagcacaatccattcctgtctgtgttttcttccaattgatcaatctatcatttatctatcatctatttcacactctattactctctctatatatttttaatttactaggcccacatataagaatgtctttgcaaataaaatctaccgacatatatttctgactggataatttggctaatacattcatcaggaaactgaatacgctggtaccccagttctagtggtatgctggagttggtttgtaccaacctactagaggcaattgttaaatttcaggaattttgaatgctggttgacatcaagttggtatcttgaagttgattgtggttgggatatcaaaccagtgaaatcagcaaatgctacaaatcagatactttttccccacatcctccttgcagagagctgcttgttaaacctttactaacacgccgcttccagttctcaaactttggtgcatgttaaaattaactggggaggtgtaagaaattctggtgtctgagccacccccagaaattcctattaagctggtagaaggtgtcatctggacatcaggactatcaaaatcttccccaggtaattctaataagcactgaagtttgagaaccatgacactacatacagctcaagatagatgtcaatgttgtgtattgatttggaagtcaaggtcatgaagtgatatttttaaaaatgagggaggatgacacctctaaaagaaaacatgtcaagagaaaagtgcagtgagccaaggatggaaccccaaggaatattgttgcttaaggggtggacgaaggaggaagaggaggagcttaaaagaagactgaaaaatgggagaaacggaagaaaataatattacagaaatcaatgatttagagtttccagccccataagatagaattaagcaatagcaggaatattttgctccccacaagtactttccaactattaagactttctcaaatagaataggccacttaaagaaggaacccagaagccaaatgactaaatgtcagtggtggtgttgaaagcatccctcactgaaggggaggttggggctactgataaagaactttcagactgaagggatgctaaaatttaatgactatgtaatcagacacaggcgattctgatttaatttgagatggaattctgtgtaccgaaaggtcatggtaaaaataaatagaaaaaaagtcattccaagtctttggaattgtgtactttaactctttataagcaaacatgtctgccaaatggcccctagttgtcttttcctttggttcaatgctgtaatgccggttttcatggcttctgtgttgtattgtggttttactgccattggtcttgtgttactaattgtacttaccatacagaagaaatttcacattaatatcaggactaaaactcttttaaatcatgttgatatattagatagttttgaatggcaattacttttaaattttgccagggcataataaatctatttcaagtgtaccttttttttcctctaaaacaagaaaatgagagagttaaaatatttatattattagcattttaaaagaagttttccactattattttctgtatttgtgtgatttattggcttgaagttatggcaaaattattttagatagcagttgttaattactcagcattaattaaatgaagtgaaaaaagaaataaaacatatttctcagaatgacttctattcatggcaagttacttgattctggtttcccaaaacaatatgctttatcagtgagagagaaacaaacatttggtttgaacttggctgttcacagattatgatattgcttagcaaagcagaaaattatgaaatctaggttgaagtcattggttaaaaaaaaaaaaaagcccctgatgtaaatgcatttgcacacatttcaattgcagtcgcttttcccacaaatcagctttatcagctccattagcagttgacgccaataaaaatctgaggtcaacttcctgctggttggttcttaagtgtcagaaataatatattctgtgttacaaatgtcccagaggtatatatgtctgctccttccaacactgctataacttattctccagcataaacatctgcccttatgctcattaaaagttgctcttaaaaataggaaatcaagtaaaaacaaactaataagtgaacagcctgacacaggctaactgccaagaacagattggttctgtattcagaactcccactgacatcagacttggcttgggttttattcatattattttccattcatttatttgtttatttaatattttacatcataattgataatccttgagcaatgaaactaaaaattatcaaaactttggacagtatgacctgggtcattccttgttagatattatggtctccttttttctttcttcatctaaagatacagtctggcatagattcaaattttttaggttaaatacaaatatttttcctttgacaattttaaaaattaattatactaattggagataccatgaggttttataactccagatctggaaatctgaggaaaacacaaaacaaatagtacttggccaactatgtccttcttatgtatctcaaatttaacaagtatttattgaacatctatgtgttgagtatgtgcaaagatgagtaaaacatgtaccctatccttaaggagctaatgatttaaaggacaagatagatgtaaactagtaatcataataagtgcaatcattaagatactcagaaagcccaagttttatttatttttatttttattaagttttgctgatatagttcatgcagatccttgaagccctagatttagatctgtctctcgggatttgcaaagttgtagagaggaagggagagaggaacagtgcataagcaggagctttgcattttctatttcttaccattttatacctctatttcaatatctttatagtgaagcatcctttttgtcgtaagtctctccatgttgctaggatttttcactggctaccctgatggctttgtttagtactcaaatttctaggccagggctattcaatatgcagataatgtgaaccacatataaaattttaaatattctaatagccacattataaaaaataaaaaacaggtgaaattaattttaataatatattctttttaacccgatagaccccaaacattattattgcaacatataatcaatatttaaaagactgttaatgatatattttacttttaaaaaatgtccagtgtgtattttacacttagagcacaactcaattcagactagccaaaattcaaatgcttaatagttgcatcagtgatatggtttagatgtgtgtccctgccaaaatctcttatgttgaaatgtaatccccaatgttggaggggggcctggtggaggtggttggattatgggggtggatttctcatgaatggtttaccaccatcccctgggtgctgttctggtgttagtgagagagttctcatgagatctggtcgtttagaagtgtgcagcactccccacccgcccccccgacttgctcctactccccctttgccttccaccatgtttggaagcttcctgaggcctccccagaagcagaagccatgatgcttcctgtgtagccctcagaactgtgagccaattagacaaacctcttttctttataaattacccagtgtcaggaatttacagcagtgcaagaatggactaatacagtgaggttagcagatactgtgttagacgacacagttctagatatttaactctttagggtttcttttttatctatttattcctttgtgtgtaaatgaactttgacaacttgccagatagctttttctcaggctgaaccagggaaagtcattttttcatatcccctaaagggagccagaaagcaactctatgagagttataaatgtctcagttgttttagctctcaattcttgcaaacactggagagttttcatatttcctttccccatccataagattactccaggcacttggatgtaggagaaagaagaaaactgacatgtgaactgttcattttgtataaatatatgtgctaacaattattgagatagaatttatatacaataaaattcactcatttaaggcatacagttcaatggtttttagtgcacatatagagttgtgcaaataccatcatccaatttcagaacatttttgtcattttaaacagaagctccatgcccattatcatgcactatacatacttcccatgtccttagttttaggcaactactcatctattttctgtctctatagatttgtctaatttgaaaatgtcatataaattgtatcattaaaaatgtttggcatatttcgcttagtattatttttaaaggttcattcatgctgtagcatgcatcagtacttcattccttttattattacaatagttttcttccgtatgtatataccacattttgtttatccattcatcagatgatggacctttgggtttacaccttttagttatgaacaatgctgctatgaatattcaggtacagacataccttgttttattgtgtcttgttttatcgtgcattgcagataatgtgttttttttgaaggtttgtggcaaccctacatcaagtctatcaatgtcatttttccaacagcgtatgcttctttctgtctctttgtgacattttggtaattctggtaatatttcaaactttttcattattacgtattttatggtagtctgtgattagtgatccctgatgttactattgtaattgttttcaggtgccacaaaccactcctatataagatggtgaacttaattgaaacatgttgtatgtattctgactgctccactgactgtctgctccccacatctctctctctaggactccctataccccaagacacaacaatattgaaattaggccaattaataaccctacaatgacctctaagtgtttaagtaaaagaaagagtctcacttaaactgtccaaatcactttaaatataaagctagaaatgatgaagtttagtgaggaaggcatgtagaaagctaagataggtagaaagctaggcctcttgcaccaaacagccaagttgtaaatgcaaaggaaaaattcttgaagggaatttaaaaaatccattgttcacacaaatgataaggcaaaacaaggccgggtgcagtggctcacgcctgtaatcccaggactttgggaggtcaaggtgggcagatcacctgaagtaaggagttcgagatcagcctggccaacagggtgaaaccccatctctactaaaatacaaaaattagttgggcatggttacaggagcctgtaatcccagctactcaggaggctgaggcaggagaatcacctgaactcgggaggcagagattccagtgagccaagattgcgccactgcactctagcctgggtgacagagcaagaccctgtctcaaccgtctcaaaaaaaaaaaaaaaaagcaaaacaactctattgctgatatggagcaagttttagtggtctggatagaaaaacaaaccagacaacattcctttaagccaaaagctaatccagagcagggccttaactcttttttgattgtatgaagcttgagagaggtgagaaagctacagaagaaaagtttgaagctagcagaggttggttcatgaggtttaaagaaagagccatctctataacgttaaagtgtaaggtgaagcagcaagtgctagtagaagctacagcatgttattcagaaaatctagctaatattattgatgaaggtggctacactaaacaatagatttttaaatgttgataaaatagccttatattgaaagaaggtgccatctaggactttctaagctagacagaagtcaatgcctgacttcaaaacttcaaaggacaagccaactttcttgttaggggctaatgcagctggtgactttaagttgaagccaatgctcatttaccatcctgaaaatcctagggcctttaagaattatgctaaagccattctgcttgtgctctacaaatggaacaatgaagcctgatgatagcacctctgtttacagcatggtttactgaatgttttaagcttactgttgagacctactgctcagaaaaaagattcctttcaaaatactgctactcattgacaatgcacctggttacccaaaagctttgttggagaggcacaaggagactagtgttttcatgcctgctgataaaccatatattctgtagcccatgaattaaggagtattttgacattcaagtcttattatttaacaaatgtatttttgtaaggctatagctgccataaatagtgattcctctgatggactaggcaaagtcagttgaaacctttctggaaagaattcaccattctatatgccattaagaatacctatgattcatgggaggtggtcagaatagcaacattaacaggagtatggaagaagttgattccagtactcatggatgactttgaggggttcagaacttcagtggaggaagtaattgcagatgtggtgaaaaagcaagagaactagaattagaattggagcctgaagatgtgactgaattgctgcaatctcatgatagaactttaatgaatgtgaagttgcttcttatgaatgagcaaagatgttggtcccttgagatggaatctactcctggtgaagttgatgtaaacgttactgaaatgacaacaaaggattcagagtatacagaaatttagttgataaagcagtggtaggatttgaaacaagttctgctatgggtaaaatgctatcaaacagcatcacatgctacaaagaaatgtttcttaaaaggaagatttaattgatttggcaaactttactgttgtcttattttaagaaattgtcactgccatctcaacattcagcaaccactatcctgctcagtcagcagccatcaacatccagacaagaccctctacctgcggaaagatgacaacacactgaaggctcagatgattgttggcatatattttcattttattctggtataaatgtagtagtggaaacttctctccgaagtggctgcaccatttcatcagcaatgtatgaaaattcaattttctcatatccttgccttaactgttattgtctataattttgactacagctatcctagtggatgtgaaatggtatctcattgtggttttggtctttgtttccctaatgctaatgatgttaagcatttattttcttgtgctttttggccatttgtgtgtttctttggaaaaatgtctattcgaattttttacccatttgaaatttgatgatttgtcttttcattgttgttttgtgagagtttttttaaaaatatatattctggatacaagttcttcatcagatatataatttgtacatactttctcccattctgtgggttgtcttttcattttcttgatggcatccttgaaacacaaatgttttaaattttgatgaaatgcaattatctttttctctcttgttatgtccgatttgctgttgtagcatacgttatatttacaccatctttgtgcatgactaaaacatagccatagcctctgtttgctggagtcgatggagaaaagcagcaatgaaacatgcagtgacagtaaagcaagaagttccaggtgctgtgtatttaccccacaggaacaattaatcttgtctcatgttagtgagaggacacggaatgtttcagaagggacaatttagaagctgacaggtcaggaagtgttatttaacagtgaggaaaggaaagaatttagttatgtgtactgttcatgacggcaatataaaaatttttcaaagatatttgtgttatgaaattccttggtttctgatacaagcagtgtcatgtaactgtgtgtgcatgtgtacacgtgcacgcgcgtgcatgtgcacatgtatgtgtttagagaatgcacttcaggatcttgcaacccagctcagggccatctttctgaaggtcagttgttggtctggctaagcatagaaatactggttgatagaagtagctgatagaatagtggaaaaagtcatacaaggacaaagctacataatctgctctcactgtagttaagaccttaatatttatactaaagctaactgcaaacaacctctgtatatttggaaaaatacactgtgtccaagagtcttttaaaggctttggcattttcctctgttcatgctaaaagacatagcaacaggataaggaacagtctcaccttcaacttttgtacttgaccaaccccagttcttacctttctttatgtattttaaaatccgtttagataaatgcataacttatgaacactgggaaaaattgtggataaaatgttcttaaaattattgtttgtaccaaatgtcaaatggcaggaattgaaattaaaacagacatgaaataggcaataaaggtaaaatcaataaagtagatttcacaaaaggctgagttacacagcttttatgatgagtccaatttttagggtagacagaaccctggggatgtatgctcccattggtgtgtaggcatcactccgatttactttaatgagccttatcagcgggaaacaagggaaaatagattcttcagctctcctttcctattgccggctccaaagcccttaacaaagtacacaccatgcattagtttggggtactattcagataagagtcactcagcaaggaaagtattcaaaatcctgcaaagccttgttttgtatattgttcaggagatccagttagtacataaacagttattctctgtactagagtgtctttatcccaggctgtgcagatttaagaattacctcaaggcaatctgtaatgcagataatattggcaactaagtgcaaatgcagataaaagattgcataaataatactcctgatgggaattaccgcataacatttatagtaggatccatgccatcctttgtaatctgatgctatataatgccatgagattacgtgattaatttagataagcagcattactgaaatattttatatttagttactacattaaagaaaaatagtatcctaaaatctaggtggtttattaacatgaacgcattgattataattttgaatactaggttgcatgcctacttaatatggtaattcttcttgcttctttgaccattagttcaattccatagatgaaaattgcatttccaccctgtaacatagacattgtgttacatgctaagatgcaaaatgagcaatatcctggagatatttcattggcaataggtgctcatcctaaggagctcatccacagatctgcctgtgagtccagaaagcaactcagcctggtcatgcagtatcagtaaagagtccaagaagatgacacagagccaaatcttcaagctgagggagaattagccaggtggcagcaagggtattcaaagccagcagcactcacctcacttattataagtgctgtatatcatttccgtcgaaacaagtacatttccatttaaaaggtaattataactaactaaagaggtagagaaatgctacactaagcaagtgctaaacaagtgtagcatttttctgcctccttaattagttacaagcacctttgtaagaaagaagcaaagtacacattccttattttattaagtcatgtaaaagctttcaggagtggctgctccagtccaatacatttgcaagaatttgtagagaatcctttgcaagcctggcattaggcttacattcagggtaattgggtacccagggctataatacacttaactttcagcagcgactttcttcaaagctgtgctctgaggccatttttctagtctaagaaaactaggagaaggaaagtaagtaaattttggggagaaaggagcagggcatcgctgaggaatgcagggcagcaaccatggtcccaaaggaaggtagcagtgagtttggggcaggtattgacaggctggatgggaagaccacatgagtagtgggcaacagaagtggagagaagtgtgtgtgtgagggtggctcaggggcggggaagaaggaaggggaaaagggaacagactttttttttttttttttttttttgtgcagcctgagaggttgttttagtccaacttcataagactgaaatattttgcttcagattttactgaaaaaaaaaaatcccaacccacacatccttcttcaaactggataaaggtataatttccagtcccctttgtatctaattcaaattgtaattttatttcctatctcccttgatggcaaaatgtagacaagagagtttggaaagcaggcataaaatgatattaaactgtgacatagacttaatttaatctcccaggccagctcttctgggggactgggggaaggtttggcaatccctctcttgacctggtcagcactccgcatcctgggatgatttccctaggtgaaaggaaagtggcgaagccacagttactgctggtacttgccaacaaaacttcctctgcttgctacacacgtccactctgttttctttacactcaccccaggagcttttagatccagcagtatgtttcacataattttttgtgtgctgcagcagcagtttcatctttatttagcaagactgtacagtccgactgccacattcccatgaaacatgtggttaattatccacctttccacatattgggatgtgtggctctacgtaaattgcgtaaatcaagttgttgtttgttttctgactcctctggcaaacaataacttgtatctgttttatttttggttaccaatgatttgaagaaagtctatctacctatcatctatctagtttgtgtgtatctgtgtgtagttttagtaacgcacttacagttttagtaaaatatggaatattaaaggtttgattagtagcattccaaagccttttttttttaatagaatgcacttttaaagataaaggatatgcagtttattgtccttttccacctgctccacaggtctgttattttcctcctgtccttttctctgtccagggagctgacccttctccattcctcccctaagatctcctactggtggattctgataaagtttagttagtgagaggcaccagcaagagaccagagggtaggaggaaagagaagtcagtgtattttcctccctgccctgggccatgttttctggaaggttctgtctcctttagacaacaactcctgttctcacagcttcacagcttcagttttcactgggctcccacaaacagtatttccttcccgttggctctaggagtggcaaaaacttctccttcctgatgatctccaagtgtctagtttacttcttgtttcccttaacactccaacaggtgtgaaaataaaattcagggaagtctgttgaaccacatgagttggattcagcttcctgacaggaccctgactgctgtaaggggagtactttccaaaaaaacaaacttttgagttttcagaaaacaatcatcttccaggcactcaaacattgggaatgtctaatttcacacttggtccacctaggacaggccgtgtggctgtgtgtgatgagcactggaaagggagtggagaaactctttgtgacctcagataaggccctcacaccatcctatggactgtcttcttcttcttctttcttccttttttttttttggagacagagtctcactctgttgcccaggctggagtgcagtggcgcgatctcggctcactgcaagttccgcctcccgggttcacgccattctcctgcctcagcgtcctgagtagctgggactacaggcactggccaccacacctggctaattttgtttttgtatttttagtagagacagggtttcaccgtgttaaccaggatggtctcactctcttgacctcgtgatctgcccgcctcggcatcccaaagtgctgggattacaggcgtgagccaccgcgccggccatgggctgtcttcttatctgcagttgagaactggttacccgctgcactgtgtgactgtggagggcacaagatgcaccatgtgccaaagcacttcgaaaaatatgaagagttaagccatgaaaccctgtgtggtgtttctgtggctctgtccatgttgtgctgttgatcctcattctttctactccccgttctactagctgctctttatgattttgcatttctgcatgtcattaattaaagtttagatttccgttttagtttaaattaattacagatatcctggtagtatggttttgtgattgggtgactgggtttggacatatgcggtggcaattcttgctggttcacactcccgctgacgcatctgtgactcgatctttgggactttgggccccggcatgtgctgtgtagcttctggtgggctttgtttccttatggataaaatcataatagtaacacctaccaagtattcctcacagggatgatgtaaagagataatgaaaaagtgttagagcatttttgaaatcaataggaacaatatcattattaggaaccccagtgggtttcagtttcctcttctacaaaattggaaatatagaatggaaagtgttgagaggtccattcaaacatcaacattcttaagatttgtgtctcacagttttgagaagattttaccaaagacaaaaaatggcattattaacacacatcttctatgagcaatgcatggaaaaggtaggtattcgtaaggagataaagttaaaaggaggtcatataagtgggggcctaacctaataagactgtggccttataagaaaagaaagggagagagatttacacacacagccttcgaggaaaggctgtgtggagcaagaaggtggccctctgtaaaacaagaagagagtccccagaacccagccattctggcaacctgaccttgaacttccagcctccaaaactgtgagaaaacaaatattcattgtttaaatcactccatctatggtatttttgttatggtaactcaagctggctaatacatttagatttgttattatagattattaacaactttgaaaatttttcaggtcttgcctggtacagtggctcacgcctgtaatcccagaactttgggaggccgaagcaggcagatctcttgaagtcaggagttcaagacaagcctggccaacatggtaaaaccctgtctctactaaaaatacaaaaattagctgggcatggtggcaggtgcctgtaatcccaactacttgggaggctgaggcaggagaatcatgtgaacctgggaggcggaggttgcagtgagccaagatcatgccactgcactccagcctgggtgacagaatgagactctgcctcaaaaaaaaattcaggtctagggagagaagataattaggcatgtctcaaaagaaaaaggactacgctataatgagtttaaataaaaataaaaatgtaacttctcatacctcactattaattttcctttcataagatgcgtcattgtttgtcctcaatgtagaaaaattggttcttgtgggagctagcctaattttgagagagtgattttataaagctatctaaaggtaattttctattaatctaacatgattcattttagaacactaactctgatatctaatccaaaaagcagggtatatgttaaaaggcacccaggattgggagccagctgacctcatttctagtcttgccttgacaaatactgacgttgtgactttgaagaagtcattttatccctcaggcctcaatgtcctcatctgaaaaataaaagattagtactcgaatggtgtctggggtccctttgagttgtcacactttataaatgtgtacatcaatgcattgtaagtttgctaaagtaatgtttcagtctgaaagatgccataggctgttataggatgctgtaaaaataatgcttataggtcttctaagaataggaaaatatattaattgtacttttatttttttagtgtgttaatttcattcccctagaatagaaaataaaatactatacttttaaaattacaagacaaaagggacaaaatccacgtgttcttttttcaagaacattttatgcaaatatgccatttaaaaaatgttgctatactacccaccatacactaggtggaagcaaagagtaagttaacgtgtaaaagtttagacagtattacggtaaacgaaccacaattttctggatagtaaaggtcattaaaattataggttatatttcttttttaaagatgctaattagaaaagaaaatagcaaataacactgcctacttaagcctttgatactaagatgtactactgtttaagccaaatctttaaaaaatttttataagaaaaaaattatatttaatactttcaacatttattttagattcagagggtacatgtgcagatttgttacctgggtatattgcgtgatgctgaggttgggagtacgactggtcctttcacccaggtactgagcatagtacacaatagtttttcaacctttgtcctcctccttctctcccccgtctatggtccccagtgtctattgatgccatctttatgtctatgagtacccattgtttagcttccactcataagtgagaacatgcggtatttggctttctgttcctgcattaatttgcttagaataatgtaagcctaacctttactctccttatagactctggctggtaccataaaaaattaaatactaaatcctttatcttaatttctagaatctgattggtcaataaacataatgaaataaccagtcaaatggttctattcatagatctcttttttttttcaaaagcttacagagaaaatgcataataaattcaaaaaggaattctctaaagcttatgctattttgaattcagtgatgggaaggaaatttacctcactgcatatgattttacatgtcacttctttaaaaagttgtatagctacttcttcctctcagaattaattgggtcttatgctacagtttctaaaatgtgaaatgatggggtgattgccatgttacaagcctaaacatgacttatgttttcaggcttatagtgaatcaaaactcagtttaataccagtttctatgcaaagtgaattgctcagagctacccttgaaatgcttcgtgtggaaaaagaagagcctctttactggagaaaagcattctgaagttgtctgtgtagtggcatgcaagtgatacactctgtgcaaggataacttctgcatagtgttttagagaaatacattgtttagagcacaaaatagcatcgtttgtgaaacacctggtagtcaatgcaaggtgtgctaacaattacttaatggtgaggctgcaactgatattgagagaactatttttggggggttatcatcagtataagcagcccttaacaatctttgtaacctaggggcaatcaatcatttagtttctataggggctcagattcctgatgtgtaaaatatgaagccaaggccagatcatctttaagtttcagtggttactttctaagattctataacagtttttccactatggccaagacagaatgaataaactagattttcaaaattagaatttatcttctcagcttggctttttttcctctttggtgcataacagaaaagtaaaaatgggaaataaataatatatgtgaagaggtttgggatcatcactatgtttgttggtgaattctgccactgattgcgtggggaactaagaagtgagattttcttcaccactacccgcaacattgacacaggacctaagcacataaaacaagctcgttcatatgtatagtttgggttttgacaacagcattagatgctcacagcataataatttatatgctggacatctttgggcaacttaatcttctgagcctcatttctgtaaaatgaaactaccaatgacttaagaaagcagccctgagaattaagctaaagacagaaatcctcattaaaatgccctagtaaggggagaagttgtgggcaatgctgtcaaatatccatgaaaaatgtacatttccagacaaaatggcagctcctctaatttactggtattcttcagctctaaatttcatcagtcctgttcatcagaaagaataacaagagaaacagaaggaagtactacagaaaatgagtatattttacctatcctaggtagtagaaaattttgagcattcttacatgaaaattcaacaatttgaactcattttactggcctgtataaaatagaagttgtggaacattttatttggtatttaattactttcacgtatttctggtttctttggcattgtgctttttctgttgttgttgattttactttaagttccaggatacatgtgcagaacatgtaggtttgttacataggtatacatgtgccatggtggtttgctgtacctatcaacctgtcatctaggttttttgtttgtttgttttttgagacagagtctcgctctatagcccaggctggagtgcagtggcacgatcttggctcactgcaacctctgcctcccaggttcaagccattctcctgcctcagcctcccgagtagttgggattataggcacgtggcaccacgcctggctaatttttttgtagttttagtagagacggggtttcaccgtgttagccaggatggtctagatctcctgacctcgtgatccgcccacctcggcctcccaaagtgctgaggttacagacatgagccaccacgcctggccctgtcatctaggttttaagcaccgcatgcattagctatttctcctaatgctctcccacccctgggcccaccccccgatgttcccttccttgtgtccatgtgttctcgtcgttcaactcccacttatgagtgagaacatggcattgtgctttatccacagggatcatcctatcagcatgggcttgtcaatagttagataatctttcaaagttcccattaactgtcactttttaagatgtttagttcaattctgtggaaagtgggaattaatctagtcaagcatattcttaactttcaatcactccagaaaaacattacagaatgatagaatccctaccacatgctatgataagctatacaaagggaacaattggctttttcttcttagctataatggtctagcaggaagggcccttagcattgttattttctgtgtagttgtttctcctgtagcatactgtatgtaaaagttaaacattaataccacttgggacttttacagtgcatttaatgggctcagcatgtcttagagccagtctctgagagctgcagtatcttaacagcactcctaatggcaggttactctttttctattatattaaagaccgaaggtgaagggagaaagagggtaagtggcttataaatgattatcagtacaggaactagactgaatacttgggccacattttgacagttagtccagacattcaatcacagattttggatcattgtggatgtctatgatagtaataacttcacagtaatagtcatggataatgtagagagtttaatggtacttctgcttataatgcttccagaagttctcagtacttaaaacataaggaaagttacttattgctgtcattactattacgtacaaattaacaataatgacctgcacttgggtaaaggctgtactttggactttagaattcaactattatattaatactcaactcagtactaagcagatataagatttcaataaatatttgtggattttttcaaagagcttctaaagtaaatattagctcacttgatttcacaacagctttgggagaaagattgggtgggtgtcgttatgctcattttctgtgaattggatgaagactaataaaatggacatggtcttggagtcataggaaaacttgggttcttagtctgttctgctcttaatagctgtgtgatgttgggaaattacttgacctctctgagcctcagtttgtttccgcagaaaagtagggatattaccatcaaacagttatttttaggaataaacgagattatctatgcatgtctctagctcaatgttactaatcaggatcctgcacttaataaaagacaaaaatgagataagaggtcatgttggctgactttgggccagttgccctttgcattaagtcagatttaaggcagtaatttgctagtcattgtatcatgagccatggcccaaacacttgacagactttgaagatttgttattactttgccttatggaagcctaaaaagtcatgatcataaaacaattaacatttctgctgatctggaaaaaatgtcactcgaattgagatggatgttcctttttaaattttttctgttgtgggctgagtgtggttaaggtgagttttttgagatggcactttttagatatcatttcagtttaatattctatattcctcctgtggccagaaatactcagtaactccttaactttaactctgacatattatcagtgtgtcaagatggaaaccagttgctgctgaatctctggctcaagagatcgttaagcagatgctagaaacagaagccaggcttctgagacagacgctgggcagcggatactttaagctactgaatgaacataggatggctgtgttaggtagcttggaggtagtggtgaaggaatagctttttatagtcatgactgttgaggtcacctccatccctgaaattacatgaaaatttatgagcttcctaggcttttgttcttttgatgctcagacaggcttctctactctagattgaagtctcatgcattttccactaacttagaagaacagtatggcataatggaaaaagcattggtttccgatgagctgtgtaatgttaggtagatcacttagcctctctgtgtccttttctcaatggtataatggtataatagaagttgagaagatcaatcgtgctgacgtattttgatgctttgaacatttaaagtgctagacaacactggcttgtaaaataactgattactagcagaaagagaaggtttatgctgacttatttttcaaatgctctatgactcttctacagtgtttggtagactggctctaggctcagctttgtgcctatcttaaaaaaaagtacataatgctatactgattcattcttctcattgcctaggattacattagaaaataagctccatgaaggcaaatatttttgtatgttttattcacagatgtgtctaaagtgcttatgacattatcagacatacaataggtgatcagtgaatatttgtcaaatgacaaaataatttgaagtaaggaggcacaggcatctactgttgctcaccttttgactgtgtgtgtgtgtgtgtgtgtgtgtgtgcgtgtgcgcatgcgtaggtgctgaggtgggcatgataataagtatatatcgttacatatattctatctcactttaaatggtaaagttttcatctcttgatttccagtattgggtcaggtagcatctgcttaaaggacaatttcttcctgacattttaattcaagtttcaattcaaatcccactagttctggttgcgcctggatcaacgcattagtacactcagcttaatgataccctaccaagcttcctgaaagtcttacagagatacacaattaccaaaacccacctagggggcctgcacattgaaggaatcactaatgggatttgagagggagtgctgacaacacaatcagtctttaaacgaagagtttctgttggagctaaaatccagtcagagaagcaggaggtgattttatgatttatacaaatccacaagagcatcagtaataatttgaggctaactgaaacatgcaatgtccagtttctattgagtcctggaaagacattgcctggatttatctaggcaagtagacggggtcaaatgggatccatgagcatgtcatcaataatgtttacttatctgttatttaaggaattttaatgaaaaccaaattagatgaagtgaactgtttctaatctgatttccatgcatcaagctaagctcccctctactaaacaaaagcccaggaaatctaacaaaaaccaaataagtagtgatcagtaaactgtaagaaaactgtagtctgcagggtctgtgtcaactgctattttctttggcgctcttgattctcacttgcctcaagacacagacagctgttatatccacaggagaagaagcaactgatggagtgttctctctccttaggttagaaggaataacatctcaagactggatttgtcattgaaaggtttgagtatccctttaatttcgtagaatcattttcttctccacattactaaacccagcattttgtacaagtaaatttggaattattttagcatggcttgaaatcttaaaactacagactgcacttgtatgatgctctgtcagctgcttcgaaaggaaggctctgtcaactgctattactattaaattttctctctgtttaataatttagcaaagtaacacgttcacagggtaaaaatctgagtagaatagaaagactcataatgaaacatagcagtcctcactcatcctttttctacactgagttttctggagacagtaggtttttctgccattctgttctttcctctcactgtatgattttactttttcttgatcaatcaaattctgttaattttatgctaaggaagagtttagttcatttaaactactctctcctaatatttatgcctggtatttgacttaccctattagttatcattgtactattaatacaataaactgaaacctatgtgtcgtcacgtcttatttactcaatatctcttgacttcctaccgtgtgagattaaaatattaacaccttgccttatttgctgtcctctgtccttattgccagcttctgttttccgccagttccacctttacttcaaaagagtggcttttacaattctcaccataaagaaataataagtatgtgaagtgatggatgtattacttagcctgatgtattcagtccacagtgtatatatgtattaaaacattacgttgtacctccaaaatatatacaattattatttgtcaattaaaaatgtaagaaacccaccccccccacccaaaaaccaaacaaaaagtgtcaaggttgatcacgtttacattcagttttgtaaccttgattcagttttatgtgttttactgataggtaacatccaaaaattgaaaaccaataagtgtttatagcatcattattatttaaatgcatcctgcatagattagtagtgtgctatgattactgttcttccctggcttcacaatctctcttcaaactagcatactgaaggggtcttcatatcctaaaacaacaaatagattgattttcaaatcattgtttttttaactgattaccaaattaatgcttattttagatataaaaatgtaaagaagaaacttataaagaagaatttttaaaaatcccacaacacaaaggtatgtcaaaacttcatcatgggttatttccaaatttgattttcttctccattgaaatggcaggttgaagactcagattgacccctccaatactgcaggaaagtggtgagtgttctcggtcaccacaggcataaattaatgaggccgtgtttccaaaccttgcaacccacccctttatcctagtctataatttattggaaagataaagaacatttgattgaacccataaacacccttgatgatcatattagcatttccttgagtctttctataatttcttcccctttctggttgtttgagagaaagagtgcagcccttcctttgccttgccaggaattacaaaggttatcttcttaacagattatatttgaagagtgaaagggcacacttttagtcattcacttgggacaacaggcataaactgggttgtatgatcacctgagattagctttttcttttaaagaggaaacacttccaatagaaaacagttgctcttcagcctcactcttttttaaagaagagtctgttatcccaggtggcttaatgagccaccccatacatctgctttccaccttcctgaatttacttccttgagagtcaagagcagactcttaggatgtcagcacaacagctctttctgttactcactcactcactcacttctctgcatcatccatcgttgctacctatagcttcttcctcaaggtccttccctttgtttctaacattgtgctcttctgactcttctattttgaataacctcttccatcttttgttctttttgtaattgctctactactcattctgctcccttctgactctaggcaatgtagttttgctataaaatgctttcttgctctgccttcctcttgttttggcttcctttcaggaagtacatggttcaaccctgagctctatgtagttaaccccaaatctatgtgtcaaccctgactattgttaacatgtttttctttttttagttggcacacataataactgtatatatttatgggatacagagtgatattttgatacacaaatacaatgtataaggatcacatcagggtaattagcatactcatcacctcaaacattgatcactcctttgtgttgtgaatatttaacaatttcttttctgtttttttaaagcatataataaattatcattaaccacatttaccctacagtgttatagaatgctagaacttattctttctatctaactgtaattttgtattgttacccagtctctcttcatcctcctctcctccttacatttcccagcctctaataaccacaattctattctctacttctatgagctcatatttttgtagtttccacatatgaatgagaacatgcggtttctatatgtagtttccacatatgaatgtgaacatgcggttcacatatgaatgagaatatgcggttctatgtcttgcttatttcactcaacaaaatgtcctccaggcccatccatattgccacaaatgacaggatttcattcttttttatggccgaatattgttctattgtgtacatgtcccacattttccttatctattcatttattgatgaacttttagcttgattttttatctttgctattgtgaataatgctgcaataaataccaaggtgcaggtatctctttaatatactgatttccttttctgcttctactgaacattagcagctatttttggatatccccatttggaggttcatctgactcctgagaaaaaagtggcctaaactaaatgaattctcttttcttttcttcctggaattattctagcattcgtgttacctggttcaacactcaataactattctttacaccttcctctggcactcctccttcagggaattttttagtcctgttctatttcctaatatttgatgttctttcttcttctctctatgcccactgctgctttgctttcctagttctgattctagtaaaaattctcctatgaaaagctaataaaggtataggaaaaaaactaaacaagtgtttttccatccctcacactccacccaacagaacacttctgataccagatatgtagggggttttccccacacaccaaccaagcaattctccagtagacaccagttgacatcctctactaattcaattcaattctgacactatttacctggagatagtatcagatcccacaggctgagcactcagatccataagacttctccccacttcagatgccagtcacaagcacaggctgtgacctgcttctgaccaattggctataaatcaggagttcccatgataccttccttgggtttgatcagtctgctagagtggcttacagaacttggaaacactttacttatgtttactcacttattataaaggacattacaaaggatacagatgaacagccagatggaagagctgcatagggcaaggcatgtggaaaggggcatggagcttccatgccctgtccaggcatgccaatctccaggcacctacacaagtgagctcaatgatctggaagccctctgaatcctgttcttttggttttttttaaacatttatttttattttaatttagttttatttttttgagacaaagtctcactctgtctcccaggctggagtgcagtggcgcgatcttggctcactgcaacctccacctcagccccctgagtagctgggactacaggtacacaccatcacacgcggctaatttttgtacttttagtagagatggggtttcaccatgttggccaggatggtctcaaactcctgacctcaggtgatgtgcccacctcggcctcccacagtgctgggattacaggtatgagccaccgcacctggcctcttttgggtttttatggtggcttcattatgtaggcataattgattacatcattggccattggtgatcaactctaccttcagcccctctcctcttcccagaggtctggggtggggctgaaagtcccaaccctctaatcatgaagtttttccagtgaccagcctccatcgtgaagctatctagtggctccgagccaccagccatctcatgaacatagaaaaaacactcattgctccagtgacagagctgtgtgccaggaagtgggatcaagaccaaatatatatttcatgttatcacaagatggaactctatatatgaaggtttgagagagagacacacacacataatatcatccaggtaaaggagtagacagtcttaatcattttaattaacaatctacctgcttttaaactaaagagcttctgcacaccaaaagaaactaccatcagagtgaacaggcaacctacagaatgggagaaaatttttgcaatctactcatctgacaaagggctaatatccagaatctacaatgaactcaaacaaatttacaagaaaaaagcaaccccatcaacaggtgggtgaaggatatgaacagacacttctcaaaagaagacacttatgcagccaaaagacacatgaaaaaatgctcatcatcactggccatcagagaaatgcaaatcaaaatcacaacgagataccatctcacaccagttagaacggcgatcattaaaaaatcaggaaacaacaggtgctggagaggatgtggagaaataggaacactttacactgttggtgggactgtaaactagttcaaccattgtggaagtcagtgtggcgattcctcagggatctagaactagaaataccatttgacccaaccatcccattactgggtatatacccaaaggattataaatcatgctgctataaagacacatgcgcacgtatgtttattgcggcactattcacaatagcaaagacttggaaccaacccaaacgtccaacaatgatagtctggattaagaaaatgtggcacatacacaccatggaatactatgcagccataaaaagtgatgagttcatgtcctttgtagggacatggatgaagcaggaaaccatcattctcagcaaactatcgcaaggacaaaaaaccaaacactgcatgttctcgctcataggtgggaattgaacaatgagaacacatggacacaggaaggggagcatcacacaccagggcctgttgtggcagagggggaggggggagggttagcattaggagatatacctaatgttaaatgaggagttaatgggtgcagcacaccaacatggcacatgtatacatatgtaacaaacctgcacgttgtgcacatgtaccctaaaacttaaattataataaaaaaataaaaataacaaaataaaaataacaacaacaaaaaaaactacctgctttttttctgagctcttccagaaacacagccccgcacctcctccttgctaaaatatgtacatttccccattatctacttaataaaatccaaactcctagacttgtgtttacatctatatttaaaccttatattgtactacatgtcttcatggaaatttttccagagtgtaacacacatgatttttgagtagtttttctggctttcccctcccaacttctcagctgggatagaagctgcctaaagcaggagcttgtctgccttgttcactgctgaatttcctgagctgagaatatagcctgatacatagcatgctctcaggattcattagacgaatgaataaatgaatgacgagttattgtccttactttctgctttctggccacatgccctcttagacagcacttatctgttatgagctgaattgttttttccccaaaattcatatgctgaagtcctaacacccagtatctcacagtttgactatatttggagatagggccttacagaggtgattaagttaaaaagaagtggtttgttaggatgggctttcatctaatttgactggtttcctgtaaaaaaatttgaaaaggaggaagaggaaatttgggcacacagaaagatataagatgaatgtatacacatagaggaaaggccacgtgaggaaagaccacagtgagaaggtctgcatgccaacagacaggcttcagaaggagccaactctgcaaacccttggtattggacttctaacctacaaaactgtgagaaaagaaatttctgttgtttaagtcatccagtctgtggtatttttgttatacatttacttttgcaacagtactctgttaaaccttttacatacaatcctaataagaatcctatgatgtagatatttttatgatccccattttacagataaagaaatggaagaattgagatgttaattaacttttttatggtcaaacagccagggtttggaatgtaggcaacttgattcaccctgttccctctacctggtacaccttccccttcacttctgaatggtaaattctaaccatctccaaagccagagaacatgtcttttttcactaaatttccccactttggcttcaaacttatattgtgatatttgttttactttatgtttagttccaaatttgttgtagatgcctgctcaggaatctgcttagctctccaggatgggggtctcacattattcaccatagccctttgacattaaacctagaccccttctgggatgagagtctattatgggctgaattggaacctggatcctgattgctggcggataggtatcctggctatacaaatgccaatttacatgtatttaaaaattcacttgtctcagaattccatattctattctctattacatgtataggaatctctgctagcctgatattgattacatccctggatcatcattgttcatatttccctatagcctttacatatagtgttctactctttatatgcactttccccagaatcagaagtttagtctcccctaaagcccccagcttactgtgcatagtctgtttccatggctctgcttatcctacacatgactgctgtttagcaggcaatgtccaggcatgacctgtgatagtcaatccttagatttctgttaatgattcacccatttattcacacatgcattcacttatttgttcttctgtttatccatctaactgggagctttttatatgccaggtataacacagatcaaggtcagtttcttgatttgatactaaaaacatcaacaagcttttaatgctactaacaatctacaaaaatattcctaaattaacctacactaaaatgtaatttgaaaacatatcactgatgagattcaggtatctttctgcgtgtcaccaggaagcaatctaaaataaaatcagtaacaaataagttgcaaactaggaaattataacatgtcatgaggatatgttaaatgaaggctagccgtggtgtgataagggacaactgaagtttccgaggttctggaatactgaaaaaggaatactgtggaaaaagagagattagtgctgctctggtactgcctaggagagagaaactcaatccagaactagggtgttagtgagggtgacaactgcatagaataataagtccagtttagcaaacatttttgagaaacccctaaatactagacaattgtaggatgcaaatgggaatcggatatagtccttgtcctcaagtagtggggaaaacagacacataaaatcttagctttactagaggtaggagtgaggcaagtgtggctgtcagcaatatcaagcaacacctcagatgtgctattatctgaagtgatatcagacactgtcaagatccaaattttctaggcttctctcttttctttttttttttttttttttttttttttttttttttttttttttttttttttttgagacggagtctcactttgttgcccaggctggagtgcagtggctcgatctcggctcactacaatctccgcctcccgggttcacgccattctcctgcctcagcctcccgagtagctgggactacaggcgcccgccaccacgaccggttaatttttttgtatttttagtagagacggggtttcactgtgttagccaggatggtctcaatctcctgacctcgtgatccgctcgcctcggcctcccaaagggctgggattataggcgtgagccaccgcgcctggccaggcttccctcttaatgaaaggaacatagtacaattcccagacttctgtctgatagtagaaaacaagaaagaaaaaaatggagatcaatacattttggtgggtaatatgagaactatgctggatatttaatattttcctctcccaatccatttcattcttctccactcttctccctgtatataagttatacagtctatggtattttgttacagcagtacagactaagacaccactttctgaatttaaacaaatttccgctgtgtcaaaattgagaagagcgtgcactgactagctgataaaatcaattccatttaattggaatgatatttctcactacaaaataatgaggtagtaatatgactgataactttttcacctgcacttagatttgtaaatcaactggttaacctagaacaaccaataaaattagatttctgaactctgcacagatgaagatgagacttcgaagtagaaaggaaataggaaactcaagtacctagccaacctcacctaatgctacaggaataacgcatatttagagttgctggtctcgtatggtgatacagacccaaccacagtctaattatcaggcttggagtcgagtctgctgctgcccatgaaatatggttaaaataactagtccttataggatttcaggattattagtactgtgctaagaaagggatgtccctcaggttctaaggaaacagggctctgcagaattgtaactaacttctggatgcaaccacagggttttaacatttaaagataacattggtcagtctgatctaccatccaggcagcccagttagccatgggaagaccagaagctattttcttaaatacattttctaacatagcttaaatatgatagaaatattgaaatgtggtttaattctcttggttgaaaaagaaaatgtgatctgtaaatgattctataaacttttgacttaatttctcttaatttctgcccagtgtgtcacgtatgattttgttagtaacatctgcagcacttgcaggttaacacatctatttcatccaaaatcataccaaaatgagttggatatataaaaatatttggcaaatgtcacaagtagatgcagtgaggaaaagcctaatttctaagtcacacgtgtactcaagggtgctgagttggatgagcacatattttacaaagagctggacagttctggtccttgttttatcatgggtcaggagcacaaaagtgaactaaataacagaaatcaaaaggcaaacattgacactggaagctcacaagacttagcaagaaacacattcttaaaagtcattaaacaattttgaaaagaaattcaagctgtggggattgagctctgagatcagaacaataagctccatgaattggaacagaggctttctgaaagcagttttgaagaatacttttcccagacaagcttctttgtgaggggatttttttttttttttaacaaatatgcctatttttgactcagctcagaaatgaaatatttcaaaagccttttcaagctcagtatctctaaaattactctttcaaagttacactttaaggggtactagaggattgagattaagagggataccaagtttgtaaaattttcataggcatgataaagacgcaggaaagtccccacccatccccaataatttctttagtgttttagataaaacaaacaaagaaataccagttggaaaggatggcactgttaacggggttgggaaagtgtttcaaaattcagttttgacaaaagaaagagtaagacaaaaattgctttctttctgggtttaggagttttacaaagtgaattttaatgagaaatatttttataaggtttgttttccataattaatgtcattgaatataaaaatatagcagacccttgagcaacaagggttttaactacatgggttcacttatatatggattttcttcaataaatatattgaaatatgttttgaagtttgtgacagtttgaaaaaactcacaaaccatatagcccagaaatattgaaaaaaaactaaggaaaagatatgtcataaatgcataatacatatgtagatacatctattttattatctattaccagaaaatatacacaaatctattataaatattgaaatttatcaaaagttatgctcacacttaaagactgtacatggtgctattaatagttgggagaaatgtaaacaaatgtaaagatgcagtattaaattataactgcattaaattaacagaacatactgtactactgtaataattctgtagccacctcttgtggctattgaggtgagctcaagtgttttgggtatctacttaaaatgcgatgtgacctaaccattgctgcatgagcagttcatctctccagtaaattgcatattgcagtaaaaactgatctcctgtggttcttgcatatttctcatcttgtttagtgcatcttgaataatgttatgggacccatatgaagtgccactagtgatgctggaagtgttcccaagaagcagagaaaagtcatgacattacaagaaaaagtctaattgcttgctatgtaccatagattgaaatctgtagttgtggttgctgctatttcaagataaatgaacacaacataaaaccattgttaaaaaaaaaaagaaaaggaaatttgtgaagctgttgctgcagctaggccagcgggtgtaaaaactttgtactttctgcaaaataccttttaatcttatattgaaaattcagcttttatgtggatataggattgctatgatttgagaaatttattcattatatgacaacttaaagcaaaaggaaggtgatggatctaaagctggagaatttaatgccagcaaaggatggtttgttgattttagaatgtagtatggcttaaaaaacatcaggataacaggaggagtagcttcttctgatgagttcgcagatgccattaagaaaatcattgaggagaaaggatatctgcctgaatacgtttttttttcctctttttttttttaatcatactttaacttctagggtacatgtgtacaatgtgcaggtttgttacatatgtataaatgtgccatgttggtgtgctacacccattaactcatcatttacattaggtatttttcttaatactatccctcccccctccccctctgccacaacaggccccggtgtgtgatgttccccaccctgtgtccaagtgttctcattgttcagttcccacctatgagtgagaacatgcagtgtttggttttctgtccttgcgatagtttgctcagaatgatgatttccagcttcatccatttccctgcaaaggacatgaactcacccttttttatggctgtatagtattccatggtgtatatgagccacattttcttaatccagactatcactgatggacatttgggttggttccaagtctttgctattgtgaatagtgccgcaataaacatacgtgcacatgtgtctttatagcagcgtgatttataatcctttgggtatatacccagtaatgggatggctgggtcaaatggtatttctagttctagatccctgaggaatcaccacactgacttccacaatggttgagctagtttacagtcccaccaacagtgtaaaagtattcctatttctccacatcctctccagcacctgttgtttcctgactttttaatgatcagcattctaattggtgtgagatggtatctcattatggttttgatttgcatttctctgatggccagtgatgatgagcattttttcatgtgtctgttggctgcataaatgtcttcttttgagaagtgtctgttcatatccttcgtccactttttgatggggttgtttgattttttcttgtaaatttgtttaagttctttgtagattctggatattagcccctgaataggtttttaattcagataagtgccctattctggaaaaaaatgccacaaaggacacttattagtaaggaatagaagcaagcactaggatttcaggcagaaagggataagctaatgctactgtttgtgcaaatgcagttgtgtttatgatcgggactccccttacctatacagctgctaagctcccttacctatacagctgctaagctactaggctaaaagggaaaagatcaacactagctgccagtctttcggttgtgcaacaggaaagcctggacaatgagaacacttgttctgaattggttccattaatgctttgtcactgaagtcaggaagtaccatacatgtaaggaactgttttttaaagttcttttgattttgaacaatgccgttagccacccagagtacaatgagttaaacactaaaggtgttgcagtagtctacttgtattgaagtagtctacatagtttttaggaaaacatgatgtctctaattcagcctctagatcagggggttataaggatctttaaggctgattacacacagcactctatagacaggattgtcaacaatgaggaagataatcccagtagagagaataacataaaagtctggatgcattagaccactaaaaaatgtcatcattgttatagagaaagctgtgaaggccattaaacctaaaacaacaaattcctgctggaaacaactgtgtccagataggcatgacttcacaagatttatgacaaagccaatcaaggaagtcataaaagagattatggatatggcaaaaaaggcagcaggagaaggtttcaatataggatcttggagaaattcaacagcttagtagacatctctattaaggtgtctctaattaatagaaaattaatggaagacaacttggtggagatgtgtgcttccaatcagtggcagacgatgaggaagaacaggtagaagaagcagtgccagaaaacaaatcgacattaaacaatctggtagaagggttctgattactcaagactgcttttgaattcttttaggacatgggcccttccatgatatggacattgaaactaaagcaaacagtggaagaataattggtaccatatagaaacatttttagagaaataaaaaaaacatcagacagaaattatgacatatttctgtaaagttaaactgaatgtgtctgtctctcctgcctccccttctgtctcttctacctcttccgcctctgctatccctgagacagcaacactcttcttcctcttcctcctcctcagcctactcaatgtgaagacaaggaggatgaaggccttgattctgatcactttcacttaatggatagtaaatacattttcttatgattttcttactagtgttttcttttctctagctttattgtaagaatacagtatataatgtatataacatatcaaatatgtgttaactgtttatgttattggtgtggtttctggtcaacagtaagctattagtagttacgcttctgagaagtcaagaatcatgtggatttttgactgcatgggggttggcacccctaactcctgtgttgttcaggtgtcaactgtagaaccaaaagtctggatgtatttattatttgaaccatacaacaaaaacaatagaaagacaagactctccaaataaaaattattttcaggagaaagggtatcaaactcagagttaacttacttaggtggctactaatggtcttatccatacatttggtacttgattatttaatcacagagttggttggtttgatttttataatgtgcaaaaatgcctagtgaggtagtttacattaaagtttacagactcagaaaatattttgcctagcttgattctgcatgaaaatatgaagatattcatgaagatatatatttatgtgtataaacctaaacattacaaaaatgaattaaagcaagaatttttcttgataagaagatatgtgcaaattattggttttgaataatttaatttcaaagttcaaatttaattaaaactacacactagaccaaaaacggtgtttagttttaaatacatagatttaaggcaattcaaacttgtactgttcctattttggtagagtgcttttccctgctagttaccagagaggcattgcccttgtttctctgtagcatttctccagatagatagtaacttgacaaaattactattctctccatggatggactatgcacattgcttttgcttacctagtttcctttgtttgtgcagctaccaacccaggctgaccaaacagatatacctgttaataataatattcaataagaggttttcctaacatttgataagtggatgcaggaagaaaggctttttctttgtcctggatcacatgctgtgaagaccatctagttggaatgccaacagccttcttttctagctgctgggacaaaaagccagagagaaaagcagaataaagacagagagatgcagagcgcaggacctgaccctgcctgaagccttagactttctaataagagacaatgactcttttttctgttgtaagctagtttgtgttgggtttctgtccctcacagccaaaataatcctggctaattcaacaaataagcaatagaaaaagctgaaagggaaacaatttacagcaaaatataaggcagtgcatctagctcttagccacatatggcaaaaatgagctttttatgtgttttcagatatataataaatgagaaaaataagaatttttgccttaatgtatctcaaacatagagactgttagtacattttacgaaagtgtacgacatgctttagtctgccagttaattttaaaaattgcatttctttaaatttctaaattaaaaacattatttaaaaaattgacagataattgtattttcatgtacaacatgatgtttcaaagtctatatacactgtgaaatgactaaatctagttaacacatgcattacctaacacagttatcatttttgtggtgagaacactttacatctactcttagcatttttcaagattacaataatgactttaggagaactatactggccaggagtggtggctcatgcctgtaatcctagcactttgggaggctgaggtgggtggatcacttgaggtcagtttgagaccagcctggccaacgtggcaaaaccccgtctctactaaaaaaataaaaataaaaaaaatagccaggcatggtggcacacacctgtaattccagctactagggaggctgaggaaggagaatcacttgaaccctggaggtggaggttgcagtgagccaagatcgtgtcaccgcactccagcctgtgtgatgggagcaagactctatctcaaaaaaaataaaaaataagaataaaagaagtatatttacacatcaaaaccttgatcactttagtaaaaaaaaatattgtcaatgacatatatttggttatacggaagtaaatcactgttttgataaattatttaatgacaatatgatttagccattatattagtactttctcacactgctctgaaggaatacccgagactgggtaatttaagaaggaaagaggtttaattgactcacagttcagcatggctggggaggcctcaaaaaacttacattcacggtggaaggggaacacatccttctccacatggcggcaggaaggagaagaatgagaaaccagagaagcaggaaggcccttataaaaccatcagatcttgtgagaactatcacgagaatagcatgggggaaactgcccccatgatccaattacctcccgccggtcccctcccacaacacgtggagattatgggaactaccattcaagatgagaattgggtggtgacacagccaaaccatatcagccatatatacaggtaggtttaggtaaagattaaaggtttagggaggttaatggcaaaatattcagagtaattcatctgaccttaaacgatcctccacaccctcaccacacatatgcaaaagtacatgcaaatatacttaattattgcacattacaaagcaactattactgagttaagtgcaaatttatagtcaataaatccagggaaatgaaattgtatgatgaaatttgtatgtaattgaacaggcagagtaagaaatccttatatctcagtctgtttacatgccagattgatttgattcttttgcttgttagctctgtttcatcaaagtatttacctgatctaatttcttgaattaacacatcaaataaggtgaactggtttatgagtaaacaccacctcaataactcacactatcatatcagatcactctctaatggcttcacaagtatttgtcccaactgccctttccttattccttttcctgaacctacgaataaaacctgaatgctttgactttgagttcactgctctatttagagttcagggttctcttcatgattactgccactaaacgctataaatgtagaattccacagttagaagggactctaaaatgcctatttcacttactaattctacaaatgaaaactcaagctcagggctctgacgtacccatccaaggtttcaagtggcagagctggtcctggacacacatcccagaggcccagcccaatgcttgtattgggaaggcattatgcagatgctgtgcacacaacttaggacttttcactgtattcatttggttttatgcaagtttttatgtctcagcataacatgataaatctgtgctaaatgttcaaattatctgaatgatcatattcaataattataaagttaatattgaagaaaaatagttctttatagagttttatttctgttaagtattaagagcattttatatgtattaactcatacaaatgattcttagatttttttagtagaaagtcatactaatcattctttctggtaatcctattcacttttcattaagttctcttttatataggaggtcttacgctacattttacattttgtgtagcttgtttgcttttaagttgacagatcaagtaaggtgtactggtttacaaaattggtttacacaaggtgtaactgtgttacatctcagttacatagtaaacagagtaaaatatattaaattgaataaagttttgtatgaaatcctgaatatagtctggttttatgaactattttttttttttttttttggctacatgaaagagttagaaggaagtctctgttttgcagaataaaatatctttttagaaactttgaagcaccagatctttaaggattctggataaaaatgtctgtgatgaaaagatagatgcttggggtgatgaatatcccatttaccctgatgtgattattactgatggtatgtatgtatcaaaatatctcatataccccataaatatatacacctatgtacccataaaaattaaaaataaaaaaatttaaaagatatctgtggtggaataccaaatatgcctcaaaggtagtattttattaaaatcatgaaatattcatgattttggaaattcttattttgtaaagtgagggtgatggtggttaacaacatactttttaagaaaagtatattgagtttgaacaaaatgttataataacatttgtatattttggtagctgagagtttgcctgtagagtgaatgtgcttaaatcccagttcttaaattttctagtttgtgtgaccttggcaaaaagcattcagtctttttgtatctcagttttttcatctaaaaatatgaagataataagcagtttttatctcagagttgttgggacaattaaacacatgcattaaaaagtactaagaaataataaattagtgatttttattaaaaatagaaaattattttatattattactccttaaaaatgataaataattactgctattagcctacattttgctggattttgattgaattatttgaaggagaagaaatactctttatagaaaaaagatctgtaatttacctactattaggaatttacatatataattggtttgtgaatcccgccccaacagtttctgagatttgctagatgttattcgaagcactaagctcttgccttttctcattattataatcaactatttcctgtatgccagcaaagtcagtggtaaagatgttaaatgtttacagcaagcaggaatattgtcctaatcgcataataagcaattagaaaaaaaatgccccctgacagaaagcaatcattggttatgccttatgttgagctcttctgtttcatgattgattaaatggttcttttctattaaattattgttgtgaaaacagagctgtttcatactgaaggtcatgacataacgttattcattatttaggccaatatagcaaggtttttagtaataagtcttaggaagaaagttcatttgaaagtgctttcgttgctcacattacattctgctgaggttttattaagatggagcattaaacacaatactaatgactcatgagtaaaaatatagtgaactaaatgatgcaaaaacacctcaactatttgaagaaaacatgttaaacacacatgcacatctcaaagacaaagaaaatgaaaagatcttgcttttatattgtattagagcttctaggcttctcctttcattattaatcatacttggctgcacagaacacttgcgatctgtcctttctttgtagaagctgccattgtgtgaagatggatatgccttttttctccctcttctcccacaagatgaattctcaatctcaattgctttctcatagcatgtgcacttatctttgccttttgtgcactggaggagaacatgcttctccatttctttgtctctcagaaatatgagacaagtgccttttgctctatcatgtagctgctctttacaatgtcagctgcactgatgcctgcctccagtagcaggctggtgacaaacaccacaagggtgtatctccccaacaagatgctgatcagacagcttgaaagaaagcaatgccctgtttttccattttaggggacaaacatttttctctctctccctgatttcctttctccttcctttctctctttctttctttctctctccttctcctgaaccaatttttttttctaaaaaatactaatatttgaatcaacctttcagtcaagagtattctattaacttggttccaaaccagggacaaaagtgcagaatgttcaggtaatgaggtttaggttctttactggcttaaagaggcaatgggcattctgtatctgggcatttaagtattgttccataattatttacatactgtatatataatatgtaatacatataatatgtgctatatatacagtgtgctatatatatgttctcatctatatattatcttctactttgtgtcatgtgtttatcttccctatgtcttattatttctgtattttcagaattgttcagttactacagtgtactacctataatattttgagattttttaatatacaaaaatgagcattttaaattatacttttagtgaagattccatatagctcaaagactaacagaaaatgaaattgacacaaaattaaagactcatcaatggacacttcaaaatcagacacaggtagacatagttctgttagaagaaaagataagggtagtgaagtgtctatgctttacatattctgttattccccactccctttggcataaattttaaactcattagtccagccccagatgccttgcccatctcaacacttacactatcctacaagtgtcctgtgttctagccatactaatctccttggaatttcttaaattttctaggttatcttcctgccatacttttgtacatgcagttcctctctttgcctgggtagctttcttatatataaatattcaattcagtggtccctttctctgggaagatattctcaatttcagttctcaggactgggttaggtgcctcctaaagctcatatcttagacatattcttttcattgccctttttattcactcatttattcattcattcaataaatatatattgtgtgcataatagatgccatttgtataactgtctgctgatatgcctctcatccactagactatgacctccttgagttaagagacacacagttattctcattcttctgggaattatgttctataaagtggcataaataataaactaacaaatatggaactattactcctaaaataacaagttggattcctaagaacctttggtcacaacactgtcaccaaccaaaatgtcatttgccttaggtaggttcatttgtcaatgtccttataaaacaaaccagtctcatcagcattaaaaatctgctttttggccaggcgcggtgtctcacgcctgtaatcccagcactttgggaggccaaggcaggtggatcacgaggtcaggagttccagaccagcctggccaagatggtgaaacctcatctctactaaaaatacaaaaaattagccgggcgtggtggcaggcacctgtaataccagctactcgggaggctgaggcagagaattgcttgaacccgggaggtggaggttgcagtgagccaagatcacaccactgcactccagcattggcaacagaatgagactccgtctcaaaaaacaaaaacaaaacaaaacaaaaaaaaaaaacaaaaaaaacaaaacctgcttgtcaggcttctgggcccaagcctgcacacagatgtccagatggcttgaagtatctgaagaatcacaaaagaagtgaaaatgtccggttcctgccttaactgatgacattaccttgtgaaattccttctcctggctcagaagctcccccactgagcatgttgtgacccccgcccctgcctgccagagaacaaccccctttgactataattttctattacctacccaaatcctataaaacagccccacccctatctcccttctctgactctcttttcagactcagcccacctgcacccaggtgattaaaaagctttattgctcacacaaagcctgtttggtggtctcttcacatggacgcgcgtgacatttggtgccctgacttggatcaggggacctcccttgggagatcaatcccctgtcctcctgctctttgctccgtgagaaagatccacctacgacctctggtcctcagaccaaccagcccaaggaacatctcaccaatttttaatcaggtaagtgatctctttttactctcttctccaacctctctatccctcaacctctttctcctttcaatcttggtgccacccttcaatctctcccttcttttaatttcagttcctttccttttctggtagagacagaggagatgtgttttatccgtgaacccaaaactccggcgcctgtcacatacttgggaagacagtcttcccttagtgtttaatcactgcggggatgcctgcttgattattcaccgacatttcagaggtgtctgatcaccacggggatgcctgccttgatccttcacccttagtgtcaagcaccactttcctagggggcaagcacccctcaccccttctctccgtgtctctaccctctcttttgtctgagcttgcctccttcactataggcaaccttccacccaccattcctccttcttctcccttagcctgtgttttcaagaacttaaaagctcttcaactcacacctgacctaaaacctaaatgccttactttcttctgcaatgccacttgaccccaatataaactcgacaatttttccaaatatccaaaaaacgtcactttcgatttctccatcctacaagatctaggtaattcttgttgtaaaatggacaaatggtctgaggtgcctgatgtccaggcattcttttacacatcgaaccctccctagtctctgttcccaatgtgacttgtcccaaatcctcctcctttccctcccacctgtcccctcagtctgaaccccaagcatcactgagtcttttcaatcttccttttctaccgacccatctgacttctcccctcatccctagactgatcctcctcaggtcactccccaccaggctgaatcaggctccaattcttcctcagcttctgctcctctaccctataatccttttatctcctcccctcctcacacctggtctggcttacagttttgttccacgactagcccttccctacctgcccaacaatttcatcttaaagaggtggctggagctaaaggtatactcaaggttaatgctttttttctttatccaacctctcccaaatcagttagcatttagactctttttcaccaaaaataaaaacccagcccatttcatggcttgtttggtagcaaccctgagatgctttacagccctagactctgaaaggtcagaaggccattttattctcaatatgcattttattacccaatctgctcccgacattaaataaagctccaaaaattagattccagccctcaaaccccacaaaagtactcaactaacctcaccttcaaggtgtacaataacagagaagagttgcaattactttcctcctctgtgaggcaaaacccagccgcacctccagcacacaagaacttcaaaatgcctaagccacagcggttaagcattcctacaggacctcctccatcaggatcttgcttcaagtgccagaaatctggccactgggccaaggaatgcccacagcccaggattcctcctaagccatgtcctatctgtgtgggatctcactggaaatcggactatccaactcacccggcagccactcccagagcccctggaactctggcccaaggccttctcggcttagcaactgaagactgatgctgcccaattgcctcagaagcctcctggaccatcacagatgctttgggtaattcttacagtggagggtaagtcggtccccttcttaatcaatatggaggctaccaactccacattacctttttttcaagggcctgttacacttgcctccataactgttgtaggtattgatggccaggcttctaaacctcttaaaactccccaactctggtgccaacttggacaacattcttttatgcactcctttttagttatccccacctgcccagctcccttattaggttgagacattttaactaaattatctgcttccctgactattcctaggctacagccacacctcattgctgcccttttccccagttcaaagcctccttcacatcctccccttgtatctccccaccttaatcccacaagtatgggacacctctactcctccttggggactgatcatgcaaccttaccatcccattaaaacctaatcacacttatcttgctcaacgccaatatcccatcccacagcatgctttaaaaggattaaagcccattatcactcacctgttacagcatggccttttacagcctataaactctcctgacaattctcccattttacctgtccaaaaactggacaagtcttacaggttagttcaggatctgtgccttatcaaccaaattgtttggcctatccaccctgtggtgcccaacccatacactattttgtcctcaataccttcctccacaactcactattctgttcttgacattaaagatggttttttcactattcccctgcacccctcatcccagcctgtttttgcttttacctggactgaccctgacacccattagtcccagcagcttacctgggctgtactgccgcaaggcttcagggacagtcctcattacttcagtaaagccctttctcatgatttactttctttccatccatctgcttctcacctaattaaatattttgacaaccttctactttatagcccctcctacaaatcttcccaacaggacaccctcctgctcctccaacatctgttctcagaaggatatcgtgtatccccctccaaagcccaaatttcttcctcatctgttacgtatcttggcataattcttcataaaaacaaatgtgctctccctgctaatcatgtctggctaaactccaaaaccccaaccctttctacaaaacaacaactcctttccttcctggacatggttaggtacttctgcctttaaatacatagttttaccatcctggctaaaccattatataaactcacaaaagaaaacctagctgaccccataaatcctaaattctttccccactcccctttccattccttaaaaagccctaaaaactgctcccatactagctctccctaactcatctcaactcttttcattacacacagctgaaatacagggctgtgcaatcagaattcttacacaagagctgggaccatgccctgtagcctttctgtccaaacaacttggccttactgttttagcgtagccctcatgtctgtgtgtggtggctgccactgccctaatacttttagaggccctcaaaatcacaaactatgctcaactgactctctacagttttcataacttccaaaatctgttttcttcctcacacctgatgcatatactttctgctccctggttcatttagccatactcactctttgttgagtctcccacaattaccattgttcctggtccagacttcaatccagctttccacattattctggatacgacaactgacccctgtgactgtatatctctgatccacctgacattcactccatttccccatatttccttctttccttttcctcaccctgatcacatttggtttatcagtggcagttccaccaggcctaatcaccactcaccagcaaaggcaggctatgctatagtatcttccacatctatcattgaggctaccattttgcccccctccactacctctcagcaagctgaactcattgccttagctcaggccctcactcttgcaaagggacgaggcatcaatatttatactgactcttaacatgccttccatatcctgcaccaccatgctgttatatgggcagaaagaaatttcctcactatgtaagggtcccccatcattaatgcctctttaataaaaactcttctcaaggccgctttacttccaaaggaagtgggagtcattcactgcaagggccatcaaaaggcatcagatgccatcattcagggtaacgcttatgctgataaggtagctaaaaaagcagttagagttccaacttctattcctcacggcagttgttcttctcatcagtcactcctgcctactccccgctgaaacttccacctatcaatctcttcccacagaaagcaaatggttcttggaccaaggaaaatatctccttcccacctcacaggcctattctattctgttgtcatttcataacctcttccatgtaggttacaatccgctagcccaactcttagaacctctcatttcctttccatcacggaaatctgtcctcaaggaaataacttctcagtgttctgtctgctattctactactcctcagggattgttcaggccccctctcttccctacacatcaagcttggggatttgcccctgtgaaggactggcaaattgactttactcacatgtcctgagtcagaaaactaaaatatctcttggtctgggtagacactttcactgaatgagtagaggcctttcccacagggtctgagaaggccagcacagtcatttcttcccttctgtcaaacataattccttagtttggccttcccacctctatacactccaataacagaccagccttcatccctatcttctgtctaatcatactcttattcaccattctcaactacttgtaaatgccctgcccttgtttacactgccggtttacacttttcctccaaaccaccataactgatatctcctggttttacctcaaactgccacccataagtctctcttaaagtggattaaagatcttcagtggcaaggtacacttcaatactttcaccctgatgaagtcctattctttacttttatattcactcttattctcgttcccattcttatgccaccctctacctctccccagctatctccactacactatcaatctcactcgctctcttctagctgtttctaatccttctttaacaaacaattgctggctttgcatttctctttcctccaaaatcactgaggccttgacttactgcttaaaaaaagaggactctgtattatgatgtttaaatgaagagttttgtttttgcctaaatcaatctggcctggtatatgacaacataaaaaaaaactcaaggatacagcccaaaaaactcaccaaccaaacaagtaattacgctgaacccccttgggtgctctctaataggatgtcctgggtcctcccaattcttagtcctttaatacctgtttttctccttcccttatttggactttgtgtcttccatttcatttctcaattcatataaaaccatatccaggtcatcaccaatcattctatatgacaaatgtttcttctaacaaccccacaatatcaccccttaccacaaaatcttccttcagcttaatctctcccactctaggttcccacaccacccctaatccagctcgaagcagccttgagaaacattgcccattatctctccataccaccccccacaattttcactgccccaacacttcaacactattttatttttcttattaatataagaagacaggaatgtcaggcctctgagcccaagcctgcatgtgtacatccagatggcctgaagccactgaagaatcacaaaagaagtgaaaatgcctggttcctgccttaactggtgacattaccttgtgaaattccttctcctagctcagaagctcctccactgagcaccttgtgaccaccgcccctgcctgccagaaacaaccccctttgactataatttccattaccaacccaaatcctgtaaaacggcccacctctatctcccttctctgactctctttttggactcagcccacctgcacccaggtgattaaaaagctttatcgctcacacaaagcctgtttggtggtctcttcacatggacgtgcatgacactgcttttccacataaactttttcccatagaacgtttggtgggtatttaaagcattattttctatatgtattttatttttaattgacaattggatgtctttataagacacaagtgcaatgtgatgttttgatatacatacatacattatgaaattatttaatcaagctaattaccatattcatcttccatagcctccttatctgcaaaacttgccttgtctgcaagtttaacacgtatttcccacacatactgccttttgaaatgtgcaagttagccagcacttgccaaaaaagtttaaaattttcccgcccctggatagtgtgactaaaatttttttttggcttttagccttacaacagtggtctccaatacaccttttaaatattggttatcatctcatgaaactacaaatttaaccacttttccacttttactatagcttcatcacacattacagatgttactttagcattttctggagtgtccttttgcacagattgataaatttgctcttcctttttctggatgtactatattgatgatcaattaacactgaactcatagccaatagcattataactcatgcccggatgaagcttatgtaagacaatatttttttgaaagacacattactgtcttcttgtacttaggaacactagataacacttccacactacatttatgggctattttaaacagtgaaattaccaacaaaaaacagaaaatgtaaaaaaatgtggcttcactgaacagacctcaaaaaggacacttgtttatgtgcaagagctggaacaacaaggcagagtgcaaccttgtttggcctcagctcagagcttgcttctcaagtgacttaaaatgttgtctctgtgcatatctgtgaatgacctcaaatgattgccaaaatgctaccagtattgattttggggttacaaatacattttagtaggtaaatttttaaataggaattcacaaatattgtagagtaattgtattcttctattaaataataaaagctcaataactgtttgttgacagaatgaagcttgcctgctatgctgaaagctatttctcgtattcagtgaattaaattctttattcaaactataaatctgaaaaatcatttatgctacagcgcctaaaagttaaagaaaaatcctgtttggataccatgtatattaggttctaacttacaatattcttaagtactttctccactctagagtactgctctctctgatgccaaaattcctgagctatcaacaaaataaatgtatgaaagctagacttgacactcaaacattttatcaaaaagttctgtttttagtaaagaaacaaggtcagttgaaggccatcatattgacaacatacattttctgtaaaatctgattatgacagacaaacaatttagtgcaacttactgagaggcataaatttgggttgatttttaattagcaaagactttgaattgacccatatttatcctctttcttgtttctccttaattcaagaacaagaattttcaagacgtttatagatagatgtttatataatctatgaccatggttaatagtcaagctaatgtgctaatgtggggagtcaaatctgtggtcacaatcaactaatataattcattttgagtgaacaaatatttattgagagtgttccagacctatgttaggtgttggaaataaattatgaatggaacagctatggttccataccaattaagctatcagtctacctgaacagatatatactctacaagtgacaaaagagaaaaaataatataaatacagattatgaaataaactatagaggaagaaaatctggcaatggaagagaataatggtcatagtggaggaggaaggaggcctatgttacacgaggtttgctatggtttgaatgtttgtggcccccacaatgttcatgttgaaacttaatcctctcttcataacataaaagtgcaaggtgaagcagcaagtgctgatgtacaagctacagcaaattattcagaagatctaactaagatcattgatggaagtggctacactaaacaacagagtttcaatgtagcgaaagcagccttatattggaagaagatgccttctaggactttcataggtagagaagagaagtcaatgcctgttttcaaaacttcaaaggacaggctgactctcctgttagaaagtgatgcagctaatgactttaagttgaagtcagtgctcacttaccattccaaaaattactctgcctgtgctctacaaatgcagcaaaaaagcctggattacaggatctctacagcatggtttatggaataagttaagcccactattgagatctactgctcagaaagaagattccctttgaaatgtgttcgctgacaatgcacctggacactcaagagttctgatagatgaatacaaggagtctaatgttgttttcatgcttgctgatacatcttccattcagaagcctatgggtccaggtgtattttgactttcaagtcttattatgtagaaacactttttgtagaaacaatcatcatagtgaacaggcatcgtatagaatgggagaaaatttctgcaatctgcttatctgacaaaggtataatatccagaatctaaaaggaccttaaacaaatttacaagaataaaacaaccccatcaaaaagtgggcaaaggatatgaacagacaactctcaaaagaagacatctacgcagccaacaaacatgaaaaaaagttcaacatcactgataatcagagaaatgcaaattgaaaccataatgagataccatttcatgccagtcagaatagtgattattaaaaagtcaagaaacaatagatgctggtgaggctgtggaaaaataggagtgcttttacactgctggtgggaatgtaaattagttcaaccattggggaagacagtgtggcaattcttcaaggatccagaaccagaaataccatttgacccagcaatcccattattgggtacatacccaaaggaatacaaattattctactataaagacacatctgcatgtatgtttattacagcactatttacagtaacaaagacctggaaccaacccaaatgtccatcagtgatatactggataaaggaaacgtggtacatatacaccatggaatactatgcagccattaaaaggaatgtgatcatgtcctttgcagggacatggatgaagctggaagccatcatcctcagcaaagtaacacaggaacagagaaccaaacaccacatgttctcactcataactgggagttgaacagtgagaacacatggacacagaggaacaacacacaccatggcctgtaggggagtggggggtaagggaagggaaagcattaggacaaatagctaatgcatgtggggcttaaaacctagatgacgaattgataggtgcagcaaaccaccatggcacatgtatacctatgtaacaaacctgcatgttctccacatgtatcctggaacctaaagtaaaattaaaaaaaaaaaaaggaattacattttgtaaggctataactgccataggtagtgattcctttgatggatctaggaaaagttaattgaaaactggaaaagattcaccattctagatgcattaagaacatccatggttcatgggaaaaggtcaaaatatcaacattaagaggagtttggaagaagttgattacaatccatgtggatgactttgagggttcgggacttcagtggaacacataattgcagatgtggctgaaaaagcaagagaactagaattagaaatggagcctgaagatacgactgaattgctattatctcatgatcaaacttgagtttgaggagttgcttcttataaatgagcaaagaaattggtttattgagatggactctaccagtgaagatgctatgaatattgttgaaatgatgacaaaggatttagagtatacataaacctggttgataaagcagtggcaggatttgaaacaagttctgggtttcaattaatgggttaaatgctattaaacagcattgggtactacagagaaatctttcatgacaagaagagtcaatgtgacaaactttattattatcttattgccacagccactctaaccttcagtgaccactactctggttagtcagcagtgatcaatatcaaggacagactctctaccagcaaaagattaggacttgccgaaggcttaaatggtcattagcattttttagtaataaagtatttttaaattaaggtatgtgcattttattttagacataatattcttgtgcacttaatatactatagttaagtgtaaacataacttttattgcactgagaaaccaaaaatttcatctgctcattttattgtcatactggatttattgcagtggtctggaaccaaatccacaatgtttccaaggtatgtctgtaaataacctcatccaaattcaaccacctacctacctgtatgtgaatctattcttagtcattgccttttactacatcttagattatctcttagtctgctcctgctgctacagcgaaataacatagattgggtaatttataaacaaaagaaatttattggtcagagttctagaagctgcaaagtccaagatcaaggtgccagcagattgtctgattagggcttacttcaaagatggtggaaggtgtcaggcctctgggtccaagctaagccatcatatcccctgtgacttgcacgtatacatctagatggcctgaagcaagtgaagaatcacaaaagaagtgaaagtggccagttcctgccttaactgatgaaattccaccatcgtgatttgtttctgcccccctttaactgagcgattaaccttgtgaaattccttctcctggctcagaagctcccccactgagcaccttgtgacccccgcccctgcctgcaagagagaaaccccctttgactgtaattttccactacccacccaaatcctataaaacagccccaccctgtctcccttggctgactctcttttcagactcagcccgcctgcacccacgtgaaataaacagctttattgctctttatttatatttatttatatttattgctctatatttataaaaaagcctgtttggtggtctcttcacatggacacgtatgacagaagggacaaacagacccctcaagtctcttttataggggaaggacactaatcccatccgtaatggtggagcccttgtaacctagtcaccccctaaaggtcctacttctaagtattatcacattgggtatacattccaacatataaattttgatggtacaccaacattcagactatagaccaatcttcaatgtttcttcaagaatcttcctgtatattctcttaattttcttttccaaatttacattatagacttagaaaaatgtaagaaatgttaatttgataatgctgcatatctacaactatctgatctttgacaaacctgacaaaaacaagaaatggggaaaggattccctatttaataaacggtgttgggaaaactggctagccatatgtagaaatctgaaactggatcccttccttacaccttatacaaaaattaactcaagatggattaaagacttagatgttagaccaaaaaccataaaaaccctagaagaaaacctaggcaataccactcaggacataggcatgggcaaggacttcatgtctaaaacaccaaaagcaatggcaacaaaagccaaaattgacaaatgggatctaattaaactaaagagcttctgcacagcaaaaggaactaccatcagagtgaacaggcaacctgcagaacgggagaaaaattttgcgatctactcatctgacaaagggctaatatccagaatctacaaagaactcaaacaaatttacaagaaaaaaacaaagaaccccatcaaaaagtgggcaaaggatatgaacagacacttctcaaaagaagaaatttatgcagccaaaaaacacatgaaaaaatgctcatcatcactggccatcggagaaatgcaaatcaaaaccacagtgagataccatctcacaccagttggaatggtgatcattaaaaagtcaggaaacaacaggtgcggagaggatgtggagaaaaaggaacacttgtacactgttggtgggactgtaaactagttcaaccattgtggaagtcagtgtggtgattcctcagggatctagaactagaaataccatttgacccagccatcgcattactgggtatatacccaaaggattataaaacatgctgctataaagacacatgcgcacgtatgtttattgtggcactattcacgatagcaaagacttggaaccaacccaaatgcccaacaacgatagactggattaagaaaatgtggcacatatacaccatggaatactttgcagccataaaaaagaatgagttcatgtcctttgtagggacatggatgaagctggaaaccatcattctcagcaaactattgcaagtgcaaaaaaccaaacaccgcatgttttcactcataggtgggaattgaacaatgagaacacttggacacaggaaggggaacatcacacacaggggcctgttgtggggtggggggaagggggaggcgggagggaggaaggatagcattaggagatatacctaatgttaaatgatgagttaatgggtgcagcacaccaacatggcatatgtatatatatgtaactagcctgcacattgtgcacatgtaccctaaaacttaaagtataaaaaaaaaagaaatgctaatttgaaaaagcaataaaacccaatcatgtaacaaagtcatatgaactctttaactttataaaagaaaattaaaaaaggactaaaaaaagtgcataaatactgtatacaaggagaaaagaaatattcatttaattgcacattgagaaatgtgagaagtagctctgagatgcttcagacatgtgccaagaaaagttggtggtatgtggcttcaagaaagaataacacgaaaatggcattgctttctgctcctggcgcagcttgctcacaggaccgagaggtggcattcctgggtctgggcgaggggacagcttattgcaaatgttgactggcaccaagcttgtcacagactatgggttttcattttttttcaccctctccttaaaacttagactgtagtaactgacaactcattgccattaggaagaaacttttatgagaagaaaatgacttgaatataccattggagaatattttttcagtagctttaatttcatttaaatctcaaactacaagcaaagtctaattactgatggtaggaaagtattcatttctcacattgagcacctataagatctatgttctttgacctatgggtctttagtgtgaactccaggttcatttttcttgctagtagcaggaattttcaaacacttatcttccatctgtaggtggcagtaagttattaatgtttttgttactctgcccagtggaaggaagattaaatctggtttaagagaaacaaaatataaagagaatattgttctacctttgggccagtataaagaacagtaacagtttttttttccagtggaagtttaattccttcccccattttaatttgaagtaaaattgaaatacttatgtattctcagtagactctccactagctgggatgaacttatgttcacatcagaataaacaaacctagaacaacaaggaagagtattgtataagtcagcagctgaagaaacccactgtttcttatgctgtgcatcttagcaagattagttcagatcttaaagcctactgttatatttatattaagcaatggcattttgctttcaagtatatgcatacaaaacatcaaataattattcttccaattccacaataaaaaagatttcttctgaaatcacttgctgatttccctcctgtgtttaaaagaaacaaaaaacaaccacaaacacaacaggaaaaggaactgttgatttgcaatttttctgccttgtcttttgccttgtggtagttcatatgcaaaacatgctttcttacagatggaatccactagtccttgccattaagggaaacacagcaggacccagagaggatttgctgaagctgaaaactgactttataatttagctctgagtcttgaagcagcataagtcacagtataaatcagaacactggatccaaaaatgcaaggcaaatagagcaaaacatgaatttctcccctcatactttcctcttgttagtacaattaaaacaacaaccagttcctttattgcttatgatttaacagacaagtaaagtgacaatttcaggctacagtagacagagccatagaaaaagaaaaacagccagtaagatgaggcagttactgtcatattatgccaacagatactgccaggtttctaaaataaaaacaatcttcaccatggtgaatactttgcacatttgcttagtttagcttcatggactcttcctattgcagtaaaccagtttatacttatatcgttctttgatttctcttaaaaaatttaacacaggctacagagattaagttggctatttcaaaaaataactttgggatatatgcttaacattttacctttcctgtgcttacagaatgcttttggctcaaaagggcctttctatttttgtatttatcctttatagggtagaattcttactttgtgtaagatcgataattcttactttgtgtaagatactatcgataagctttgttcctccacaagagccatgaaggcagatattctgtcctttctaatctttgtgcagctggcagaagaaaaggtcgtgtgatcccactgtgtcccaacctaagattttctgcccctgctttctcacactaataggtaacatttatacaccattgtaatttttatttttaattggtttgttttcaattttaacagaggatttcaccagtgcaaagtgcatttcatttttgatgagcagggaaaatataaccctttgacaagcacccaggtatcaaattgtccttctttctcttgtaagagtcatctggtaatgtaacaggtctgcatgaaaatgtataaaaacttattcatgagtaaagagctttttctatttcaattctaacttgcgtaaatgattttctgtggagccaaaaaatggtggctgtgtcagctgggttgatttgcctgattttcataaaaacataaacagcaccatagtttggcttttggaccttccttggtatttgtaagatctgggggaacggctcattataaccagtagttagaaagtatgagtaagtaagacccagaaaacacagcctgtaatagtaaatatcacgagtgccagtgaaaagaatcatgggcattttaccatcaaattgtcgaaagaatatgaaccgcagaattcaaacggatatgggctaaaatcccagctaagctacttatgccacctgctctgtgagcttgagcaaagtgtttaacctcagtttcattattttataacataggggttgcaatgtctatttttaaaatgtgcactaatgagataattaaagaagttatccttcatgaagcattgcaaagcacttaaaaactggtagatgcccatcaatcaacgagtggctaaagaaactgtagtatgtatgtacacaatggaatactactcagccataaaaataaatgaatgaacaacatttgcagcgacctggatgagattggagactattattctaagtgaagtagctcaggaatagaaaacaaaacatcatatgttctcatcgataggtaggaactaagctatgaggatgcaaaggcataagaatgatacaaaggactgtgaggacttgggaagagtgggagggggtgagggataaaagactacaaatatggtgcagtgtatactgctcaggtgatgagtgcaccaaaatctcacaaatcatggctgaagagcttactcatgtgaccaaataccacctgtaccctaataacttatggaaaaaaaaactggttgctgctcaaagcaatagcaacagcataagagccgtttcagtagaacatgccataggaagcagtaaagggtgaaagtatacagcagaggctaagctgactgcctgaagtttaatccctgccccttttactattgctgtgatcttgggtggatcgtttaacctctctgtaccttagcttagctatttatacaatggagataaccatagcttgaaccacatagcattgttacaaggattaactgagataatacgtatagagtaattaatacagtgtaagcaatcaatgatgttagctatttttttattattaccttccccctgcaaggggtttatctggcaataatacagtggtttccccttatctgtgggggatacaatccaggacccccagtggatgcttgagactgtagacagtactaggacttttatatatgtatatatattttccttttggtacatacttatgataaagcttaattaataaattaggtaagcaggagattaacaacaataattagcaataaaatagaacagttgcaacaatatgccagcatcactttaggtaaaataagtgtcacttgaacacgagttctttgataatgtgacagttggtctgataaccaagatgtctactgactggcggatgggttgcatatacagcatagacatgctacactaagggataattcatgtcccatggagcaggacagcagagacttcatcatgttattcaggagtgtccccaatttaaaacttattaattgtttatttttggaattttttaatttaatatgtttggactgcagttgactgccagtaactgaaaccccaaaagtgaaactgtggataattgtggactactgtgtagaagtagcctgtgtggtgttaatggacaatagaatatatttttaaaactgtggtatagccacatattaagatgtttctggaggagagagaaacagtgacttgacattggcaatgctacccaatggtaagaggaatttacttctctctgaatattctcatcaaaagcatggatgtgatcctgacacaagtgacgataagcaagtttggaaaaatttttggagttttgatcaattcaccatgtttcatttggttctgaatctcactatttaaatgaatttgtgaatattttggaaatgtagaaatccataattaatccccataagcaaaacagaggctgcttgttgaaatcagccttcacattctctctttttcaacattctgtgcagatataataaaatgtccttgcatttgtatgatgttttgcaattgaaagcattcccatacatgcagttctatgtcagcctcttacagccctggggagtaatcctagctcgtattggtatctcctccctcaaaaacaaattttgagaggtgaagtgatgtgcctcaaatcgcatagcttttaagcagcagagtaagttaaaaaaatcactcaacagtgtttgataaggttggcttttgcagcttagttttaggttatgtgagattgtactgtcacaagtaccactagaatttctgtcacattatgaattttttctgctttcactaattataataaagaaagacctttgtaacatgctttttatatttgtcttctatatttatatgtgctctttggggctattttaatttgacatttatctgctttttctaggaatattctgtgaaaaagactaagatatcagagaaattattagtgcacattattagaagagagcttcagatgaaaataaaggttggtagcttacatcataatattttcaagggcaaatacaattctttattttcgtagtcttggttatgggcttatatgtctgcatctgagagacaacaaaagaatcacagctggatttgcaagatgcatctaattgggggaaaatgcaggggtatgtgtggaaactttctttttttcttactccaaaaagtgaactcaaaaataaaagcacctgtggaattgagatttgagcaagaaaagcagtgtgggaagatggataacctttgatgtcaagttgatttctcatacctatgtggtacaatttcagtttgaatattagctatgcgatctgcagttctctgttctacaaggctcgaaaggtgaaggcagaatatttcagaggtttctcgaaactctaataaaagactctcctgccagatgacccttgataaacttcactcttcctctcagtaaaaatctcccccagacaggctcaaaagggttgatgatgttcaccactattaagtctccactcagccatgctaggcagctcagaaatttcattggaatttttccttacttggcagttttagatgttttagtcagtaatgcaaatccaaaaggagaagaacttggtaggaatatgtgaaaagtagatctatattacacaaagcgtacttgtggttatatagaagtaatatgtaatttttaaataatagcataatacatcaaaattgagcttgtggtgatgatgcacaataatatattccacttacaaatctgtttatattgttgtttttctgagtgttttcacagtgatatatttttcaatatagcatcaatatattttgtcacttatatgtcatattgtggtatcctcatcccccccttaagcttcttgagtataaggtttgtgatttattatttgcattatttttatgccttgcaaaatgactagcatagtaggctctcttttgatgtgcttgtaaaactgacctgagtatggatgtttctttgtctaaggacaatttcataatataaaatcaatacagatggtaacaccagtaaaaatcttagaaaccagatttaaagtattcctaacccggcttttatgaatttgcatttaaaaaagagcatgaggaatttttgtttatttccactgtctaaattctaagcagagagaatagcctaatggatttctgtagattagtttaaaactaacaaatagggagtaagtattctgtaaaatccctgtaattattatagaatccttcaataacctcaagcagtactattaggacttattttgttctctgagtacatatcattaggataaaaataaacacatttgaagctaaacaaagatttgaagatcaacgataaattaacttgatatatttgcagtggccaatccatgtctgtggggactggacacatcaatcagtgcaacattgagaatccctgttcttcatcccccacaggaccagtcacataatatatggggcccagttcaagatgacaatgaggagtccctaattcaaaaagcattacaacaacttttgactctctgttgtagtctctctctctcttgcaagctgttaccacgttttttatttgctgtttaatgccattcattttctcagtcatgaggacactcatggggtgagagcagaacttcacaggcaactgagaccctgtcctgagttgagcacaagtggtgtatgtacccaaccctgactctccctatctccacacccagacccccgctacgagtggagatggccatgggttattgggttggagagaaaaagcaggtagctgagaactttccctggagacatggcgaggtggtgacagtgggactaaatgtaatctgtgactccagggccctgacacctgcagaattgttctaacttacttcacttacaaaagctaaaattgaagatattatgttaagaattttcagatgaccacttcatagcattacactcctagtgaaggcccttgtgagcaaggcgtcctgtgctgctgcactggccccatgtccatgaagctggccatggttcccaagatagaagatctgtgggatgggtctggcccagtggctcacgcctgtaatcccagcactttgggaggccgaggtggccagatcactaggtcaggtgatcgagaccattctgactaacacagtgaaactctgtctctactaaaaatacaaaaaattagctgggcctggtggcgggtgcctgtagtcccagctgcttgggaggctgaggcaggagactggcatgaacccgggaggtggagcttgctgtaagtcgagatcacaccgctgcactccagcctgggggccagagcaagactccatctcaaaaaaaaaaaaaaatctgtgggatgatggagcacaccttgctgacagagaagtgatgtccttctccctagtgctgaagcaagagggttgacattgtctttctccttctccactgtgactgctttcttacttcaatgtgtactttgtcttcattttaatccacttatttttatttaaaaatgatgagaggaaggaaactggaagacaattttgataaagtataatttcataatggtaaaatcatgactcctgcaaatacaatatgaatgcatgtcaagattttatttaactcaatgattaatgaggaaaatagtaagatgccaacagtaatttaaagaacgtttgagaagcaatattaagattgctgggttggatataaaaatggttaatgtccaacaggaccataaattgtaacatttagggtactttttgttcaaaacaagttattctcatttctactggacaaaaatctacagttaacctccaaccttacaaagttgtaaagtagaacaggcaatagatagtcaagcccagcaatggagaactgcagtgtgaggacatctaagtaatctcttctgtctatttcaacttaaggatgatttacctgtcagtgtgatttgctccatcctagcattatctgggtttttatttcatctgactaacatgttaaaagattttccagtagccttctatatgcatggtaatagatgtttaatacatacaatgatagagtataaaacaggaaaataatcctcaatatatttaattcagcatgcatcctcttaatacttcaattagattatatacttctagattatagaaaatagcactggaagtagtctaagattcttaaatatttaggattagacaggtcttggtgatcttcagttttctccatgggagaagaaaatgtcattctacaatcatgcatataaatatttgtggctcacatttaggtctagaacatttttgaggctttaatttgtgtttctaagtggatgggtagactagagaaggaaataaaaaagcccagagaatttgtgagagagaaaaggggaaacaaattagtcaggtggctattcaggcacaatcccaccacataggtctaacagccagatgatgtcctacctcaagactgaactcaagtattttaggcatgattttctgccaattttgttgcatttcaattgtatttgtcataagttctattaatctcagactgaaaagacaaaatcacatatcttaaagcacatggtaagttaggtgagatatgaagaaaggattcttggtattgaaacatactaaactcaaagactttcccaattgttgctgtacagtcttccactatagaagtcttctaaaagtagaaacaaatttcacttgttgggccttgtttatatcatttgttatagaatttcttcactctatttctgagaaagagaatgttttatgtgatgttaatagttaataggtattcctggaaaaatactttatttttctcaatgaaattagtttagttacttctaagcagagttgaatgggttctttttttagaggattgcttttgaaactccaagagggagaaaggaacatgtgacattttatgaatttgtcttagagaaatttctccttacctgcctctttttccccaaggaatgcttattactatacttgaaaaatagctttgaaaattccagtctagtttaattccccctctacacaaatgatgaaagtgaggttcagaaatggttagtggcatacttaagaggaagggcaaaacacatacctcttgactgttagagtaatctaaaatgatgaagctataatttttatatgtagcctagtccttatgtgtaagtcccactgctaaaaatagttactaaatcattcagtttagagaactaatctttttttttattattatactttaagttcctggatacatgtgcagaacgtgcaggtttgttacataggtatacatgtgccatggtggtttgctgcacccatcaacccatcatctacgtcatgtatttctcttaatgctatccctcccttagcccccaaccccctgacaggccccggtgtgtgctgttcctctccctgtgttcatgtgttctcattatttaactcccacttacgagtgagaacatgtggtctttggttttctgttctgtgttagtttagagaatgatggtttccagcttcatccatgtccctgcaaaggacatgaactcatccttttttatgggtacacagtattccatggtgtatatgtgccacattttctttatccagtctatcattgatgggcatttgggttggttccaagtctttcctattgtgaatagtgctgcaataaacatacatgtgcatgtgtctttatagtagcatgatttataatcatgctactatttataatcctttgggtatatacccagtaataggattgctgggtcaaatggtatttctcattctagattcttgaggaatcgccacactgtcttccataatggttgaagtaatttacacttccaccaacagtgtaaaagcattcctatttctccacatcctctccagtatctgttgtttcctgactttttaatgatcagcattctaactggcatgagatggtatctcattgtggttttgagttgcatttctccaatgacctgttatgatgagctttttttcatatgtttgttggtcacataaatgtcttctttttgcccagaatctacaaggaacttaaacaaatttacaagaagagaactaaactttattatttgtgatgaaacaaatgcttgatttacatttcagatcctaggagagagagcattgaattaaagtctaaaaaattagaatttatcctgtctttattattagtgccgatttgaaccaatatcttaattcatttatactccattttatcatttttgaaacaaaaatttaaaactatattataaagatattttaagtagtaacatcattttaagataaattcgtatgagaacaatgcaactatgcatatcccagcacagacaacacttggtaattattaggtcaatggcagttagtggtggtagtatctggacggtacttgcttaaagccatgactgcattttactgtcagtaaccaatacccagatttattgtccagtgttttctcatgtagtttatatactctcaagtctttaccaagtgttaagttttggcttcaaatcactcaaggtttaggtaggcaggtgggaacaatttttactttatttttctagaataaaaggttaagcagttttcttaaggtacaatatctaccagcaaatgggccaggaaaaaaatgtaaggcttgtgaactttgtttactactcaaccaaaaggattggtttgttttctttctaaattaatcacttaaacttgttttttaagaatattgtaaacccaaagccaaaggattctgaatatctcacattttgttccacatttaactttgctctgttttcattttgtttgtcaagcttttcacacaattttaacagtggcatgtttaattatatgtaaaaatcatagtggttaacacaatttaccatttttacgcatttttttggtgcatgaattcaatctataagtggtcaaaaataaatgcttctatttacaaaataaacaggctttaacacatcttttcctactaaaaaaaaccattaataaatagtttttgaaggaaagcaaaacagtcaaaaaaacatattaccaggtcatatttagagtgcttgttctttgaagaaaagagtgagggagagatactattagcattctgttaagaaaggagagaaaagatagttttcagatgggatttaagccagagaagtctcttatgcccaggaagatcaatcagggtaaatgagttctccatgtattattacctaagggtagagaaaattgaagatgagattttcttccccctacttgtttgaccttgctgcataaatatgatataaaaaatatgagtggaatttgatagtggtcttttccattggtcaaaccttgaaattttaactctttgaggcttttcaaattcggtgtaaggaacacaatttcttcacatttaatcttatttgttcttattaaaatacaattgtatttgtaatcatgactttaatacaacacttatttgccgaagatctatcaataaatgctttctgccctgtgaaaacaaatgcccagcacttgttgctacactcaaggatggcagtaataaaagtggttagaaaatcaatttaaactgcatttgtactttaccatagagctggtgacacttaaacattggtaagagttacgctcttcaaatatgtgatccacttttataagcaactaaaaaccctacagcttcagtcacactctcaaagaaagaataaatgacctcacatcactccattttcagaagacctggcacttgtagaatgggggaaagaaatgagacaaaaaaaaaaaagataaacaatagaaattgtgaaacctaggctgttttaacctaagcttgcagtttatgtgtataaatggaaaaacacaatttgttctgcatgccttaatgttttacaaacttgagattatcatacacaaaataatatgtggaaaaggtttccatgtcttatttgtctttatgaatcccacgatcattacactgcttaacacaaaagaggctctacagcactcatagtataaaagaagggacagattgatggtatgaaggacacatatcctattttaatcagacagatttagatcaaaataatttctaaacatggatgttctagaaaaaaagaaaaacagaaaacaattaccagaatgttttgttgtgatgcgttactttttgtttaagtaacagtgacctaaaacaggcctgtttctccttttcttcttttctaatagcatgtgtatatttgcataagtacttttttgcttatcacaaccttttcttgttaaacattaaggacagcagagggttacagtgaagcagctggaactcctatcttctggtaatgcaaaaagtgtctggtgttcagaaaagattcaaaacttagtaataatacaaaaggagagttgtgtgttcttttaatatcataccagagcattgtctaatgggcttgcttaaggattatgtaattctctagaaggtgaacttttatttggcttactatttacagttatatgtcactcagtaacacttctgagaaatgcctcattaggcaatttcatcattgtgcaagcatcatagaatgtacttatacaaacccagatggcatagcttactatccacctaggcgatacagtatggtctattgctcctgagctataatacagatctgtacagcatgtagtaccaaagcatgttctgaatactgtaggcaattgtaacacagtggtatttgtgtatctaaacatataaaagatgtataaaaatacagtataaaagacaagaaaaatggtacacctatatagggtacttatgaaaggagcttacaggactgcaggttgccctgggtgaatcagtgagtgagtggtgaccaaatgtaaagggctaaaatactaccgtatattaccgtagactttataaataccatgcacttagtctatactaaatttacaaaaacaaaagtaattgtgctatgatgttacaatagccacaacatcaccagaaaacaggaacttttcaactccattacaatcctgtgagaccaccatcatctgttttgtctgttgttgactgaaacattgttatgaagtgcattagcactattaatactgttaattagaccaggactctgtgaagttacatgctcacttgtaggctgtggtttgatggaggcgcaaatgaatacagactggtagaaaacatcacaaaattacattttattgccctatggaacattaactagttttgtctctaaaccttgcaattttattttagcatcctttcagtgtctataaaagctcagtctcttgaattctttttgaaccaactttaccttcatgctggttgctttgtataggagctaaatgaatctttggtatgtggtttatacaattgtataaaaatcatgtttataactttttgaaaattaaactttgacactgggtttgaattatcttgccagaatcctgtcttagagaattgtagaggggagtttagattttgtggggcctgaagctcatataattttgtgatcttttataaccaaaaaaattttacagattcaaatgaaaaattatacataaaagtgattatttatttagaataggaaaataaataacagcaaattacattaatatttggagattcaggtctctttctctgaactctctttttaattgtactacagtttttgttttttttcaggagaccagagttttattattactcaagttagcctcctattgtactatagttttaaaaatggatacacaataattgtgtaaagggctaaatattattatatattactgtacatatgcagtaatctatatataatacaaattatgtataataaaaattttacatatttatggggtacatgtgatattttgatacaggcatacaatgtgtgattatcaaattagcataattggaatagccatcacttcaaacgtttataatttctttgtgtcaagaacattccaaatcttatcttttagctgttttgaaacatgcaataaattattgataactaataatttatcaataactaatatatttacccattgtgctatcaaacactagagcttacatggagatgcttcctgatcgcaacttgttttcccttcccaaaggaaattgtgagaaattattgcaattcctagcaactcccaatcccagaaagacatgtacaaggttgagggcctcttaagcttcattagcttcgaggtaagccagctctgctattgggtgaggggatgtcagcaggtaaggagctgtgaaggactgggtggaaagaaacaaaccagagaatattttccccctcaggcaaccatggagtggcccttggagcaaggctttgtgaggactcctgcatgtatctgacaagagatccaggaccgagtttgtgtgtcagggagtacaaaatcaatacagaaccataatggcaccagctcataagaaaacctttcgatatttttcagtcaaatccctcctgtcccaagccagacccaaacctggagaaactagaaaaagaagagggatagaaagaaatcaagaatgcattacattccttccccactctaaattcttgaacttgaggtttgtccaacctggcatagggctgatgaccactaaattggatatgagacagaagtttttaattggtgtagtctgaaccagatgatttaatatgtgaacatacatagaaggctctggaacctgcaggatattccagtaagggaaaataaagtggagaccaacagagtatgtacaccatcaatgacagaagaaaacattcttttgatactcacaccctagagactgattttagtgaatgaattatgtagaaaataccttaaatactcaattaattaacataataagaaagataggaaaaactatgaaatcatttatgcttctaagttcttaccgaaaacctggttagctttccccgccacctgtttctctagcaacaagggctgcccacagtgggagatgtttggaggttcactggtaaacttttatattgagaataatctaactaaatataaaatagtcttctagtgcaagggacacttaaatcctatgtacaatttcaaggatgtagactacagacagaaagtgtagcagttaagaagaagggttaaatatttgaaaatgtcattagtctaaatgtgtggtaagaaattgatctgaaataggctcttttttcctgtggtatttagaagaatagggtagactgctgagctagatttggggtaatctgggttagatacagagtaaaaactaaaagatctcagcaggtgattcctagcgacatgacattgtgaaatgacaatgaagacaagcaaaaattgtgtgagggattgcaacttactacagaacaaatggaaaagctaagacctgatatcctgtctttatgctgtgtaacagttcttactattgcaatttcaaattcaatttatgcctcctacctcattttgaagtgctaaatgagttggaaactgaaaacctcagtaatcacaaaaaaactgccttctttctacaaatgttaaaaaaagtctataaaatgagataatagggaaagatggattgaaagtaaagaataaaggaaagaaactcacctctgttcacatggggtactgagaataatgataatttctgaatgctaaacaaatacataccctgtttgaagcttgcttaatatggaaaaattattaatatgaattggggttgattttcttagtctagctcaattagttgaataacactaatttacccatttgttgccctagtgcagtggtctgcaaatgatagcccttttgccaaatcctgccagccacctattttggtaaataaagttttattggaacacaacacagtcatatccatttgtttacattttgtcagtggctgcattcctgctacaataggagagttaagttattgcaatacaaaggctgatatttgctatctggcccattacagaaaatgtttgctagcctctgccttggaacatggaggatagcactggttaatgatgaataaaagctatgagaacagctagaagcatagaaagcagattcattgagatgtgaaaattattgactttcactgcatgataaaatacatttatatgtgcttagctcctggtaaaattaagaataaatttgaaattagtgtctcaataattatttactgtaatgtcagtgatgtaagtttctagtgtcatggttgtatagggtatattcccaaacctgatgctccttttaattactgtttaacttatttaaaaacatatggctcagaaaggggaaagtgatgtaaatattatctgtttaatttactaacctttctatgcccttttggaaacagcttgttttaagtccgtagagatttggatactcagaataagccttctgtatcactttctaaactgaatttcactacatgcaatttggacttctctgaaatgaacaaccacaggggtttgaaaattctagtacagatttataacaaaatgaaaaaagattggacactgtccagaaacgtgtgatggtactcaaagcagaatgacatttgctcagtaaagctgctgaagtgttactttccttaatacttttcaacatgaaatttgtcttcttgtaagcagattacattcatagacagtgtaggaacagcactttacagcagtaaattagatcaaccaaggtacaaaaattagtgatgattttgcttacaaatatccattgtaacagtatttcattttgtgaaccctaaggtctaactctgtggcactgaaactctgttcattcactaccccactcttgtgtagagagccaatttctttaggggttatctcatactataacactattattcttcacttattggggaaaataggcatgcattttcaggaggtacagattagaatgctcaagagtgtgtgtgtgtgtgtgttgaaaaatctctctttcttaaggttctcatatactccattaggaagcattccccaacctttcaattagagtcctggcctagaacaattaaactgtgatgagaaattgttatttgcatttcaaagtaaaactttatgcatacatgctacagtattaaatcatcagtatctgtgtattttgagagaagcaagcagagaggtaaaagggctttcttcctgtctctgtaataatcactcttttattctgaacataaacagtctattactttgaaaataaagtaatataacttgtaagcctataaggaatttcatcaggccatcttgtccatcctccctgaatccagaaaggctgaatattaacacatcttattgaaattgatctgctattttgaaagctgtcttgcatccaatttcttcttttgagaaaataggaggaaagagaggggaagtttagaactctgcctagatgggctcaggagtgagatcaggtcagatggcatggactgagggaaaaaaacagagccaaaggatgagaaggactggaagagagtagaagattttggagaaatccactttatgatatggcagcagaaagaaagagaacctttggcttcggctaacaacatagataggaagtgggttaccaaaatcatgaagtcagttcagatccattttgtcagaatcagaatgaggctcactcagtagcacagggtttctctaaatttctttgttggaagactctacactgctccgtgtatgccaagtgtgaatatgcatctgttgagggagagagttggttatggtgatggccctctgtgtcctacctctttgacccatgttcttcttaatgagctgaaactgcttatggtctcattgggagtctatgttctccttcagtacattttctggttctcctttttggattactgcacaaactgctggagtgctagctgtagggttgggtattggtgggaagagcaaaagacagcattcttattctgataatctcctccgtggtcctatagctctctgttttcttgtattaaacttctgatatactacaggcatctcttcttaggatcctttcaagaattaaaaaaaaattgttgttctggaactggccaactccactgtattgcatgttgaagtacacaaagggattgcaggaatataagtcatagctgccatggagcagcatgtcctgtatgcaacggtgtaagtagtagtttacaggagctgagcaccggcaatcaaaatagaaagcatgttgttcataagatgtgaagaagtgttatacttaatgatacacaactggtacatctccatgtggctagcagtataaagggacatacagatctggaagtctttaaacagtgcatgccaaatcagttgaccttccagtagatttctctggagttgtggttgagaggttgagagatttagaaatgaggatggaaggtgagataatgtacgtgatgaagactgactgatacatttttttgtgggaaaatttaccttaagtcctgaagagctgatagagcttccacgctagaataaaaactctttgtgtgtcttgaatatacatctttgatttacaattaccttggctcttagttggctctcagacaatgtttgttggaataagtctaagagaatcaatatataaagtataaataaatctaggactgcttatatatacatcctgttaggaagattatctttattgttattttcaaatacatattaaataactgagattggaattaatgtgatgttctttaattcatgcagataagaggtttactttatttaacacatacttggcttactaaatatcagaaagttaatgtcctaaaataaaccttatccttacctatttctctgagttggtaatgttagacacttttccaggaaatgagagtgtgttagttttctattcctgaataacaatattaacaccaacttagcaccttaaaagaacatactaacagttaactcacagtttccatgagccaagtttgggcatggattcactggattttctgcataagaatctcacattgcagtaaaggtatgggataggttgggggtctcatctcaaggcttgactggggaaagggcccattttcaagctcatgtggttgttggtaaaattcaattctttgcagttgtaagaatgagggattcaatatttgctggttgtcagccaggggacaccctcaactctgcttcttgttggctggaggctgcctcagtgtcttttcatgtgggtcttccccaaactgctgtttgcttcctcaaaggcagcaaaagagataatctctttgtaatatacagcttacacttctatgtagtctaatcctggaagtgatgtctcatcaccttagtttatcagatagtctgttggttaaaagcaagtcacaggtttcacccacagtcagggagggaggatcacagaaaggcatgaacaataacaggagggggattgcagggccatagtagggtatgttcaccacatatagggagggagaaaacacaattcttgtaacttctgtaatttcatcagtaataaagcctcatggaaaatatttacttaggttgaataacacaaatatttcagacattaacacagtcagttagagaaggttttttcccgtttctatttcacttaatttgacagaattgcacgttcttctatggggtttgaaagttgccttgctaaattatttttgcattattagattttgaaaaacaattggtattagtgggtgattataaagcaaaatacttattgagtaaagccttgaggaaagtgatgatagtcaaggagataacgttcactcttagcccccagatttactctcatttagttctttaaatctgtatccattgtacttatgttgaataggtctatgttgctgttattgtaccaatgtataaatgtgtataaattcactatgtaagtcagatacttacacagtgaatcagaagccaaatttctagacactctaagaaactctgcctgacttttccactaaccatgccttttttatttttttcaaatttattactgtcattctgtgattggtaaatatatcacattgactttatcatatctgcccagtcctctgtttcttgtctttgtgattggttctttctctctttttttattttctattctagtgatcactatcagagcttgtttctgtctaccatttttaaatcctgcttttttgataaaatttctctcttttctacactgtgtatagagatgtttatttttatggagtaattattgactgcttgatagctttccccatgaaaatactgaggttaattaattaaaatatttcctgtgcaatttggtcaatttttccttgacttgaattattgtaagttgtatctgtttcagcttccattctgtcattatttgtagctccaaaataaagaattctcagatgactgaagaaaattgggaatatgttttacactgttcaaatgagactccctcagggttgattcagttaagacatttaagtggagcagaaagtaattttaattaaaatcttcttaagtttataagcatgataaatctgcttcaagaagaaaaaaggatataggattgcaaataaaaagagaaaacagatataggtaattttgtttttacctctaaccttagcaatctaagcagattcttttttggcagatgagtaaaaaacaaatataaaaattaataaatataaaaaattaataaatatatcaaaaccatcaccaatgaataatagcctctcattcatatttacaagaagctggaacacctagataaagacgtggattcatttgaaattgccaaaaccaggtctagttacctagttactgtcagagtctgagactctcttgtctcttgagctacaatatatacatttctttggacaaacaagaatttaccacatgtgtgcatcatttaggtgatgcatagaaaaacttgagaattctggacttgtcattttcgtctctcagaggacaatactgctggcttttgttgttttaagaatttggagtcatgtaacgtaggttgggaatcaggagactaatactgacctgatgcaggtgccattgttgcggcacagatgatgagcacaccaagggacgtggcagttctcaatattctttccatgtcgtgcttcatcgatgatgaagaattctttgttgtttacttgaaggtctagaatgcagcccctgaacccataaacaggacctgctttcttatgaatttgaacatttgcaggaatatggccaaggaacattgattcaaaatatgcctgtagaaaaagtaacaacaaaaaatattataggttgttgtcagattatgtggaaaagatgtaggatgtttggttctgtaattggatgtgttttaatgtgtttttctgtgtaaaagaggttgctattgttggctagttttgtcacttctactaggtggggagatagactgttttagaaaatggtccttttttacatctcttttttagctctaacaatatctaataatatttagcagaaaaatagacactcagaaaaacttgctgattgattactttgaaattttttttgagctgatgtgtttgcattttagtgtaaacattaccaaataataactaaaaaagaaaataaagccatgttaactaattgttgttaggggttgaattgtgttccctccaaattcatatattgaagttctaacccctagtacctcagaatgtgactttatttaaaaatagggtcattgcagatgtaatttattaagatgaggtcaatactggaataaggcaaaactataatccaataggacgttttggacatttataaggacttttataaggacaatagtctttttaggacttttataaagaagcttggatacagaccgactggcacacaggaatattgccatgtgaacaaaaaggcggagatcagggtgatgcatctatgggctaaggaacatcaaatattgccaacaccttaccaaaaatgagttaagaggcattatctttctcaagtcatcatatggaaagaaccctacagttctttagtttctagtttccagagctgtaagaactgtaagacatttctgtggtttaagccacccagtttgtggtactttgctatggcaaccctgacaaactaatgtaatcataatatattataaatatcctaaaatatgagcaaaatgtacggtgcttgcaaatggtgcttggaatgttgaaaatgttaccgtttcctttctcccaaatttgaacataaatatgcatgagaagtagaattttgcttgggtaatattcacttccttaattcaccttttattccaaaatcagatcaagaaaagactcttgctttgagaagacacaaagaaatcacatcatcttattgggattactggctagccatatgcagaagattgaagctggtccccttcttacaccatatacaaaaagcagcacaagatggattacttaaatgtaaaacccaaaactataaaaaccctggaagacaatctaggcaataccattctggacataggaaaaggcaaagatttcatgacaaagacaccaaaagtaattgcaacaaaagccaaaattgactagtgggatctaattaaacgtgagaacttctgcacagcaaaagaaattgtcagcagagtaaatagacaatctaaataatgggagaaaatttttgcaaactatgcatcttacaaaggtctaatatctagcatctataaggaatgtatacaaatttacaagagaaaaacaaccccatttgaaagtgggcaaaggacatgaacagacacttttcaaaagaagatatacatgcggccaaaaagcatatgaaaaaaagctcaatatcactgatcattagagaaatgcaaatcaaaaccacaatgagataccatctcacaccagtcagaagggttactattgaaaagtaaaaaaataacagacgctggctaggttgcagagaaaaaggaacacttatacactgttggtgggaatgtaaattagtttagccattgtggaaagcagtatggtgattcctcaaagagctaaaagcaaaactaccatttggcccagcaatcccattactggatatatacccaaaggaatatcagtcattctaccataaagacacacgcacctgaatgttcatttcagcactattcataatagcaaagatatggaatcaacctaaatgcccatcagtgacagactggataaagaaaatgtggtacatatacaccatggatggaataatatgcagccataaaaaagaatgagatcatggcttttgtggacacatggatggagctggaggccattatcctcagcaaactaatgaaggatcggaaaaccaaatgcagcatgattctcacttatcagtgggagctaaatgatgggagcttatgaacacaaagaaggaaacaacagacactggggtctacttgagggtaaagggtaggaggaggtaggggagcagaaaaaataactattgggtgctgggcttaattcccaggtgatgaaataatctgtacaacaaaacatcatgacatggtgtacccatgtaacaaaccttcacatgtgcccccaaacctaaaataaaagttaaaaaacaaaaaaaagaagtcagactatcttaaaggcaaccaaaccatttatagaaaattagtagaataaagagactctgtaaaattaggctgttgatctacctttatttgatcaatacaacagggccacatcttacatgggatttagttctaaagacggcaaataagatgaatatttcatagaagctaaattgtctttggaaatcctttagccaccacattggaaactaacatgctttctccagataattccaacacagctacatatttcctccagctttggaatagcttgctgttttttcagtgtagctgtagatgaagctggcatttcatgtcatgttgtataaaaactctagaaccccccagtgtgtggtgagatgtaccactgtcaaactaagagggaactgatactgagtacaataaattcacttctcacatctgatgttcattgcagagcttatgtgcattgaccagaatgatgctaaaatcagtttacatgatttaagttgctacttgatttctactttcccaccctcagcaacatatataattgaattctcataatttagatgtacataaaatgcagaccttctctgtaagaatttatgagctacaattgaagtctaaataatctggaaataagacactgctcttcagggctgttaggcatatggcaggtagatgcagcaacatttgtgtgggtaacatctctgatatcccaattcccaaaacacacattcatacctcaagttgacatctgaaaagtatttaaattggtattacagatacaataaaatggaatactgtcattgccagaattaaaaaactaaagccaaataattaagttaggggtctggtgggaggacagtgtgagagatgcccagcaatattgctttacatttatactaatacgtgctgttttcatgtggatgtacttttagagagcagaaacatgtttaattctaggaagagcaaagcatctccatgacccgtaacaggtcaaactaactctgtatttgagatattgttctttttaaaagactgagtctctgctcctaagggtgtctttaattttttttcctgagtatttcttcttatttaggtcccagagggtgattatctttgtgtatgttatggtggaagctaaaagttgcaaggtgtatcaatagagctgtcacatagcataggtgtatttctgtttgttttcacattctacaaactattagcagatctgtctattagctaagataagtgatccactgttacaagactctgcatccaaaggatgaccttcctctcactgaggatctctgacatctttgtatattgatcacacacctggaaaagtgaacctttcactgttttgacaagtgtgctctttaagcacaaaactggtagagaatggaagaataccctccttttctgtcagcagtaggaaggtatgaaggaaagtctatagagctatcaatgatttattagaccattaaaaaacacccaaacaatggaaatagatggctcctgtatttcttctgatgtgaggctcatgcttagttggagtcctgaaatgtctaaaaaagcagatgttgttggctgcacacagattaccattaaaatggtcgacttccattcccagactttcaattatccaagagacgacttttgtgtgtataattattcctaaggagacaggtctttaacataagtcttttctaataattccttgtgaatcagactatgaagaataaaatctgacatcaagatatgatggtacaagatgaaagcacagagaacagacatggacaatcaaggaggaatcatgaaaataataaaaagtatcagtgaaaactgagggaaaaggcctccatatctgacaggagtgaaacgaacactccttttcctttagagtttctctttaaaggaagaatatagttattcttttatgatacgtatgaataaaataagaaaataggcaaaggggaagtaaaatttaaaatccatcaggcaggggagagggtagataagaagctgtcctatttattttttgttttgttttaatttaaatttagatgttggagtactgcatatctttctgtaatgacatcctgatttaatgtttacttttattttgcattctcaattctgcgtctgaagttaaatgacttgtgttactaaaatatggagaggtgattataaatatacttttcggttaagatgaattatcagagcgcacttgtctttaagattatgatgacttacaattgaaacaaactggcttttatttaagagtcattaccatttttggtttttaacattatctgaattgtatggaaacaaatttaaaatcagaaacattaagttttggaataaaggtggataagaaatgttggataaagtgtttcagaaggatttattgaagtaacttttcacatgttaaaaaagcttaaattcttaaaaattgtttaagggaaataagtgaaaagggataaaaaataacaccagcaatatttatcaaaattcccattcttttgcagttaaaggatctctctctccctctctttatcttacttttccctaaagtataataatctgtgagcatatgatatcttctatgttaatatatatttttatttttaggacagagccttcaccctgattatctttggattcttggagtccatagaagtgccttgaaaatagaaagttttatacacttttttttacaaatgacatgaaatccaatcctgcttttcctcaatctcttagttgtcttttaggcctctttccccgtgttatgctgccttagaatctcgatattttgctagattcagcacatgggatgtccttacaagatcccactcagaataaatgttatattattattctaatatacccttctatattttatatatatatatggcatattgcataggacagtagctcacacaaggttatttctttaaaaatttgataaatatgagtgaagtgattattgatgttatgatcaataattcacagttaatatttgattcttaaggctttctaggctaggaaattttctcagaataatatctcctcacctttttgaagggacaactaaactttagagaagcaatcaataaactgagttgctactttgtgaacacattgatctagggaagtgtaaataaaaaagaagtatgtgggattactcttgtctataaagaaattaaatataatttggggaattaaataataaaaaaatttgttgcaaaataataacatataggtcagcaagatggcagaataggaagccccagaccctctttcccctgtggagacacagaagcaacaaaaatacatggaccaattccctttgagaggaatttagaaaacagttaagagggtcccacatgtcaggtgattgtgaagccagctgtatcaaagctgtaaggaaaatttatggcattcattcattataggtccactccccaacatagcatggcatgatgaagagaaaactcccagcttccagttttgccttgggaaaagaaatagaaaactaaaacatgtccagcatgcagactctttggggagctgtttgagtgattggattttgtcttttctgatccaggaaagggtaccacattggggatcactgagaacaaaggtgatggtttggactaatatgcaatcattcaccacagtctcttgtcctggcttggcatgggatcagagaaaattctcaccttccagtttctcactagggaggtaaagaatgagggcatgtgtccagtgttaatggctttttgggggcttctgtctcactagtttctgtctcacctgtctcagaatgctgatgggacctggcttactctcaatatctggggactgctgagaaaaaaagagttttgggaggcttacttctgcttcaaaggacccagaatacagaagacagaggctggtatagcttcatggcctctccctcaggagggagtgggtgaaagagtggatcatgcacccaatgttctggcttttcagaatgttacaagagactaatatctatcttgtttgactgagagtgttaatgggacttggcatactctagaagtctgagggcttctgagaataagagagatgggcagcttgtggcagatccagagaacctgtagtatcatatacagaaagtaaagggagcaagagattatgagctcctgaaagaagaaactggaaaatcactttaattgggagtctgcaggcacaagttcagggaagacacatccataggaaacactggagaggacctcagactgactgttaaaggtctttccctgtacaaaaagccagtccaaaaagactggaagaagtgactgtcttatcaaatgtgtggattccaccacaaagttagaaagcaaaggaagacagaggaaagcatggcataatcaaaggaacaaaatagatctccaggagacaaccctttaaaaagagatctatatgaattacctgacaaaaaattcgaagtaaccattttgaaaatgttcagtgaggagagaaaagtgatgctgaacaaagtgaaactatcaaaaaagagaaaatatgaaagaggaccaaccaaaaattttggagctgaaaactgtaatgcctgaatttaaaaattcattacagaatttcaacggcaggcttggtcaagcagaagaaagaatcataaaattcaaagacggatcacttggatgtctcaaaaggagaagagagaaagaaagaagaaaaagcttattcatagaaataatgaatgaaaactccataaatatggggaagaaaatgtacacccagaatcaagaagctgaagtactccaactgaaatgaacctaaaaaagtccactctgagacatactatagccaaaaccagagaattttaaaagatgcacaaaaaaggcaacttgtcatgtaaatgggagctcccatgagactatcagtagatttttttccacagaaaccttgcacatcagaagggaaaggggtgatatatttaaagtgctaaacattttttaaaggaacctgcaaaccaagaatactgtatttgccaaaactgtcctccaagaatgaagaagacataaagactttccccataaacaaaaactgaggaatttaatcattacatgttccttacaagaaatgctaaaggaagtttttccagttgaaatagaagaatactagacaacaacacaaaaacttctgaaagtataaagctggctaaaaatggtaggtatgtatacaaatatagaatactgtaatactgtaatcatggtgtgtaaataaattttggaatttatttattttccatttgtgctattattttattgttgtattgttatttttatggtttttattctgaaatattttctttttaaagatttcaacttattttagatacaaggggtacatgtgcaggtttgttacctgggtatattgcatgctaactttaggaatttagaaattaagggcaaaagtataaaataactataattataaaatatgttaacatgtacacaatataaaatgaggttatttttatgattaataacataaagtgtgtgtgtgggagcaataaaggaatagagttttagtatgtgatattgaagttattattaccttaaaatgtaaatgtactgctatagctataaaatatgttgtgtaagcttcatggtaaccataaaaaatacctatagaagatacaaaaaaacaaaaaatgaaatcaagttatgtcattaaaaagtcacaaaggaagaaagcaagaaaggaaatgagttacaagaaaacttggcctacaagagattcactttagatttaaggatacacacaatgagaaagtgaaagtatggaaaaatatattccatgatcatattgttgggctttgtgtccccacccaaaatctcatcttaaattgtaatcccctaaatccccataatccccacatgtcaagggaaagaccagatcaaggtaatttcatcatggggatagttttcccatgctgttcttgtgaaagcggcagttcgcttgagatctgatggttttataagtgtttggttcttcctgcgttcattctccttcctgccttacaaggccgcaggaaggagaatgtaataataattacattaacaaactggaagataacaatcacaggatcatctcaataaacgcaaaatgtcattttacaaaatttgaactctttcatgaaaaaatactcagcaaattaggattaggaggaaattaattcaacagaatacatatcatactcaatggtgaacacctaaagcttttccttcaagttgaggaacaagataaggatgcccactcactgcttttattgagcatagtactggaagtcctggctggagcagttaggcaaaagaaaaaaaaaaggaacaaaatgcatccaaataagaaataaagaagtaaaattattttttgttcacagatgacctgataatatacatagaaaaccttaatgatatctctgacatacatgcacacacacaaaaactgttagagccaacaaatttagcaaaatttcaggatacaaaaatcagcaaaaattaattacatttctatagactaaccattaactatcacaaataagaaaacaattttatctataatacatgaaaaaggataaaatagcataagaataaacttaagagggcaaaaaacatgtaacttaaaactacaaaacattcttgaaagagaaaaaaggcacaaataaataagaaaaacactttacattcatggaacatcaataaaatgtccatactatccaaagtaatctacagattcaatacaatccataccaaaattccaaagatatttttacaaaaattgaaaaaacaatgctggaatttatatggcaccaaaggatgccaaatagccaaaacattcttgagaaagaatacaaaatgggagaggttcccacttcctgacttcacagtatattacagagctatagtaatcaaaagtgtatggtgctggcataaagaaatgtataaaccaatgaaacataagaggctgtgaaaaatcccatggacacatggtcaaatgatctttgaaaagggtaccacaaatgcatgtggaaaataatcttcaacaaatggtcttcggaaaactggctattcacatgcaaaagagtgtcattttataatgagcaagcatttggcatatatctgaaagatgtcttgaggtagtagaaaattcagaacttagctgaggtacagtcactgaagatgtcgttaaatgtaaaatattctattctcaacaagtatgccacactgctttaatttacactatataattacacggcattaaaattctgatacatcagtctagtggcaagccttaagtaggaacagataaatatgttcaatctgcttatgcaacaattactctaatgggagtaggaaatagtgcatgttcccaaggattctcattattttaagaatgtcccaggaattccctgttagtcacaagtcaattctcttccactagtaactgagagacgagagaccctgaaaggccttgaattcctttttcactaaggctgttcctgatgggagagcttcagcaacatcttggatagcaaaccttctactgaccattatattgactataataacaaaagaatgaagacaaattcacattctaaggaagactccagaccactttccacaatattttccacacagtaggaaactattttcaagaaggtaacccctactcatcatcaagaatcaatttgttcagctctatgataatattttcaatgaatcagtaagacaatcaataatatgttttcttttgtttcttctgaaatccctttattgtataagaaattaatggtataatttaaaaagcaaggattttgaaaattgaaaaaattaaattggatctttgtcttacactatacataaaaatctacttaaagttgattaaagacttaaacttaacacccaaaccataaaacccctagaggaaaacatggggaaaatgcttcattagttttgacaatgatttcttggttatgacaccaaaagcacaggcaacaaaagcaaaaatagacaagtgggacctatgtcaaaaaaagcttctgtgcagcaaagaaaacaattaacagagtgaaaaggaaacctacagaatgggagaaaatattttcaaaccatatgtttgataaggagttaatatccaaaacatataaggaatttctacaactcaatagcaatgaacaaacacacaaagcagacaaacaaaaccccagtataacctgattaaaaaataggcaaaagacttgaatagacatttttccaaataagacatacaaatggccaacaggtatgtgaaaagatgctcaccatctccaatcatcagggaaatgcaaatcaaaaccacaatgagatatcactttataattgttaagatggctattacccaaaccagaaaataacaagtcttagtgaggaggtggagaagtggaaatttatgagcacggttggtcaggatgtaagatgatgtagccactgtagaaaacagtatgggggtttctcaaaaaattaaaaatagaactaccatctgatctagcaataccacttctgggtatttatccaaaagaactggaaataggataaataggatatagaagagattatttgcagttggatgttcattgtagcattatttgcattattcacatcattcaaaagatagaaacaacataaatgtccattaatggatgaatggataaagaaaatgtggtatagtatgatctcacttatatgtagaatctaaaaatgttgaactcatagaaatagaaagtacaatggtgattgcagaggctggtcagggatggggatagacagaaaaaagaaaaacattggtcaaagggtacaaagttccaatctgataagaggaataaattttggtgatctattgcacagcatggtgactatagttaataataacatatttaaaaacaactaaatgagaggattttcaatttcttaccacaaagaaatgataaatatttgaggtaatggatatgctaatttgctgaatttgatcattccacaaagtatacatgtatcaaaacactacattgtacctgataaatatatactattattacctgtcaattaaatatataataaaaaaggaaaacgatatatgtgtagatattatggaatattcaattttttaaaagaaagaaatctttcatatggtacaacatagatgaaccttgaggactttatgataaatgaaataagccagccacagagtacaaatactgtatgattccacttaaataaggtatagaaagtaaactcatagaagcagaaagtagtcagaggttgcggggagagagaaatgaaaagttgctcttcaatgactatagagtttcagataagaagaaaaagttctagagatctgttccataataatgtgtatataattaacagtaattagcaataatgtgtatataattaactgtacacataaaattttgttgcttagtaatagttgcaatagaataaaggaaaacatcataaatcacgttcagcacatgtatcccagaacttaaagtaaaaaaacaaaacaaaacaataaatcagattagaaataaaaaaaagaaaacatcatataaaatgttgtgagaccacatagttttggttaaaagcatggactatctagctagaatgtctgggtttgaatccccaaatagctgtgtgatcttgggcaggaaactcatcctcgtgctttattttccttctctgtatttgaagataataatagtatttacttcatattttttggtaacaattaaataatttaaaatatgaaaagtgcttagaacagtgtctggaacatagtattacatattttagctattatcagaattaagaataaatttttactttttactttcaaaattaccagaaaaacctccaaattaatacaggtgttttttcttatccaacctagaatatcacatttgagatttaacccctttggtgtcaatctggctttgttttgggtttatgtactgaaaaatactattttgtacataatgattctttgaatatacttaacaatccctactaaattataatgagtagaggcagtgctagaacctattttgatattttgtgccaaagtccgtgactcttaaaattaaatagcttcagctcacaaaattttcagttcttatatctttattccacaaacctccatcatcctcctactgtaataatagaggaaaaggcagtagaaaacatgcagtagaaaagccacttaggtgctctttctcagacaagatcctgccagaacttggagagaaagggcatgtgccatagaggttgggccctgaaggctgtaatataccgtaactctgggactgaagtgtgtctgagagaatctcaccacatatagcctccacaagcgtgaccaaattgagctttggggttaacacaagttagaaggtagcagtgattcacccaggcttaggagcacttgaattgggctgaacttaaggaggcagagttataaaagcatgtgacagctcctgtagcggcagcagggaacagccaccgaggctttagagtgcctacatgcattctctctttaccaccctaaaattatccagattattttccattgaaataataaattctactcccctgtgtgtgcatgtgcaacttgcagcattctgatcggtatttcatttcgtcagcctaaagggcaaggtaactggtttgtcaaagaggctataaatatgtcatatttaacattttcaacaacaaaaagatatttattgagcacttactggattctatgtgttaaaaatgtgattcattaatgtagaagttggtagcatattttatgctattcataagaaaatacagatctttcaatataaaaaatgggcaactataaggagttaataaagatgtagtcatactgaatgctttacatttttcactatgagtcattcatatattttctactgcttgaatattccatgtcttaaatctaaataagtggccctctcgggatctagaatgactttttaaaacataaaaacaattttattcctaccctaacaacccacttgaacaattttgagttggctgcagtagcaaatgaagatcagtacagtgcattataaagggacacaaaagtgctgggaaacagagcctgagatagagcctcctttcttatcactataaaattctggtcaaataagatactcagcatccttcagctgtagaaaagagataatcattctaccttttcagggttcttgcagatattgaatgagataatatttaaggccataatttggaaaatacaatgtgcttatacaaatgttagatgttattatgtgcttcttttggatgcctatatatactcaagagactatatagaagaaatgaaaataaaatgaaatttccaattcattaaggcagtgcatagtggctgctttaatgtctactaaaattagatctctaattatacagattaattctccatgatgatcaaatgaactaggaatttttatcatgaatgtattgcaataaagttatactaagaaaaatgtaaccaaccacatcattaaaacagaaagaattcagcaaattgcctggtctctggagggatagacattctcttttcttttaatttagactcattcaatgtttctaagagaaattttctggccaatgcaaatctggaagactgggaacggccttttttaacagtgcaagtactatcatatcctataaaaacacaagtttttaaaaaattgtcatattttgccaatctttccccactctggagctgtcttttttttttttttttaaagtcaagcacaatgtattaaatccaaagtgtgaaaggaaaatcagtttattgttaaatttgataaaactttgatagtgacaggcaacattaaatatatttaatcatccctaaagcatgagttgaattttctggtgctttgttgagagtttttacaaggaatctgttcaattaagaaatatgattactgcttagtaacataaaaaatacttatctgaaatactgagggcacaattagtgtttggaactggatatttgcatacctacctgagaggcatgggaaatctctgtgtctttcttctgtactggaggttttccatctgcagtcatttcaatcatacaaacaactccagggctgccaacaggcgttgtgtagctaaacgtaaaacagaagaggccattatgatatgtgtttttggcaagaaaggagtaacttcacacatggatagtaagtacttcttcattgagagaggtactttctggatcacaacaatcctgaaatatggacccagccaagtgtggacattttcaagtagataaaagatgtatttcttttctaacactgcgttttattttccttctctcctactgactttaaaattggacatggaatgctttcagaaagttaaacctcccacaaaataaaaagagcttcatgtgtataagtagatattgacaaattttaagtgctaactgtggttgacatatggtctccctcatgtaggagattgttggaccagtaacatcaatgttaaatgatgctaaactccctaggtagaatttcccctccctggcctacagggaaattgaaatggaataagaaatgaaaggctgcatacccctgagcagagagattacactgtgatacagttatcagaactcagaaagcatgccgctaatgtatcggctggtactgtatctcagagataaaagcataaggttaagggagtttgtagaatgaatagcaaaaatggtgaatacacaactgaaaatttatcagagtttatagaatgatgcaatcatatgaaaaggtacatatactaaggtacttggcatattttttaagcagcttatttagagttttaaagaaaattcaaacaatattaccctggcacctgccatattgtatcaacagtaacttgcactgttataaagtttatttcgtagggacaatacaaatatgttcgctgatattaacagtggctgtttctgcatactgagagtgtgggtgatttcatttctcatttttgcttatttgtattttttaaattttggacaacgatcagacttattttttattttttatttcgatcagaccttcttgtttgcctgggactgaggagtttcccaagacatgggacttttttttttttttttttttttttttttttttttttttttttagacagagtctcgctctgtcgcccaggctggagtgcagtggcgcgatctcggctcacggcaagctctgcctcccgggttcatgccattctcctgtctcagcctcccgagtagctgggactacaggcgcccgccaccacgccaggctaatttttttttgtatttttagtagagatggaaaccagtgtgagccaggatggtctcgatctcctgacctcgtgatccatcccccctcccaacctcggcctcccaaagtgctaggattacaggcgtgagccaccgagcccggcaggacttttagttttaaaaccagagaagttcctggaagacctggagaagttggtcattttatttttaaaacaaaaagtcaattttattaaacaattattggttaaataacttagtaatattttttcttaaaataactttgttgacttagttgaatgaaaaaacaaaaaacaaaccctaagcttcctctttcccttacccctcttaaaggcgcaactgtgggctggttccttctccttgcctactaggtaataagaatctgatatgatccttccagtaaattattccacggctgttttggcttccactttagcttaccaaggtcatttctaattctgatcaggtcactgttaaaaattcttgaattctggccaggcgcggtggctcaggcctgtaatgccagcactttgggaggccacccttaggtgctctttctcagacaagatcctgccaaattgtgtcataagaaacaaaaaaaactctataaacaaatgagatattatgtcacataaatcatttgaggaaaagcctaagagcatatcccttatgcctctcaagtattgctgaggccagcctagtctaatgatttaaagacttaaggatcatattctgagataatccgttgactggctgagtgatcttaggcaaaccacttaacctttcttccctgaagtgtgattatgtacagaagggagataatcattctaagctcataaatggttagtgagaatcacattatttaatgtacataaatcattcagtgctaatattaaaatccaagttaaagcaattatttgctgactagacagggatctctaaggagatttttgtaaaaataaattacacagtcaagttgaattgttcatccacttctactaatattgctcataatggaattcaaaatcaaatactcaagttgcgttattttaaaaactgaaactcaatgcaaccgactttttttttcagtgtccttaacatttttgcactttagatttataatttttaggtatgcttagcaatattggtggaaacattctgatttggaaaagacaatttatttgtagatttttagaagacctgcccaaatggaagttcaggttatctaaaacaaatgaaaaggctgcaaaaaggtaaaaaaagaagagttcattgcttaattaattaaatcaagtaatttaaataattcatccagctcttaaacaagagttatagaataatagtaacacagaaagatatttgcgtgaaatagaaaaagggatacatgtaatttacattacataatataattttaataaaaatatgcataggataataccagagctacttttactaatatcaacagtggctatctctgtatcctggtgatatgggaggcaggcagggaagtgctgggtagagaagggcagggtccctggcaagggctccaccctttggcctgtgcctgagaaactaaatgagaataggcactcatgttttcatgcacaaatgttgcattttccaagaccactctggctcaccatgtcccctatcctatgcccatataaacctgagacattagcaggcacacacagaatcagctgattgtcgacaccagcagactagcagaccagccacggtggaacaatgtagcagagaaagagagaataggagggatgtctggatgccaaggggagtttggctgggggctgtcagagaagagtccagcccctgggtggcccaactccaggggaagaccatcttcccactccatcccctctttcagctcccatccgtcttgctgagagccacctccaccactcaataaaaccttgcactcttcctttgagcctgtgtatgatctgattcttctgggacactgggcaagagctcaggatacagaaggctgtcacactggccccctgcccttgcagtaaagcagagggcccactgagctgattaacacacaagccatccacagatagcaaagctaaaggagcacactgtaacacatgcccacttgggtttcgggagtcacagactcccacccctagatgctaccgcagggccaagagcccaaagcactcaccctagcctctgtacctgcccatctgcatgctacttctaggggtttgagctgcagggtgaccaaacaggggaggcacatccctgtcacatgtcctgtgaggggaatctgggaactttcctgcttcagtgggaatgaagatgattttgtgtgtgtgtatatagagatagggtcccactatgttgcccaggcgggtcttgaactcctgggcttaagtgatcctcctgcctttccctcccaaagagctgggattataggcatgagcctctgcgcctggcctgaggatgatttttaaattgtgtcttttgcttatttgtattttctaaattttggacactgaacatatgttttttaatcttatctcttaagacaaaaattcagctttcattaaaaaacaagaattaaagaattttccaatatttttctgttgtttcctggattccatgccttcctttcaggttcacctatatacataatagccaagatttggaagtaacctaagtgttcatcaatagatgaatggataaagaaaatgtggtagatatacacaatggagtactgttcagccataaaatagaatgagatcctgtcatttgcaacaacatggatggaactggaggtcattatgttaagtaaaataaaccaggcatagaaagacaaactttctcacttgtttgtgggagctaaaatttaaaacaactgaactcatgaagatagatagaatggttaccagaggctgagaagtgtagtaggggtctggggggttggaacgattgttactgggtacaaaaatatagttagaatgaataagatctactatttgatagcacaatagggtgactatagtcaataacaacttaattgtatgctttaaaataaataatatgattggattaatttgtaacacaaaggatacatgcttatgttgatggataccccatttaaactgatgtgatttacacattgtgtatctgtgtcaaaacatcccatataccccataaatatagacatccactatggacccacaaaacttaaaaattaaaaaaaaattcctcaaactttggaaaatttttacctgaatcatcttgaatattgctttttggtattctctgaatgatatggtttggctgtgtttccacacaaatcccatcttgaattgtagttcccataatccccacatgtcatgggaggaacccagtaggaggtaattgaatcatggaggtggttacctccatgctgttcttgtgatagtgagtcagttctcatgagatctgatagtttataaagggcttttccccctctttgctcttcacttctccttcctgccatcacatgaagaaggacatgtttgcttccccttctgccataattgtaaatttcctgaggcctccccagccatgccgaactgtgagtcaattaaacctctttcctctataaattagacagtctgggacagtcctttatagcagcatgagaatggactaatacacagaacactgaaatctctacttgtagaacttatgttagacattttttggaagcctgttaagcagtcctctaaatttcttaatctcgcttttactcttaaaaaaatcttcccttatttttttctgtctgacattcttcttaggtatcatttttttcttcaactgtttttagactagagtttatcctatctactgagttttaaatgtctatgaatttttttattctcaaggttttgaatatatttcttttttgtgttttatttctgcctgttatgcttttataacttttccccatattttaactaatattttaatatactttcttataaaatgttatttttattggaaaatattggaattcagtttccactctttaaataaggagcaataagtattatcaaagtttgaatcactttttttttttaacttttattttaggttcaggggtacctgttgcagtttgttatataagtaaattgtgtgtcatgatgtatagattatttcatcacccaggtagtaagcatagtactgttaggtagtctttttgactgtcatcatcctcccaccctccaccctcaagtaggctccagtgtccgttgttgccttctttgtgttccctttgagctaagcacttaatatttacctcccacttgtaaacgagattgtgtggtatttggttttctgatcctgcattagttcacttaggataatggcctccaactccatccattttgctgcaaaagacatgatctccttttttatggttgtgtagtattccatggtatctatttaccacattttctttatccagtctaccactgatatgcatttaggttgattccatgcctttcctattgtgaatagtgctgtgatgaacatatgggtgcatatgtctttttggcagaacaatctatatgcctttggggatgtatccaataatgcgattactgggtcgaatggtaattctgttttaagttctttgggaaattgccaaacttctttccacaatggctgaactaacttacattccctgcagcagtgtataagagttcctgtttctccacaaccttgccagcatctgtaattttttgactttttaataatagccattctgactagtgtgagatggtatctccttgtggttttgatttgcatttctataataattagtgatgttgaactttgttttatatgctttcggccacaagtatgtcttcttttgaaaagtgtctgttaagttctgttaagttctttgcccactttttagtgaggttttttgttttttgcttgttaacttaagttccttactgaatctgtatattagatctttgtcagatgcatagtttgaaatattttcttctatcttacaggttgtctgtttactctgttgctagtttcctttgctttgcagaagctctttagtttaattaggtcttatttgtcaagttttgtttcggatgctattgcttttggtgtctttgtcatgaaatctttgccagggcctatatttagaatggtatttcctacattatcttccagagtttttatagttttgggttttacatttaagtctttaatccatcgtgagttgacttttatacatagtgtaagaaagggctgtagtttcaatcttctgcatatggctagccaggtatccctgcaccatttattgaatagggagtcctttcccattgctttttttgttaactttattgaagatcagatagttgtaggtgtatggcattacttctgggctctctattctgttccattggtctttgtgtctgtttttttgtacaagtaccatgctgttttggttactctaggcttgtagtatagtttgaagttgggtaacataaaacttccagctttgcactttttgctttggattgccgtggttatcctggctctttatcggttccatatgaattttaaaatagttttttctaattctgtgaagaatgtcatttgtagtttgatagaaatagaattgaatctgtaaattgctttgggcagtatggccatattagcaatattgattcttcttaatcatgagcattggtatgatttaccatttgtttgggtcatctccaattcctttcagcagtgtttgtaattctccttgtagggatcttttacctcactggttagctgtattcttagatattactctctctgtgggtcttgtgaataggattgcattattgatttggctttcagcttggatgtttttggtgtatagaaatgctactgatttttttatgtggattttttttatcctgaaactgctgaaattgtttatcagttctagaagcagagactcctaggagcagatattttgggcagagactatggtgtgttctaggtatagaatcaattgtctgcagagagagagagtttgacttcctcttttcttacttggatgacttttatttcttactcttgcctgattgctctggctaagacttccagtactatgttggatgaaagtggtaagagtggacatccttttcttgttctagttctcaaggggaatgcttccatctggtgcctattcagtatgatgttggctgtggatttgttatcaatggctcttattattttgaagtatgtttcttcaatgcctaaatgcctagtttattgagggtttttgacatgaaatgatgttgaattttatcgaaagccttttctgcatctattgagataatcacgtggtttttgtctttagttctatatgataaatcccatttattgatttgcatatgtttatgcaaatatttcatcccaaggatagagcctacttggtcatggtggataagctttgtgatgtgctgctggatttggtttgcccatattttgctgagaatttttgcattgatgttcatcgaagatattggcctgaagttttctgtttttgttgctgtgtctctgctgggttttgatatcaggatgatgcttaactcatagaatgaattaaggaggagtccctcatcctcaactttttggaatagtttcagtaggaacagtaccagctcttatttatatttctgatataatttgtctgtgaatctatttagtactgggctatttctggttgttaggctttctattactgattcaactttgaaacacattattggtctgttcaaggattcaattttttcttggtccaatcttgtgagatatgtgtatccaggaatttattcatttcttctaggttttctagtttgtgtgcatagtggtgtttgaagtagtctctgaggttttttgtttttctgtggggttggtggtaatgtcccctttgttatctctgattgtgtttgagtctttttttttttaatttcaattagcctacctagcagtctgtcaatcttatttattcttttaaaaaagaaacacataggttttttgatcttttgtgtgtttttttacatctcaatttccttcagttcagttctgattttgattatttcttgtcttctgctagctttgtggttggtttgctcttatttctccagttcctctagatgtggtgttaagttgttaatttgagatctaactttttgatatgggcatttagcactataactttccctcttatcactgctttagctgtgccccaggaattcttgtatgttgtatctttattcatattattttcaaagaatttattgatttctgccttaatttcattgtttacccaaaagtcattcaggatcaggttgtttaatttccatgtgattgtatgattttcatcatttttcttagcattgatttctatttttattgcactgtggtctaatagtacggttggtatggttttggttgtttaaatttgctgaggattgttttatggccaattttgtcatttattttagagcaggcacaacacacagatgagaagaatgcatattctgttgtttttgagtggagatatctgttaggtccatttggtcaagtgtcaaattcaggtcctgaatatctttgtcagttttctgcttcagtgatctgtctaatactctcagtggggtgtttaaatctcccactattgttgtatggttatctaaaattcttcataggtctctaagaacttgcttgatgaatctgggtcctgtgataggtgcatatatatttagaatgattaggtctttttttcgaattgaaccctttaccattatgtaataagtttatttatcttttttgatcattattggcttgaagtctgttttgtctgaaattagaatagctacccctgctgttttccattttctgtttgcttagtagatttttccctctctcttgactttaagcttatgggtgtccttgcatatgaggtggttctcttgaatatttgaatcttgtttctttatccaacttgctactgtatgccctttaattgaggcatttagcctgtttacattcaagattaattttgacatgtgcagatttgatcctgtcatcatgttgttagttgattatcatgcagacttgattgtgtggttgctttatggtgtcaatggtctatgtgcttaattgtgtttttgtagtggctagtagtagtctttcctttccatatttagcacttccttaaggatttcttgcaatgcatgtctggtggtaatgaattctcttagcatttgcttgtctgaaaaggatcttatttcttctttgcttttaaacttagtttaactgagtgtgaaattcatggttggaagttattttctttaagaatggtgaatataggcccccaatctcttcttgcttttagggtttctgctgaaaggtctgctgttagcctgatggggttccctttgtaggtgacctgccccttctctctagctgcctttaacacacttttaatgtatttcaaccttggagaatctgacgactatgtgttttgagcatggtcatcttgtatagtatctaacaggtgttctctgcatttcctgaatttgaatgttggcctctctagtgaggttgaggaaattttcatgaatgataccctgaaatgttttccatgttgcttgctttctctcctgctctttcagggatgccaatgagttgtagatttggtctttacctaatctcatttcttggaggtttattcatttattcattttttattcatttttctttatttttgtctgactgagttattttgaagaactggtcttcgagctctgagattctttcctccgcttggtcaattctgctgttaatttgtgttaggaaattctcgatttttttttttttttggagacggagtctcactctgtcacccaggctggagtgcagtggcgtgatctcggctcactgcaagctccgccccccaggttcatgccattctcctgcctcagcctcccgagtagttgggactacaggcacccaccaccacgcaaggctaatttttttgtattttcagtagagatggggtttcaccgggttagccaggatggtctcaatctcttgacctcgtgatctgcccacctcggcctccgaaagtgctgggattacaagcgcgagccacttctcccggccagcttggttctttcttaaaatgaccatttcatctttcatctcctgtatctttttattgtactccttagattctttagattttttgactttgttctgaatcttgatgatctttgttcctatccgtattctgaattcaattttgtcatttcagccatttaggcctgattaagtaccattgctggaaaaccagttcagtttttggaggtaaaaaggcactctggttttttgagttgccagagttcttgcgcttgttctttctcatctatatgggttgatattctttcagtctttgaagttgctatcctttggatgtgtttttggtttgtttgtttgtttttgcttttatcttctttgatttccttgggggtttgattgtggtacaaagtgggttcagttaactggcttcatttctggaaggttttagggggccagtgctcagctcagcactcctgggctgtgtgctctaactctggggggtggggctggtaccagactcctggctttttctctctggccccttgaggttatgaacctgctgtgctggcagggctgagatatttccagtccgctggccagaacgctccggtgaaggggagctggccaaagcactgcgtcggggtggcagcagcaggatctgtgctcagttgcacatgcctgcaccgtggcagagtactggcgagactggggatgcggtgctcctgctctgacagtggtggtggtgtggcaggggcagggtgttggcaggtgcagggcttccagcctccatgtgtgcatttgcactggtggcattggctgtgtgtgtgtttggttgggggggggggtggtggtgtggagagaagggggacagggctgtggcctgtaatttctctttttaaatagtaaaattattccttcatttatgctttctagtgttttaaaaatactttagagttttttcaggccctttcataaaaattgtcttatctagaatgattcctgttccattgttggttttcttggttccttttccagtatctttatgggttctgatattgtactgtgcaggcccattttgaatgggaggtatgtttctttttctctctttttgtgtactcccattcttcatgtcctgtgttcttctgctgtgcccaaccctacctgctgaatgagaaacgtacctgatcttttgacactgaaaccggaatcttcgctaaaaggtatttggtagttctgtcctacaatgatactggaaatattcacaggtccattcacagagctgacagactgcttggcataattcaggtcatgatactttgattgcattctgttctcttcctgggctggcagcttgctaaaagtcagaattccagatggcagcctttctctttttctgagtatatatatatgaatatatttatattcccttatatattttatttatctttataaacctatatctatatcagatctttcacaaatctttttgagcaaatagttttagttccttttaccttacaggagataagcttttctatttctagatttatatcttagcaagtatgtactcttaccttctttgctgctttgcatatttgtctatttcttgtctaaagatatgtttgtcttgtttttgaacttgccttcatgttttcagttttcttcctttattttttctatcactgctagcacataaaagtgtgaagttacagagtcatcttgacccgaaatcccccattttctttttttattatgagaaaacacaaaaatgaaagatcaaactaagttcttgcctttgaagggacatgtacatagaaaattgtctttaatttgtgagaggtaggatgaaaaaaaagttaaccaagccatttggaagtgccttcatgattttgcagtctttaaatttggaaggactaatttctttggcttttctatctcaggtttgttttgtgctataggcatttgaatgcatctgtctcatatttttttttccagtggtatatttcaaaagcacataagtaaagtagtttgttttttttttttccagagagaaatagaacgtatggatttttttttctttttaaggtacctatgttttatttgtcaaatctggtggttatatgagttattggcatcaaaccataatgaaattaaatgctttaaagcagtatctcattgctgggctgaaggtgtgtgaaacctagttcatgtataattgcagcatgaagccatgatgtaacagtaagaaaactgaacagcaccaactgcttctagggaatactgcaaaattgatgatgatactgaatgctttcacaggtgcaaaacataaatgttcttttctcttgtctttaggcttggcaattacccaacaataacactggcttgtttattttagattttgggcatgcattaacattgctaataagtttttcctctcctctcctctcctctcctctcctctcctctcctctcctcttgtcccctcaccccctcccctcctttcctttctttcctttcattttcttagttaaatgttaaaaatgaatgcaaaaatgtctatcttccagattttaattatttccagattaataacttgaatttctgaccaataatagtttgccttaatgtatactgaataaatgtaagtctattgctctgaagtgaatagtagcatatgaattaagcattaactcagaacttttatttaaaagaatcttcttaggctacatttaagatagaaagagggtaagttcagttgttagcaactatgatctccatgctcagccagaagttttagctgactagtgacagctctacatgagaatagctgggatgggagactcagagcccagagactcagtatcagcagatggcagtaaaggtacatggcagagatggaggcactgaaaggaatctgatccctacaaagactaacttaagatctaattgatagcattattgttttacctccctgtttgtaacagggaaacatggaaaatatatttcaaaaattagacattaggcagtatgggtgaaactgtccagagacatacagctttccttaccacttcacttatccagtgtgattgtcatggctgggtaagcaaatttaaggaaatgctgtttcctaaaagtgggatggttttcatacagccctatcaacacagccatatttcttgacattgtctgtgcaactcagcacaaaataaatgttaaacagtataaaaaaaggatcacgcataaaagccacagtgtcaggacttttgtctagcaaaagcaatataaacacactgtttttaaaaagcatcctgtttttgcttagatcgtcacagagttggccagcctgacagtacaaagagctttgtataaaaagcgctccatgacctctaataagtgatttttctgagcacttcctgcctctggatgatagtcatgtggcggtcactagttttagattatattagttagacttctctctgacaaaacagcccaaatacactttataataaattacagagaaaaccaagccattttcctgtgatgtactgatattaaaaaaggatctgtgatgattcctgaggaccactgaagcagaaacttcacttactcccttgattaaacagagcagtcgtcaagggaacatacaaccagccatcacgagatactggagattttccaagaactgtgattttctttccgactacgctatccaattcacgtgcaatgggactcgcagcatattctctagatttcatggtctcctggtagcgcctctaaatgtgtaaatgcccagaattctcttgttttctttagccggtaaaagcattcatataatgacaattacaattacacaaatataaatttgcatccagaaagcttcctgttttttttgacctgacatccatttctaacctctctgaacatgttgatgatgagtgtcaatgggatgctggaggagcctggcactagctcgtgagagctaattttgcatatctttcccaaatgccacattcagtgaattcatattgttagcttgaaatataggccatggtaaaagtatttattccagggaaagtggcaaatgctacaaatcaccaccccaccctttttttttccctgagagatgattcttaaaaaccagtatgccactgagtttcttgaacatttcttagtagcatttaagtattcacttagaacaagggcattaggaaagctgaaaagctcaacttcactgttgccatttcgtttgagatttcagtaaaaaaaaaattctttttctttttggaatctattatttcacagttctagattgggctaattcactctgatggtgaatgtaagttctaagaatattaccctaaaacctacacatgttcagtttacaaatacgagatagtatttaattttattctccacttccagtacttattatgtactcaatttatttggtttttagtagttttaggggtgttcactcctctgagtaatcaattaaaactcaggacttaaaacattgatttctgatcctttcatctcaaacatttgaactcacacacacacatattttgaaagaaagaagtttttttttcaagttaaaagaccgtatggaaaaactcaattaggtaacaagcagatcactttaccaaaatttaaacaaaaagtaattcagatgatattggtaggtggagattcactcacattaggtggtaaatgaaaaggccatgtgtgtccctgccatttttttttttacaaagatatgttacagtgagggattctttttataaaattgccttaacattaagtatgtagtttttttgttttctaataatacttcagtttccaaatggttggtactatttgcagtacataattttcctgacaatgcattttactgagatttatgaagaaacagaaaatattttaatgttaagatatttatactgtattatgtttaatccagtgaagtcagtaataatcctagtttcacatttgtattaaaaatatgaagagagagtagatgactagagatgtaaaacatttaaatttctgaagcactctctgagccaaagttgtaaatatacttatcactctaagtgtaaaaaggctacagtgtgatccattgggtgagtcttggatcaatacctctttggtttctggtttctctaccagctagcacacagtctaaatatcctttggcttggcttatttagtctttttttattttttttttttttggtttctgaggttttaggtacaccacttccccttctaactgtcctttctataccctttgtcaaacatgactcccccatctttaaaatttcctatagggagagaagaacagttaaaaccttaccctaggcaaactttcaatttggagataaccaagacatgtaaacttttagaaattcaaccaatataaaaataggtagaactgatgaatatctgtaatctaggcttaatgattgaaagaagagttactagcccttctttaagtcaatttcttataaatagcttccacaagagcactttcaatttaaagattgagaaaaatttaattgaataagtaaccatgatgatgaaaaaaattgctttgttttgcactcttacaatagagataataattcctggagttgtttctgataaaaaacaattacactaaacattttggaatttttccagaagatgatacataaaatttgagtagaaccaaaatccacatctcatataaagagaaaaatcactgatggttagagacaatggtttgaatgttttgtactgctttatataaatagcaaactaaatattgcaaggctcataggctcaagaccacaggcaaatttaataaactctaaaaatctataatctgtgttaattttatttataaagtctcaatccaataatgatttaaggtagctttaaatataaggtaaaatagcaaaaaatagaagaaaaaaagaaaaaattggtaacacaataaaggataaaagaaattagttttcagggaaataatttaaaatacaaatgaaaatagatctattgattcaacagacaaatgatcgaatgcctattatataagaaatgtaggtgataggtgatggtgaggtgaaggtgaataaaattgttgtaatctgaaggtcctcacagagggtaagaaggaaagacattgtcattctctgagaggtcagttttcactggaaccagaggaagcatagccagggcacctgcatcagcagcataggttagtgttaatgagggctgacaggtttgtgcaccagcttcaaggctgcattcaaatagagacagcaagtaatgccaggatgagtttacacatagaacacaagctgggacttcttggtttccaggcttatgaggcaaaaaggaaagtaaggaattctgagtgctgagctttgttgcttctaggaaacaaagaaacaaacaaaggaactatgttttctcccatttttggcttttttgctccttttctttagcaaattccatttcaccacctggtacctttgggctgctctgtcctgcctcctattaaaagcaatgcaaccaatcaggacagactggaataacatgtttcaaagtgacagagaccttcacaggggtatgtttttattattagcaatagcttcttataatcaaatactgtataatggaattatttactttatttaataaacatttatatagcatttattatagaccaggcattatctcaagtactttaaaatattacacagcagccaccctctgagataaatggaaacattcttcccatttataggtgaggaaattgaggcacctaggggttaagtaatttgctcaaggtcacaaagttcataaatcacagtgctgggttataaacctgtacgttgtagctccagaatctatgctattggctgctgtgtcatacctttttgattttttttttttttttttgagacagggtcttgctccgtcacccaggctggagtgcagctcactgtagcctcaatctcctgatcacatgcaatcctcctgcctcagactcccaagtagctgggactacaggcatacatcactatgcctggctaatttttgtattttctgtagggacagggtctcattatgctgccaaggctggcctcaaactactgtgctcaagctatctgcctatgttggcctcccacagtgctgggattacaggtgtgagccaccatgcttggcctctttttgatttctaatgagggtattgtacatttcttattcgtctcttgttagctaatctatctctgattagcagcaaatgactaattatttagcttaactgagacaggaaagcttttcaattcctttacttctgaaggtatccctgtctccaccactcactctgttctcttaagatggaggactcccttcttcctgtctcctttaatcataatctttccatcaattgcactccgcatgtccttggtcttttttcctctaattcctgtcctctgcttgaaccttcctaggctgctgtcatatccatcactaggactgaactcttatatgagtgcaaaggcaaggagggaaagctgaaagcaaaatctgttgagaccccacaaacactcctttctggaccttgttaatagcaagtaacaggaaggagagggaggcatactaccacaccctgtagtgttggtggcaggttcctggcagggtacctagaagagaattacagtgcctgacagggctgtgagagtggatttatttgggaacatctgtgatctacaattgtgggactctctgcatgctgggggtgggagatctgtgggtactgaagatgttcaagaagctgcattactacaatacgagatttcatttgtttccatggtctggtgaggtctcataaaaatcaggtaatgtcatattattccatagttgttggttttgtgtctgtttttctctctggccttctgttcctcaggttcctccctggtagcctcagctgtaagtacagtacctgatgcataatgcacacaatgcacatatgctgacctgaagccagtgtacttgggtgatgtgggaccaaacaggccagtggaactgtttcttagacaaaccatttttctttacctgctgtctgctctacccacagcccagtgacaattctatctgctctccctgtgtgaaaggttcatcctttagcacatctgctcattaatatgaagtggtgagaacagtcaatatgctcgtaatgatagacccaactctcaacctaactagctgtctatgttcgggcaatttacttaaacctctgggcaatttacttaaacctctctgagtttcctgatacataaaggaacttatacattttcattgaccttctaaacccttatattctctcatattgcccaatgttcgattattttgtataagaaataatatgttgggaaatcagagatccatgcagtagcatttctacctccattttatttataaccatgtcttatgtgtaaaccttggtgccaagtttattcctacttagtcctgagaaaagacgtggaatacacacttatacacacacacacatacacatatatatacgtatatgtatatataaatatgtaaattaaagctgaattcaggagtcaagatatatttgaaaaatatgctaccatgggatatttcatttgaaaacgtaaattaacacagtttcctttggaaagtagataaagaaatagttgtgacctagatatagtataaacctcagattggattcataatagcatacctcaggaaagtgatctcttttatatattcaggggttttttgttgttgttgttgtttggatgtttcttcttgctttctcatcaaatctaaactctttaaatatctgcattaagaatatgttttgacttgcacattgagtaagaataaactaatactcataggttttgcaattatacagccgaatagcaaaaaattttttgtggtgtctcaattgaaatttgattttggtaacatttttggttttcatatgctgatgtctagcatatggtagaaaaatggccccctcaaaggtatttctatatcctaattcttagaatctgtaaatgttactttatttggaaaagggtctttgcaaatgcgattaagttaaagttttttgagatgaagagatcatcctgggttatttgggagtgtcctgaatgtcatcacaagtgttttttttttttttttttttttttttttttgtcgagacagagtctcactctgttgcccaggctggagtgcaatggcacagtctcagctcactgcaacctctgcttcctgggttcaagcaagtctcctgcctcagcctcctgagtagctgggactacaggcgcatgccatcatgcctggttaatttttatatttttagtagagacggggtttcgccatgttggccagactggtcttgaactcctgacctcaagtgatccacccaccttggcctcccaaagtgctgggattacaggtgtgagccaccatgcccggctcacaaatgttcttataagagagaatcagagagagtgaatgattggagactcaggggaaacggtaatgtgaagatagcaacaaaacctggaatgatgcaaccacaagccaaggaacaccaaggaatgccctcagttggcagacgctggaagaggcagtaatggattttccctcaggacttctggagagagtgcagcctgcctacataacatcttgatttcagacttctggtttccagagctgtgagataataaatttctgttgttttaggccacatagtttgtgtccatttcttatagtagctacaagaaacaaataaagggcaagatattttctttctttcctttttatttttttaaacggagtctcgctctgtctcccaggctggagttgagtggcgtgatctcagcttgctacaacccctgtctcctggattcaagtgattctcctgccttagcctctcgagtagctgggactacaggcacaggccaccacgcccagctaatttttgcatttttagtggagacggggtttcaccatattggccaggctggtctcgaactcctgaccttgtgatctgcccgcctcggcctctcaaagtgctgggattacaggcatgagccaccacgctcagcctcgttctttcttttttaaatgaagtaatgttaaaaataagaagcaaaggtttgaatactaacagtgttcaatagttgaatttggagatgaatgagattagaatgtgtatatataagtatatatatatatatgtatatataagtatatatatatatatatacttacatatataagtgtatataagtggacactctattaagatatacagataatctgaatgctttgggtttaacaaatacctcagctgtgcagaggctatgaaatagatcagaaagcaatagtgtatctcctcttaacattttcgcagagtaatcagtgacaagaaacactgataaaatcaacataactctattacaaacatctaaactctagtatctacatttattgctattcaaatagagtaataacagttaggtagaaggaatgaattcttgtttgatagcagagtagggtgactatagttaacaacaatgaattgcatttttcaaaatagctagactagaggaactgaaatgcagccaacacacagaaatgacaaatactatggtggtgaataccctaagtatcctgacttgatttttacacatacaatgcatgtacaaaattttacatgtacctataaatatgtataaatgtaatatatcataaaaccttttcctttaaaaatgttgatgaaatgttttcatccaaattacataaacatacacatttgtttacttaactaaaaaaacaccaaaccaagtcacgaaaacattgtaacagacttctgtaaagtataaggtagattatgttcactattattcctgataccaagggcttcatggggtgcaaatagatgtggtagtaacaggaaaagaaatggtaaaaattatccaacaatttccattcctttcacatgtgatattttagactctaaaacatccccacttgattattttgggtgatttttggggatggattatatttactacttatgataaaaagaaatattgatattccagagttttaccaactgtattttattgatagacagtcaatgcagcaaacttttccatggtgggttatgttaactttgaatcatctgatatgctagataatgtcctaatcttggggagaatattataaatgttaaaataatgtattattaataccaaagaaagatctcaatagtggtgccatagacagatggagaaaccctatttttgtattaaaggatttcctgggaatccaagaattatgatgactacagaagatcctctacattatattgtgaaaatattaggggaagaaccaagaaatgtccacaaatgaggaaaccttatcattattactatagtcttcctaaaaatcttttctacccaaaagcattttcttaattgagaaatggttctcactttgtctatttctcatccaaagactaaaattccttgcagtgatagttttcaagggaaaaaaaaaaagccttttctttattgcttagtagctttgctgctgtttttgcaaaagccattctttttctttccatcacaattaccctttattgagcattttcttaagccaggtactggattcaacgccacacatgatctatctcaaggcagtagtgctagactggggggagtttgcttcctggggtacatttgacaatgcctagatacatgtttctttatcacaacagggaatgaggatgctactgacatctagtaggcagaggtcagggatgctggcaaacttcctacaatgcacaggactgcctggaataataaagaaggatacagccctaaattgtcaacaatgcacatcttgagaaaaatgttccaaagtaaaagctgagtgattgttcatcagctaaataaatggtaagtcttgttataagtaggaggaacaatgggacatggtttttctacaatggatgaattgaaaagattatcatatgttgtaacatttttctatttgtagggaatacattcactacattcacatggtccaagattcaaaagatactcaagaagttgtagtccaagtctccctcccaccccatccctgtttcacccaagttccctccctggaggaaactgttagtaatctcttatttagttacctaaaagttctctaggcctctgtaagaaattatatacatgcacagaaacatactatacatattctttgcattgtgcttttgttacaattcattttggagattgttttctatcatgatacaaagcgtttccccattatttctttttaagatagcaaagtatttcattgtaggttgtatgcaagttttctattttatgtaaccattcccctctctatggatatttagattatttcctttttttctgttacagacactgatcaatgaatatctttatctgtgagtttaagtcctacaaacagaattgccaaataagcacatttgtgcttgtaatttttatcagatgttgtccaaattaccctccattctccattaaattgaatatgtttccattcacactggcaatacatatataaaggagtttggataactttataattttaaaagtttttctcattcttttcatcaaaacctgagaataaataagaggtggacacacaatataatattttctgtctaaaatgttctcagcactcaggtatccagaatctattcatgggagatattttttttctaatctgtttttagtgcgctaaaatatataacataaactttaccattttcacaattattgtgtacaattcattggcattaagtacttttataatgttatgcaaatatcattattggctatttctaaattatttcatcacaacaaaaagaaactaatctgtgaaagctgaaagaatttggtcattcttgtcatacccagctaaaacagagttcagagccagaaagaaaaaagcacccagggcacataacatttcttcaagaatgttattctctgcaagcgtggctgctgaaactgcctgctccaacctgaaaccagttttattcaatatctactgaaacaggctgctgtgactctaagaatagttttacccacacccatcacttatttagagcttaccagctccccaaaactagtgccaatgaattttcctgaagaacaatacataacatttcttctttttataaaaccgccaaccttctctttgttctttagacatagcaaagaccaccctgtctgtgtgtatgccctgaaatgaaattcttgcttctcaaataaaacgttttatatttagagatttgtctttaattttttactcgacttcaacaaaccattatgcaataattccccattctgcccttctctagccactggtaacctttgattaatttctgtctctatgaatttgcccattccatatagtatatttcacataagtggaatcatataatacttgtctttttgtgtctggattattgcacttagcataaagttttcaagattaattcatgctgtagcaagtatcagaacttcatttcttcttaggtctgaatagcatttcattgtatgcatatagcttattttaaaatctatttctctgttgatcgatacttctccatttgggttgtgaacaattctgctatgaacattgacatataagtatctgtttgaatccctgttttcaattcttttgcatatgcatctggggtggaattgtgggggtcatatagtaaatacgtgtttaacttttagagcaaccattaaactgtttctaccatttgtagtgtaccattttacgctgtacatggtaaaatgtacacttatattttacactttacattgtacggtgtaaaatggcatggtctcgatttttccacagcttcaccaacacttgttatttttctttttttaaataaaaattatggccattgtagtagatgtgaagtggtattgagaggcaacagtgtgcgccctcactagctctcggcacctcctttgcctgggctcccactttggcggcacttggggaggccttcagcctgccgctgcactgtgggagcccctttctgggcaggccaaggccagagccggctccctcagcttgcgaggaggtgtggagggacaggcgcgggtgggaactggggctgtgccgcggtgtttgcgggccagcgcgagttccaggtgggcgtgggctcagtgggccccgcactcgtagtggccggccggccccgccagcccagggcaccgaggggcttagcacctgggccagcagctgctgtgctcaatttctcaccgggccttggctgccttcccgcggggcagggctcaggacatgcagctcgccatgcctgagcctccccctctctctgtgggctcctgtgctgcccgagcctccccgatgagtgccaccccctgctccacagcgcccagtcccatcgaccacccaagggctgaggagtgcaggcgcagggcgcaggactggcaggcagctccacctgcagccctggtgcgggatccactgggtgaagccagcggggctcctgagtctggtggggacttgcagaacctttatgtctagctaagggattgtaaatgcaccaatcagcaccctgtgtctagctcagggtttgtgaatgcaccaattgacactatgtatctagctactctggtggggacttggagaacatttgtgtggtgacactctgtatctagctaatctggtggggacttggagaacatctgtgtctagctcagggattgtaaacgcaccaatcagcaccctgtcaaaacagaccactcggctctaccaatcagcaggatgtgggtggggccagataagggaataaaagcaggcttcccgagcaagcagtggcaacctgtttgggtccccttccacactgtggaagctttgttctttcactctttgcaatgaatcttgctgctcctcactctttgggtccacactgcctttatgagctgtaacactcactgtgaaggtctgcagcttcacccctgaagctagcgagaccacgaactcaccgggaggaatgaacaactccagacgtgccaccttaagagctgtaacactcactgcaaaggtccgcagcttcactcctgcgccagcgagatcacgaacccaccagaaggaagaaactccaaacacatccgaacatcagaaggaacaaactcccgacgcgccaccctaagagttgtaacactcaccgtgagggtctgcggcttcattcttgaagtcagtgagaccaagaacccaccaattctggacacattttggcgaccacgaagggactttcgcctatcgcccagtggtatgacaatcaccatgtggtgagaccatcgcctattgccgagcagtgagacaattgcctatcaccaagcagtgagtaccatcagacgcctttcacttgctattctgtcctatctttccttagaattcgggggctaaataaccgggcacctgtcagccagttaaaagcaactagtgcggctgccggactaaagacacgggtgccaggctttctgggaaagggctctctaacaacccccaactctttggagttgggaccgttggtttgcctagaaccagcttccacttttcctgtacttctgggctgagctgaggatcgacagagaggaaagctgtgcagctccgaggtcccaacaacaagttggttgaccctgcagccatgagcggaactctcaaatgcatgtcgcccaagcaagactcacccatctatcctatctatcctgacccttgccccttgggtcctaatgcctaccagacaaacttcctctcgcctctcttctctgaggttagtcctccttctaaaaattgctacctgtctctggtgcttttctagtttctcctatgagaatgatttctagtataaactccaggactctgttaccttctttaggcacctgggctcaccaatcagaaagacataatttttgcccaaagctccgtcatagtggggactacctggaatttaggatccctcctcagactaacaggcccaacaaaagctgttcccgaagctaggatatggggagcctcagaaagtgtatccttcctattcatataagtgaagacaaaaggtgtcactcttccaaccctggagatcccttccctccctcagggtatggccctccacttcatttttggggcataacatctttataggaaaggggtaaagtcccagtactaacaggagaatgcttaggactctaacaggttttcgagaatgcatcagtaagggccaataaatccgatttttcttggtcagtcctccttgtggtctaggggacaggcaagggtgcaggttttttagaatgcctcagtagggactactaaatccaaccttccttggtcctccatgtggtccgggaggaaaactagtgtttctgctgctgcgtcagtgagcgcaactattctgatcagtagggtcagggaccgttgtgggttctggggcaggggttgtttctgctgctgcatcagtgagcacaactattccgatcagcagggtccagggactgttatgggttcttgggcaggggttgtttctgctgctgtgttggtgagtgcaactattccgatcagcagggtccagggtccgttgtgggttcttgggcagggggaagaaacaaaacaaaccaaaaccatgggcggttttgtctttcagatgggaaacactcaggcatcaacaggatcacccttgaaatgcatcctaagccattgggaccaatttgacctataaaccctgaaaaagaggcagctcattttgtttctgcactatgacttggccccaatattctctctctgatgggaaaaatggccacctgagggaagcacaaattacaatactatcctgcagcttgaccttttctgtaagtgggaaggcaaatggagtgaaataccttatgtccaagctttcttttcattgagggagaatacacaatatgcaaagcttgcaatttacattccacaggaggacctctcagcttacccccatatcctatcctcctatagctccccttcctattaatgataatcctcctctaatctcccctgcccagaaggaaataagcaaagaaatctccaaagtaccacaaaaccccctaggctatcggttatgtccccttcaagctgtagagggaggggaatttggcccaacccgggtacatgtccccttctccctctctgatttaaaacagatcaaggcagacctggggaagttttcagatgatcctgataggtacatagatgtcctacagggtctagggcaaacctttgacctcacttagagagatgtcacgctaccgttagatcaaacgctggcctttaatgaaaagaatgcggctttagctgcagcctgagagtttggagacacctggtatcttagtcgagtaaatgatagaatgacagccgaagaaagggacaaattccctaccagtcagcaagccatccccagtatggatccccactgggaccttgactcagatcatggggactggagtcataaacatctgttgacctgtgttctagaaggactaaggagaattagaaaaaagaccatgaattattcaataatgtccaccataactcagggaaaggaagaaaatccttctgccttcctcaagtggctatgagaggccttaagaaaatatactcccctgtcacctgaatcactccaaggtcaattgattctaaaggataagtttattacccaatcagccacagatatcaggaggaaactccaaaagcaagccctgggccctgaacaaaatctagaggcattactaaacctggcaacctcggtgttctataatagggaccaagaggaacaggcccgaaaggaaaagcaagatcagagaaagtccgcagccttagtcatggccctcagacaaacaaaccttggtggttcagagaagacagaaaatggagcaggccaatcacctggtagggcttgttatcagtgtggtttactaggacactttaaaaaagattgtccaatgagaaacaagctgccccccatctatgtccactgtgccgaggaaatcactggaaggtgcactgccccagaggacaaagtttccctgggacagaagcccccaaacagatgatccaacaacaggattgagggtgcctggggcaagcgccagctcatgtcatcaccctcactgagccccgggtatgtttaactattgagggccaggaaattgacttcctcctggacactggcacagccttctcattgttaatctcctgtcctggacgactgtcctcaaggtccattaccatctgaggaatcctgggacagcctgtaaccaggtatttctcccaccttctcagttgtaattgggagactttgctcttttcacatgcctttcttgttatgcctgaaagtcccacacccttattagggagggatatattagccaaggctggagctattgtctacatgaatatggggaacaagttacccatttgttgtcccctacttgaggagggaatcaatcctgaagtctgggcattggaaggacaatttggaagggcaaaaaatgcctgcccagtccaaatcaggttaaaagatcccaccacttttccttatcaaaggcaatatcctttaaggcctgaagctcataaaggattacagaatattgttaaacatttgaaagctcaaggcttagtaaggaaatgcagcagtccctgcaacaccccaattctaggagtacaaaaaccaaacggtcattggagagtagtgcaagatcttagactcattaatgaggcagtaattcctctatatccagttgtacccaacccctatatcctgctctctcaaataccagaggaagcagaatggttcatagttctggacctcaaggatgccttcttctatattcccctgcactctgagtcccagttcctctttgcttttgaggatcccacagaccacatgtcccaacttacgtggatggtcttgccccaagggtttagggatagccctcatctgtttggtcaggcactggcccaagatctaggccacttctcaattccaggcactctggtccttcaatatgtggatgatttacttctggctaccagttcagaagcctcgtgccagcaggctactctagatcttttgaactttctagctaatcaagggtacaaggtgtctaggtcaaaggcccagctttgcctacagcatgtcaaatatctaggcctaatcttagccagagggaccagggccctcagcaaggaacgaatacagcctatactggcttatcctcaccctaagacattaaaacagttgagggggttccttggaattactggcttttgtggactatggatccccagatacagcgagatagccaggcccctctatacactaatcaaggaaacacagagggcaaatactcatctagtagaatgggaaccagaggcagaaacagccttcaaaaccttaaggcaggccctagtacaagctccaggtttaagccttcccacaggacacaacttctctttatatgtcacagagagagccgggatagctctttgagtccttactcagacttgtgggacaaccccacagccagtggcatacctaagtaaggaaattgatgtagtagcaaaaggctggcctcactgtttaagggtagttgcagcagtggccatcttagtgtcagaggctattaaaataatacaaggaaaagatctcactgtctggactacttatgatgtaaatggcatactaggtgccaaaggaagtttatggctatcggacaaccgcctacttagataccaggtactcctccttgagggaccggtgtttcaaaaatgcacgtgtgtggccctcaaccctgacacttttctcccagaggatggggaaccaatcgagcatgactgccaacaaattatagtccagacttatgctgcccaagatgatctcttagaagtccccttaactaatcttgactttaacctatatactgatggaagttcatttgtggagaatgggatacgaagggcaggttatgccatagttagtgatgtcaccatacttgaaagtaagcctcttcccccagggaccagtgcccagttagcagaactagtggcacttacccgagccttagaactgggaaagggaaaaagaataaatgtgtatacagatagcaagtatgcttatctaatcctacatgcccatgctgcaatatggaaagagagggagttcctaacctctgggggagcccccattaaataccacaaggaaattatagagttattgcacacaatgcaaaaacacaaggaggtggcactcttacactgccaaagcaatcaaaatgggaagaagaggggagaacagcagcataagcagctggcagaggtagggaaagaccagcaagaaggaaagagggaaagacaaagagaaagagacagagagaggaagagacagagagacagaaagtcaaagagggagtcagaaacagagacaaagaaaaggagtcagaaggagggacagacacagaaagtcaaaaagagagttaaaaagagaggaagagacaaagaagaagtcgaagggagaaggagagagatggaagtagtaaagaaaaaacagtgtaccctactcctttaaaagccagggtaaatttctgtctacccagccaaggcatatttttcttaagtggaatgtcgacccatatctgcctctcagacagtttgcaagaaataacgaaatctattcttactttacaatcccaaatagactctttggcagcagtaactctccaaaactgccgaggactagacctcctcactgctgagaaagaaggactctgcaccttcttagggaaagagtgttgtttttacactaaccagtcggggatagtacgagatgccgcccggcgtttacaggaaaagccttctgaaatcagatgcctttcaaattcttataccaacctctggagttgggcaacatggcttctcccttttctaggtcccgtgtcagccatcttgttattacttgcctttggaccctgtatttttaacctgcttgtcaaatttgtttcctctagaattgaggccatcaagctacagatggtcttacaaatggaaccccaaatcagttcaactaacaacttctactgaggacccctggaccaacgcgctggcactttccctggcctagagacctcccctctggaggacactacaactgcagggccccttcatcgtccctatccagcaggaagtagctagagcggtcatcggccaaattcccaacagcagttggggtgtcctgtttagaggggggattgagaggtgacggcgtgtgccctcacttgctcttggcacctcctctgcctgggctcccactttggcagcacatggggagcttcagcccgctgatgcactgtgggagcccctttctggtctggccaaggccggagctggctccctcagcttgcggggaggtgtggagggagaagtgtgggcgggaaccggggctgcacatgctgtttgcaggccagcatgagttctgggtgggcatgggcttggccagctccgcactcagaggggctggccggcaccaccggccctgggcagtgaggggcttagcacctgggccagcagctgctgtgctcaatttctcgccaggccttagctgccttcccatggggcaggactgcggacatgcagcctgccatgcctgagccacacccccaacccccaccctccatgggctcctgtgcggcccaagcctccctgatcaggatcgccccctgcttcatggcacgcagtcccatcgaccacccaagggctgaggagtgcaggcgcagggcgcaggactggcaggcagctccacctgcggcccggtgcaagatccactgggtgaagccagcggggctcctgagtctggtggggacttgcagaacctttatgtctagctaagggattgtaaatgcaccaatcagcaccctgtgtctagctcagggtttgtgaatgctccaattgacactctgttatctagctactctggtggggacttggagaacttttgtgtggtgacacgtgtgtctagctaatctggtggggacgtggagaacatctgtgtctagctcagggattgtaaacgcaccaatcagcaccctgtcaaaacagaccactcggctctaccaatcagcaggatgtgggtggggccagataagggaataaaagcaggctgcctgagccagcagtggcaacctgctctggtccccttccacactgtggaagctttgttcttttactctttgcaatgaatcttgctgctgctctctctttgggtccacactgcctttatgagctttaacactcaccacgaaggtctgcagcttcacccctgaagccagcgagaccacgaactcaccgggaggaatgaacaactccagacgtgccaccttaagagctgtaacactcactgcaaaggtccgcagcttcactcctgaggcggcgagaccacgaacccaccagaaggaagaaactctgaacacatccgaacatcagaaggaataaactcccgacgcaccaccttaagagctgtaacactcaccgcgagggtccacggcttcattcttgaagtcagtgagaccaagaacccaccaattccggacacagtatcttacatggttttgatttgcttttccctaatgacaaatgattttgagcacttctttgtgtgcttattggccattaaagggaaaaactttttctatatttacaacatttctgacaccaaatgtgtgggttttctataccacgtgtctgtggacacaaactgagcgtcctacaatttaactcagttctgacactatctggagttagcacagaccctacgggttaagggctcaggcccacaagactaatccttgcttcagatgtcaatctgaagtaagtagtgggtctctagattacctatacatttgtctggcttggctacaaattgggggtacacacagcccacccttgattttaataatttgctattcagctcactgaactcaggaaaacacttttcttactaatactggattataaaggatactactcaagaatagccaaatagaagagaggcatgaggctatacagaactttcatgtcctttctagccatgccacccttctagcatctcaatttgttcacaaatccagacattctctgaactgcattgttttaacatttttatggaggttccattgcataattgagtaaatcattggccagtggtgattaactcactccccagccactctctcctctcttgaggagacttcaagagtcttagaagctcttttgtcaggaagaggggctaagaccaaacattgtaacagaagatgctcctatcactcaggaggttacaagaattttagaagctctgccaggagctagagacagaaaccacatttagatttcttattatgtaacagctgtctatatgtctactctgaagaaatgtctagtcaagtttttgctcatttttcattacattatttgtcttgttgttgtttctacttctcatacagtgagtcaaaacacttctcatataatttttcacctactcatcgtaagtctacttccgttagagaaaaaaggctccttttactctaataggcacatagctattaaatgtggttttctggtaaattctgaaaagactttttcaagagataaagatgaaagtgaaacatatcaaagttttattccctaaaatattttaagttaattcaagaaataattttcatctctgaacctgaaaaagagtactaataaataaatttctaagcacgcaatagtaactataataataaggttaattactgtctaaaataggtcagaagtcctgctgcaaatatttttaaataaattatgtaaacttggacataacaccttcattaattgtcaaaattttttatctatttaaatttacatttaaaatatttaacaggttaattatattcagatcagataggttgctacaaaaacaaatttaaaattattagaaaaattagaattattgttttctagaacttccccattcaaactagttatgttgataatgttgtgtatacatacattcaattgttgcaaagtaattctgacacaaatgagattactctctctctctctctctctatatatatatatataaaattgggagtggacttacattgttaaaatatacatataatctaaagaatttggccttaacaaatattcaggtgtggagtagctgagtagtatcttgaacatttttacagtatagtctaatttgtcaggagcactgatttaattaacataaattcaacaaaacaaagggaagtaaaaatggatctagattcctaatagattgttattggtcatgcctgtattgggtaatggtctgcaatagcagggcagtcaaattaaatggtaggccaaatccagggtccagtaagtgttagattaaaattaaaacaaacaaacaaaaataaagttgaagacagaatgattgaggggagcaataaaaagtgataatacatggtacttgttaataccaccactactagtactaccaccacaactagcttacaattgaataatacttgccaaatgccagagaccaagtacttttatatatgtactacatatattagctcataacctccagatgtaggcaatgttatcttacggtatttattttacagataaggtaatcaaaacacaggaatgcaagtgacttgcacacactctcaaggagcagagccagatggggccccaagcagcctggccctgagtctgcacacttaactcttatcccagtagttcccaacgccatctccacattggaatatcctggagagactcaaaaaataacagttctcaggtcataaccaagagcaattaactcccagtctgtgggagtaggacacagatgccaagggttcttgaagcttccgaggtgattcccatgtgcgaccaagtttgggaatctctgtactatgctatgctgtcttaaagttgtagaggtcaaaggaagcagagttattaggccaggaaataatccatctatggcattaagaggaataatggacaatcaagcatacagtgaataatgacaagcaacacgaggcattctcttacaactaaaggaaaaaaaaagagtctaagctgcagcaagatgaaattatatatttctatttttaatatcttaccaaagcaacatgtggtaatgagaattttaaggaataaggcatctgctttctgtttggaattaaaagggatattatgtttataaacagagaatagctagacgtcaatgtctggagattgtcacagctgaagggtggggtggaggctactgacatgtagcatagagaagccagggatactgctgaacacgtggcagtacacatgacaggccccacagcaaagacttatctggtccttagtgtcaatagtgtccagtgtgataaactctttaataatgactattttaattacagagacagtaaagagattaagtgaattcaatttttcttcatctaggattatggttaatttgtgtttactcaacaagcatgacagatttatatgacagtattagaataattacaacaaccattgaattcctagaaactatactttcatgctagaaaattctttagatgtgatggtaaatgcagttatagccttaaaaatctatgactcatagggaggagaaagaaactaggtagggcagggctagatatggaatgacatctcaaacatgtccagaccactgaatgaggaaatcagagccaggtcttgcaaatactccgatgttggttctttgaagcctaggttatgtttagtttcacctgcctatgaagaagtaatacactttctatgaaaccagagtaaagaatcatgtaagatgcaactacatccctgaaaatgtgcaggggaaatttgacactttactcaaagtaatgacagtaagaggacaaccttcaaagtgatgcatcttattttttcttattgcataataattgtattttcatgtcatcctaaatgcttttttcttttaaaacatttttcactgcagtgctttaaaaatttttaatttttatctctttaaattctattacttttaaccttatataagaaagtgattattagaaaatctgattataagttctcagagattcactctagcatatcttattaaaattggattctgggcttagctctgaagttttggtttggaaagctgtacttctgatcttcttgaaggcattagtttgtgttagtactaaagagtagtgctgtatgactgaaaagattttgaactagaattctgatttacacttgttctttctgtaataaccaaagaagtaatcttctaagagatcttatacagcaaattttgttgtataatacagtaatgtacagtgacaacttagatctagctggagaagtatttgttgcttctctgccattccagactaggaaacagcaaatgcaaaagcatgtaaagatgatagaacttaaagtataatagaaaaaaaaagatgataggactgttaagggtgatggagtttgggtgcagaatggggagtgagtagtgagagctaatgcaggagctacgtctcagatcatggatggccttaataatcatacaaataattttgggtatagaatattgaaaacttaatttggaaaagtaaaataatgagatttgtaatgtaatgacattgttccagacattagtgacattaatctggaatactatagaagagttattattctggaataatgtggaacaattttaatcttaatcttatggaagatggattagagagggttagtgtttaagtaaggagaccattgaggagctacagacatcacgcaggtgaacaatgagggcataaactaaggctgtcacagtggggataaagagaaaaggatagtttgagttactgagacatttaaggagtaacaaaaacttgggcctggattggctgtaaagtgtatgataaagaaggaggctaagtaagactcatacttactgatttaggacactgctaaatactttgcctatatcttctctttcaatctatgatgtaataaatgttatctaccttctacagatgaggacacttggcttaagtaacttgctctagaccacacggaggatagtggcaatgctaggatttgaactcgggaccatctaattccaatgcacatgatttcaactattcttagtaactaggatgagtattacaagaggaagagaatatttggagtgtgagataaaataatgcattatgttttggaaatgtggagcctcagatggccatggaacacaaaactagatcatataataggcaactaagtggaatttaaaaatgtggttatatactaccctgtcactttacattacagcttattgtattttataatgattacagtggcaaatatttttatatttttcccaaatctaaaaagactagtgataatggaagattgttccagaacatattgggaagtagactgtggaaaacggtcctattaactttttcattagtcatttttaaccacattatacattaacacttcagtacacttcacaaaatagcaatctgggctttgtattcaaccacatttagtacaaaagtggaaactaaattaaatacaatctagaaaacaaatagtgcaacaaatttcatgaatattaatagaaaaccagacaaatgtatttgagtttgcatcacaaaatgtgcaattcattcttttatggaattgctattttcaaacaaaatagattgctatagtcacttaaaaatgtaaaatgtgaaacatccatggaaaaaagataggcaaagattatgagaaatatgatagatttcccaatgagggaatgaggttttgaataaactactccccttggcagcatcttaacaagatcatattcaatgaatatgaatcattagtaaactatgaaacaatgaataaacacacacatgcagatgagatgctaggttgctacggatttactagctattccatctgtcattatttctgatttttcacctcctcctaaaatcattaatagggtacagagtcactgtgaattttatgcctgcctcaaaacacagaagggtttaatttattgaatgatattttattagttcagatgagttgaaatgtggcatttcattttctaaaactgtggaaacatcaatcatatagatacttaaattgtaatttaggcactgggtaaagtttcaatttatctgaataaaattgaataaacatccaaaatgaactaaaacatattttagatcaaattgactttttctgattagtggtcatttaaaatctccttatgcaaaattaatcaggtgcaatttcttttataaaaataaagaatagaatggtggttaccagaggctggggtggttgaggctgggggttaagtggggatgtggattgggggatgtggatagggcagatgttggttaaaagatacaaatttacacttagataggttgaatctgttcaggaggtctatttcacagcatggtgactacagttagtaacgatatatcattttcttgaaaaatgctaaggaatgcctactaaatattcttaccatgaaaatgataactgtgaggtaatatatatgttaattagctatattttaaccatcccataatgtatgtgtacttcaagacatcatgttgtacatgataaatatatatgattttacctgtcttaaaataaacaatacattaaaataaaagtcttatcttctagagctgaggttttgtcacttttaatatccacattcctaattgactatcaaaatccagtacttcattgtgcaatattaggatatactttatatatcctaatagtttataaaattatataaaatgttttataaaattaagtaaaaaatattgtgtgcataaaaatatcatgggcaatttcttttttcctccatttttttaatgatatgagactaattcttattctgaagatgtcttcacaaagtagaacatttttaagtggtttatttactttattctacctaattttctttttacttttgttttctttttctttctttctttttttttttcttgagacggagtctcgctctgtagcccgggctggagtgcagtcgcgcgatcttggctcactgcaacctccgcctcctaggttcaagagattcttcagcctcactctcctgagtagctagaaccacaggtccctacaaccgtgtatggctaatttttgtatttttattggagacagggtttcgccacattggccaggctggtctcaaactcctgacctcagatgatctgcccgccttgggctctcaaagtgctgggattacaggtgtgagtctgttctattctacctaattttcaaatacctgactggcctattctacctaattttcaaatacctgactgacaaatgtagaaatcaatatatcagatactttggtctacacaaaataaatttcttaatagatcattcattcagacagattgaatttttactttagataagaattacttaggtaagtattattgtgatggttactaaagaagaaaactgaactcttttggacaggaatctaactcaagtcaactgcttaaaggagagtaaaatttctgaggcatggtattgcaaagcaagggaatacatgttaaaaatattagaagcggtatagtacgagtaaatttgggaaatttgacttcaataagcatgttagagggataaataaaagaggaagctctttccagattaaagtttttacctatgaataattctacttttaaatagatccctggcaagacattctgggtttgagagtctggaattttgcaaatatactggttactaactggaataaaatatgtgctgcagtcttaaaatttatttaaatgggaatataaggttgccattgttttaatggcaaaaaaaaatgtttccatgaaatttatttatgaaatgaatgtgtggttgtagcttgagaggcaggaatttaggtgatgaggtagaaagttagaaagctacacattttattatttttggattctccacaatttttagaaaattctcataatttcccttttcttttatttgtacatatttgattattttgctattatcaacaattttaagaattttgatgtgcagaattaaacttaataacatagggattatttctaaatctttgatttccacattgcatacttaaatatgttcttagaaagataacctcatagcactgaaatagatggaaagaagaaattcttgaatggcaatgtgtccatatggcaagatagagcttgcaaagttaatttttcttaattagcagtaacttaatcagttccaagttagaactgaaaaaacgttttcagttcttttgtagaggtatccttttaaaataattcttatctctgcatttccataccgtgtaaattgagagtttgaagctactatatttaaatccagcaaacattttggcactaaacctttgtttctgtcttttgtgcttgtggtaatgtggtgatatatggaagatgcctcagagttactagtaatgctatgggggtggtggtgaatagcaggacaaaaattacttaagtgtaatttggaattgtagttggaatgcactttcatttcattatgtgtatttgataactcattgcttctgaaaataatcaatcttgtgaaagttaatgagcttttaaaaactgttctatgtaaacatttaggtagaattttaaattttgtattatttggaacatatacctattgattttcaaatgttaatttggttttattttctgacattttaaattggttttggaaattttaatatggcgcacaactaagataaaaagtattagtttataacctagacccaagattgaaaaactaaggacaaagagtcaaatacagcacacttaaaattttgttggaacacagccatatccactgatttacacattgtctatggctgctctagagctgcagtgacaaagttgagtagttcaacatagattgtatggcctgcaaaggctaaaatattcattatctggctctttagtttgtcagctccttatcctcgagctcctaaaaagctggagctgagctttacaattgcctatgaaaaataataattaagggcactggtataagggggaaaaatacaacctgtgtttaaatagaggtattcatttcaaaatctgcaatcagattttggttcatagaaaagaaaattttaaaaattagaatagactcaagagaaggtattcagttacattttaattttaaacatggtcatttactaagcatgggtagtgtgtttgtaattttagatgacctatacctttaagatttctgtccccttggggtggaggtggtagtggagctttgcctctttagatagtgggtgatagactctgctgattctgacagaaaggatcatatggacccccacagtttggaatcagttccatcatagatctgtacttgtgtgtgtgtgtggtgtgtatagtgtgtatgaaaaaaacaattcccttaaacgtagaactaaagtagactaaaatagttgcagttttcaggaaaataagaatcatggtacatacaaatttaaaagttggttgaatacgggaaaaataaattttctggtattaaagaggtctaaaatgcagccttcagtattgctcgttgaaaacactgagccaaaagataagtgctttctatgtagaaaatggtaagtgctttgccctttaaaaagagaatccagaaaatgttgcccttttaatgtcctgtagcctgccctggatttgaggatgaacagagatggcactaaaaatgataaagcaataaatcataaaccaccaaaattccttttgtatcaaagctcttacatgttcagaaggcaataacaatcttcagtacataccaatttccctatgtgggatggaaattggagaaactgtgacagaaaatactgaataggaataaaactgtctttgcctctttcattttcgttattttgaaatttttgctgtccacatattaattggaaatcttaatatatctaactgtaagtttatatctgaggcagaaagaaaacaaatatgggtctgtatgtcagctggaatccaaagtaaatatgatctttttttaaatgttcaaagcattttaggttcttttcactctcatcatgtgttacctgcctttgcttttcatgcatttgaaactcactcactcccctcttcatagttcttttttagtttctaaaataccagtgtaagtgagaaaaggtaaaaagctgttagaaaaatctctatcctttagaaagttcactaacacacaagataacatattaatgatgaacgagagcggaaatttctttatacttaaaaaagtaagaattataaggcagcaggtcatatttttggttagtgatggactggacttggagtcatttgtagaattaatttggagtactggtcaggatcaggaaataataattaattccatgattattaaagtttcttctgaatctttacaatttttacataaatgtgcatgcaatgccttgcttctcagttagtaacagggcttaactattttgtaaaccactttagggaaacatttagctagtgactggaaaatggggaataagtatgccctgctctattccaaaagcatttgactttggggttacttttcatggtagagtcaggacaatttctattaaatgctcatacaaataggaagtgcatgtttctccactgtgttcggaagactgcgaacaacagaccttccatgaatatcccaggtagtgccttgggaagaaagctctttgtccattttgtgcacacacttccctctttacctctccagattcacttcttgtgactgaatggaaaccacagtctttatacgacctgagttcaatgtagtggcttttcgctttttcttccaggactttgtaattttgtatatctttttgttctctggacacttaagatactcttcctgatccaaagatcaggagtcgaccacgtacttttaggctggtctcggctgacttgcctctagtcaattaacattttcctttgtctccgcatccaccatctttaaggacttccactccactttcctcatgtcataaacttttctaaaactgcttccataataacatagagtgcaggttctggggccaggttgcttgggtttgaattctagttagctgggtgaccttggacaagttatttactatctctgtgctcagtttcctcttctataaaaaggagacgatagtagtatttttcttatagagttgttatgatgattaaatgttaatcatcttaagaactttgtttttatttaagttgggtcccataaaagtttatgacataggtactgaatagacattttttaaactaatgataaaataccattttcacctaataatttgtcaattttataaaagattgaaaatatctagtgctggtgggtaggtgggcactgctggcaggagtataattggtacagccttcatgtacaatatgaaatgcaccacaaggctcagtactccatatataggtaagcatcattctggaatgtttatagcaacaggatgaatatttattgcatgccttactgaagagcatggggacatctagattgcatgcgtgtcacacgcaggtcatgaggagccaggaccgctacttgatcactcttcagccacttcccaccattacttttgtgccatcacacatgcaccatgttggagccaatgctgagttcaaagatagagtcctctcgaacacctagaggttctgacacgaatatgcccattactttctagttcctcattttcctttggatagtcctgtagaatcacctccttttctcaagggttgggtaggtccttgagggtacagagaagaagatcctggcaatcacttcactgatctactccaagtatccttataatactctctaacactgttttgctgtagattcaagaaagtcatttggaggtcaaatctaagaggctttgttctgtgtggtaacttcctgggtaagaagcctcagctttggatatggttgattaaagcagatttaaagatgaaatgaaaacacacttatttaatatgccaccattactgttccccttaaaatataaagggaaatacactaagtaaacttcttgttcattgttattttcaactccacacgtaacttgaggaacttttcatgaaaaccttccttcccctgcaactcctggacctggggagtggtttcattagttatgctaatgaggcacatgttcagttagctttgtttgtgaatccttgtgcatgttaatatgtcatatttctatatcttttgaaaataggattccaaatatgttcaacggtcttttcagcaaaaaatttacttcctttttaaaacagtttattggaaaacacatattttctatcttccgttttatgctgttgcaggtcctacattgaatggaaagtttgtttcaaaataattccattaattaacagagagccttgatcactggttaaattgtgatttatctgcttttgttcacatctagatttgctacagcccttgcattactggctttctgcccatcagtattacctcaagatgatttaaagcaaaggctttctggttaaaatgtgatgaaggctaaaatcaaaatggcaaagagccggggagcacttcaggtggaacgtaagttcacttatgaggtaaagcactcatgtaaggtgagtggccataccctggtgttcaactcagcttgaattttagctgaataattctgtgcagctccattggttacttaatgtagttatgaaaatgtatttgccctttggtcttcgacattccccacacatgtcttagagtgcttaacattctttctgttcttttcaggggaaaaatttactttttcttttttactgttgcttatagaatattttgagtgatttttttttactttaaaaaatatgataaactttatggtgagaacatatgatttactatgccaagctgttttgttgatttagcttccagatgagcacaaaaataaaaggcagaagtgaatagtttagatcagagagtagatattacaaaccaaatgacaaatataactcctgaaaaatatgaaatgcagtggttaaaattaaatttagacctaattcccttgggaattagctgtatgtagaacattgtatatagaacattgagataatctttggcataaaaagattgtctcattgtaatcaatccagtggaaaaggaaaagtaagatggcccttactcagccatctttctctgtgagcacacaggccattcatagaacaaacattgctttcagccagcagctactggggtcagagtgagtcgtctccatgactatgtgtgcatcctttggctacaggcacttgccatctgataatgaaaactctgactaatttttactttttttttaataatgaaaaactttttcaggaatactttaaaaaggtgagtgtaaatattttaagtttgttgacaaacgtttttactgaggtggatactgctattatttccctatttttcccgaagagtaactcattttttaatgtttgggtgaaacaagtttattttattttattttattttattttattttattttattttattttattttatttattttattttattttattttttgagagagagttttgctcttattgcccaggctggagtacaatggcatgatcttggctcactgcaacctccacttcctggtttcaaacgattctcctgcctcagcctcctgagtagctgtgattacaggcacccgccaccaggctcagctaattttctgtatttttagtagagacggggtttcaccatgttggccagtctagtctcaaactcctgacctcagatgatctgcccgcctcggcctcccaaagtgctgggattacaggcgtgagccaccatgcttggcctgaaacaaattattaacaactgttaaatattatgcaatatgtaatattatatatatgtatgtatgtgtacattgatatatatgtatatatgcatagatatgtgtcatgtaatatacacatatgtaccatacattttatatatgtaatatataatacatatatgtttattatatatgtaatatataatacatatatgtgtgtattatatattttatatatgtaatctataatacgtatgtattatatactttgtatatgtaatctataataaatatgtattatatattttatatatgtaacataatatatgtattatattttatatataataaatatcttacatatatttacatataattacatatgtaatgtatttaaatacgttagaaatatattttacatatataaaatacatatgtaatatattttagagatttttaatatagttgagaacattagcttcttgaggtttgagatcaggcctgaatcttgcctgcctaacagtaagcagtgacaatttgaagggatcgatttcagacctaaaatacaaaaaggaatctaaggggaagaacatttaaaatgtctcctgtccgtatctatctattgatttatctgtttctctctctctctctcaccatctgtccatctatttggattcaccagaggatgaaaaggatcatctttatgagcatcttgcagtgagctgggaggacacatgctggcttgtgcctaccatcttctacatcttaacttaattctgaagcatgaatttgacctgaaaggaggctcaagctttattcttttttttttttcaaccagaaacacaatagaatttatttcctttctttttactgagggagaaacagtgtcctggtaggggaatagtattttcaaaagctgcctaagtgtctttaaaaacaagaggacaactgaattgtaagtgctgccttttctctaaataaacttcatccagtcagcacatcacacactgatattcacattcgattatatttcttaccatcagaatatttctttgcctgaaaaattgtttccatatttactacctccagatcctcccctaggaatgaggtatagtctgtcagtaggtctgtggctctatacattttccattctctttgaagtttgtaggacagaggtcagggttagctttacattctctctcctctttgaaggttgtagagcagaggtcaggcttagcttgctagtcactgcaaattccctttattctcataatatgctgtgctaagtgttaatgataacatgggacaccaaggatatttcacctaatgactttttttccccctctcattattccatatttgaaattaaccaagtattaaaattaggcacctttttccccaggtaaagatgtttttcaattcccatctctaattttaaagtgtgtcattaggttaaaaaaaaaacaagataaaattgtggtaattatattataaactattttggtgaggagaagtaataattcaataattccacttaggagaccagaggttgttattaaaaatgatctgtaggcaaagagagagaaacaaatgggaccatcatcagcaaaaaacaacagaaacacaaaaactgattatatcaacgtgcggtagggaaaaagtgtgacagaatctacaaaatgagaaatgaataaacaggctcaaattttcaagtggatgcttttagagacatatacttgatgggcgtgcagaactcaggcataaaaatgcctgacagaatgataattgtttcatgttaattttgagttaaattttaaaatgtgagttgcaaagtttaatcacataagtctcaaagagctgtttatagaattaggtgacttagtatttgcaaaatattcagaagagtgtttgtcacataataagcaccatgtgagttcccttctattattttcatctcagttggtccttgcacaattctgtgaggtggatactgctattattcccctttcaggtgcatcttagaaggttaagtcacttgcttggacaaactacgtgtccctactgaatatcgcattggtgggaactatcattaaggtgaccgtcctctggccaaggggtgggctgcagcagaggctggtctcctcagatgtactctcccttgattttgaattttattttattttatttatttattttgagacagactcttactctgttgcttaggctggagtgcagtggtgcgatcttggctcactgcaacctctgcctcccaggttcaagtgattttcctgcctcagcctcccaagtagctgggattgcagatgcatgccatcatgcccggctaatttttgtatttttggtagaaacgggattttgccatgttggccaggctgatctcaaactcctgacctcaggtgatctgcccatctcagcctcccaaagtgctgggattaccggtgtaagccactgcgcacggccttgattttgaattttaagtggtgatgacaactgttggaatgtatctctctagagaatgatctggatctcagggacacacacccatttctgtggtttctgaatgtggttctggagaatttattttgatccttgagctactccataactttccattcagttgtttccgttgtgactttggttctgcatggctctgtgcttgggtgaggggatgtggtatatgagggaggaaaatgaccgtgccttgtcatagtcatccgtgctgtgacctgagctggcctagaaaagctaaagttgtagaaaccttggtcatgggaaaggagggattcaaatggccccagtacaaacatggcatctaacttctctagtagaataaaatcatggtgataaaggtgggctcaaatgtttttcatttaattattttacatcatcagattcatgattacctggaggtctgaagtattatgaagtgcccatgttcatctagtcatttttttttgttcatttttatatgactatatgaccactcttttggaaatctggtttctgtttcctctgattgatactaaatattatcaacttcttaaaagaaggaaccacagatttttttccacccaccgtgacctgtcatatgtagctccactaggttttccaattattctgactattctctaccaggttcagtcattctcctgccattcttttccccccctagatgtttgctcatgctgtttctctcacttgaaatgctctttctcacccactttatctttgaaaatcctataccatcttcaaatctcaagtggcccaacttcctcatatgtcaatttatgttgatttctctctgaattcccatggcacttacaatcagtacttcacagtatagtagttattttgtgtgagtatttagctgaatggtaaggttcacataaacagtgatcagttgtttttccccaatattttattgtcaaacattttaaacatacggaaaagttaaagggatttcacagtgtaaacagtcatgtatctacctagatcctacaattaacattttgctgtatttgattaacattttgctatatttgcactatcacatatatatccctctattcatccatctcttcaccttattttctgtttaaattgcaaaataagttgcagagatgagcacatttcactgtatgctaaggcatactttagcatgcttatcactacagttaatatttttaatattttggtgattaacttttctatactccatagcacccagcagagtactgaccacatcatacatgttcaattctttcccattggattgaatttaggtaccactttgaaaagcattagaaactaaaggtgtttaagcccagatgagtggtctctggtggcttagaggcagatagaggtgggtgtgttttacagacttttggaaaagacatccctgtatgtagcttgtattagcccaacttgtgacctctcaaatatatcctaggagtgtgttcaggcaaagtctaaggaggcacttggcggagaaactagacagggcaccatctgattgactaaaatactaagaacattgatattgcagaaacaacagatggatattctagtttttctgaagacagatagaaatgaggttataaaatagtcataaaaacggggttcatgtgcagcagcctgtgacagcctgttccattgcacccaggtgggtggaaattcaactccttacagagccagcacacactccaggtagacaatttgggcccaggcagacgatgaatttgcaagaaggctgctctcctgaacctgtgtaggcagtgagtttctgacatcttattaggggaaagaaagtcacagtacttctcagatttggtaacactttttaaaacatgttattatagcagtcattattcaccctgccttctttctttaacagagatatatttatgttcatatccacatccacatacattccttcattcttcaaatgacaggcttcttctcatccaagtatctctgatcatcccctctttggaattctctcctgactcttttattgaatccctcccaccccctgccattatgttgtatctctgaattctattttacctgggacatttttcaaaatgactaactatatacttgtttacttgtttcttacatttgtcttagtaggctaaaatttcataatgtcagaaacacatttttcccttctcctcttaactagagggtcttatagtacctgactcatagtagactcctaattaaaatgtactgaatcatgtatactgaaaatacatgaatagggaaaaaatttgtttcagtgttatcctaaatgcccttactgtgttaaactctcaccctggctcttttctttctttctttcctagtactgggggctgtactcaaacttgactttctgggcagtgccacaagttacaaaatcattcactccatctctgcaaacttccattccttcagcatgctgctctctcagctaggggttaggagaaaattatatctgatggaagcaattgaccacaagctgtgaatgattgggaactttgcttaatgtgttaaatctcttgaggatgtttacatattatgaaagtggtaaaatctggcagtatgactaagcaacttaaataatttaaggcagtttatgttaaaaagacatacggacttagctggctaaaatcacaatctgaatgatctgaatattgagaaaagtgaattcattcttgtttgagcatattataatctcacttttgttatgcatttttatattataaggggaatactgaattccattgtctctgatagattatctggtagctgatacgttgaatgatgaatgtagggaatagttaggaaggtgaggatttcccaagtcatgttgttgaaaatgggttaggagctgggagtattttgtttatagaaaaaacacagggaagataacaaaacttgcttcattcatttgagaaatatctattaaacacatactgtatactagcactacattaagtgctgtggagaaatagtgattaaaaacattagtcctgcttgcatagagtttatatttcatgattaggaaattgttaaggacagttaagtagaaacaggaagataaatttatagagttatatgtgtcctttctttttttcttagaagaacaggtagaggactaatgcacacaaaattgcaaggaaaaatacctttccttaatgtaaacaaatccctaacatgtacagggtctatcaatgtagaacggaataggatgcttcctggaatagcaatttcccattactgttaaaatttagctaatactatcaagctttaaggtgattttagataaatcccatatgcattagggataagaatagtgacttgcccatagttttttaaaattaagattctgtgatctttgtgttagtcaagatcactaattttcacttatgatgaccagataaatgagcatgattgttcttataaacagaagtcttccaggtcaggtttgaaaaagaggagttatttgatttggatttcttgatcctttcacaaagaaaagagtcaggtgttctgaaggcctggcataatgaacaaacaactgatagctcttttctttatatataataggaagtaaaacacaggtcacagagaggggaaagataaaggtagccatatgtcacctataataatagatataaaagatgggtgcaggggaaagagtgccaaatgttcatctagttgttctaactttctcattttgtccttgagtcatgtggctccatgcaagtctcctttcttctcaggcatgaagtttcttcatcagaaaaatgaggggattgaactacattattgttaatgtaacttttcaatcttacatttaaatattttagaaaaaagtaaacatattttgtgacaacacttcttaattattttcgaccattaaaatagtatagaaataaaatttgctattttctcagtggatcagttagagtcatcaaatgtaataaaaaaatcactcctcttattcctgagcctaggaataaacccagcaatgaaaactttttaattaagcacttagacatacttttgagcaactcacatgtggtattttaaagcaactgtttgctcaaataataattagtaatcttggttgagaaaaatctgaaaactagcatatcaacttgcatcagtcttttaattagaaataaatattcattttagtataacatacctccttgtattagatagaaggggaatgtgctaaactttcctgcatttatggaatttgtctacaatagaactataattgatccatgtaattttctaagatgaaaaaaatattttctaaacactttttaaacagtacttaccaattatagcctaacaatttttaagtaatagaatgttatggcttgatatggtttggctctgtgtctccacctgaatctcatcctgaattgtaataatcctcacgtgttaagggcgggaccaggtggaggtaattgaatcatggcggtggtttctcccatgttgttctctgatagtgagtaagtctcgcggggtctgatggttttataagcgtctggcatttccccacttgcactcattctctcttctgccaccctgcgaagaggtgccttctgccatgactgtaagtttgctgaggacttccccagccatgccgaactgtgagtcaattaaatctctgttctttataaattacccagtttcaggtatttcttcacagcagcgtgagaacagactaatacatggcttttttcataatggcaaatacattaaaatttttgatttataataagtatagcagcatataataatttataaacaactttaaaatatgtttaaatttatcatacatattttgtgggataagtaaaaataactttttctaccccctttttttgaaattccagagtttatagatgacataccaattgcatgtttctttcaatatattatcaaaattagaataaaacttttgctaaattttattgtgtgaaatttctaatagaaaaatggcagtcatataagtgaaactagaaaataaaagttttagattttatacatttttaatttttattacagttgagcttccaaaattatgttcagtaattttataaagcatattttagaattaaaaacataagaaaattttgaatatttcttaaggttttcatgaaatgtaaattataagagattttaacttcatttgttgcctgtaatatagaccatgcaatattgagtagtgattagagttagactctggattcaaatttcttgactttgaaaacttctgtgtgatttttcagtgtcctctggcttatgtgcctcaatgttgtcttctttaaaataagtataatagtaactcactgggtggatattagaaataataattaaatacaggtgtaaataattaactacaggtgaagaccaagaagtatgcttagacaatagtaagagcttaattagtgatagctattttatcattaatataatttaggcattttctttaagaaaaaacttagaatgaacagcctctccatttaaccttgaaggccctctactaatgccatttccttttttgcaacttttagagttctcattaggtttgagccaattttctaatttcttgtatgagcattttatttgtatatttgcatgtggcaaacctactgcaaataatctctctataaagctaaatttccatggcctttacatacttaactaatcccttttagtaagatttctatggtgaagtctgtataattgattttcttctgactataacatttcaacccttatatacttgtttatattgtgttgatttagtttcacatgtggccttagggattatctctaataaatacatactttattcctagcattcttatagtagtttacatgagtgaaaaggaagagatcctgtaccatttatggtttgattttggagatgagataacaaaaaatcaatagaaaaatcctttacaagacatgagcatgctgggaattgacagcaaaggagttgagtatgagttgggaccagtctaggctagctttcagaaggtgaatggcttgcagaaagcataaggtacaatttcatagaaaaaaaacccagaatatttaggaaggagctgtattactagctacaatgcatgtggtaggaaaatgtaggactctgtttgggacagtagagattatggcttcaatggagtggcaagcccatgagacttgggtattagaggaggataaaggtggaaggagctgagaaaaaagcttgattataagacacatgatttgttcataaaatgataaatgatggagaaaggggaggttttctattgttgatttgatttgagagtgacctcatttaaagaatatttcaggaatgagttgtatagcatggttaaatataagggctctagagtaaaatggcctaggtagtaaccctgtttcaattagttatagttgaatgactttagataattacctaatttccttaagtcccagtttcctcacttcttaaatgagtatcagaaaaataactaccccttaaagatattataaagaataagtgagatagtgtataaaaatatttcatggtggctgtcacataagtgcaaaataaatatgtattacatagctattaatggacatgaagaaatgactaaatgagattactgtaatgcaagtgaagttttcagcacatgctttaaacgtaacaggcccaaaacttaacagacacttatttatccacctcacaatcatctggacagttttctttcctaatgtcatggaaacagatctgcttactgtagtacagatgagaggcatgaccctcctggagcttggcctcttacagctccaggactatcactttcccatttatgaagctgcaaaggaagacaagcctaacaagcaagaaccttcaaagacatttgccccagaggatagtggattagtcactctgctaactgcctaattatgaagtgtttttaataagatgctgtaaaataaaaagtagtgagcatttttttttctagtcctacagcagcaatagaagaaataggtgtatgtgtgtgtgaaaaaccataacaataatactttcgtttgagggatacttgatgttttttaaagcactttcgtatacatgatattcacagaagcctatatagcagaaaaatgagtgttattatctttgtttcaaaaaagaaacatgtaagatcctttgtagttatacaaagagtgctttgcttcctcacttccccactcgcaggattctgccttttacgtgtcctgtgccttcattttgaagcagaatgaatctataaagattccttcttttgttctatacccaggtataccctacttgggctgtgctgtatgttctaatgatatatcagtgagtggcattatttggagttacatgtgtccctgctgatgcacatctatacaattagaattttgtggttttggtatgatgagtatttagctgttcttctgaagcgtcactgtttctttgggtcactcctcgtaagaaacagtagaacacagagaacagtcgctaacacagggaatttagctccctggttactatggcagggcgatagtgggtgtggggatacctgcctagtttatctaaaaacattgcttacgtgtaagtcaaacccaaatgtctcaggcttcttcagccagtaagtgcggattgtagccatcagcctcaatcagttacggtgaatactgtggtatgctgcccagaggcccctcgggatgagggggatgcaaaggcctggtcctcttgactaaattaaggaaaatatgaacatctcaagtccagactccccttacagacagctgaggcctctggtgcaactactttgcaattcaacttttgcctctgttcgctcctgtttccctcactgccttccaagtatttgttactaagagcattctctaataaactttgtgcatgcaaatctccatggcacagactgtttccaaggaatttgacctaagatgcagttattaagtttcaggggctgagaatacacactcttaacttcaggaattacaatccattatagactctccctctccaaagatttttagaaatcctcaggacttgtttgcacatgtgtgccaagtatcagattcgcctgttggtgatttctgtgcatcatcaatccaagactttactttttcctattctgagaatacattcctattacattcctacatttcctattctaagaattctatataatcccattctaagaggctacaccaaactggaactgtgtttctattactttccctgaggctaaggtgccagacgaattgggattctccttcaacctaatttctgctactgcaccctagtgaaagggatgagtgacactgctattaccacgcaaacaggagaatgttcctttggtattttattccttgggtagaggggaagggattctcagggcatggttgagtctatcttgtccattgcatttgactggaaatttttgcacttcaaatggtgggagctgtacttaggtgtctaaccagcccctatgtagatcagcagatgccactgggtactgtgaacataatgtcatcatgaggcacagtaaattcctgttttatggtaattggtatagggctttgtcctgcaatctcctcctttttatctttgtaacattttgtctttgaagggcaggatggagttctgatattactggcaattagaattaggccagctaatagaaagttaaaaagtaagagggaccaggacagaattctatctcaaatagcataaaacagaaatttactgtgtcttatgatggcattagaataaattatctgaagaaatgttaaaagtctttgttctatatttattgagttcaaacactttggctcaataccagtacctgtctatggaacaggctttcaattttaaagaaaattggtaaatcttttaaaaagcattaaattactcttaactgaatagtgttgggtggaaaagagttcagatgttaaattgtaaaacaatttatatcaacatatacctacattttattcatatattgatgaagcatgagcaacttgttgaggaggaatctggcatagcttcctttagcttcatttataaagtaaggttttttttttttttttaaaaatagaatggtctcaaatgtgtttttattaacaatgatgctctgttattataatccaccttcacatataacaatttcaatttttcaaaagcaaggtttacttttggaattatgcatttccaaaacaatagctttctaacatttcatttttaaaaagtaaacttttggaaagaatgccagagctactatccaaagagagatgtctgattagaagtttatgaattaaccactgtctaattgttaaacaagtatgctgtttgtctgtttagctcatatacctttcacagtaattataaaccactaataagtaaaaattatttgaatttcataagctattttaatttttattcttatttcacactcaaaaatcaaacatattactttcatatattagcatactttaatatttaagttcaaagacagctaatttttgaatctgtttgtttttcctttgagacagagtctcactctgtcacccaggctggagtttggtggtacgaccttggctcactgcagcctcaacctcccaggctcagatgatcctcccactgcagtctccaaagcagctgagattataggcatacaccataatacccagctaatttttcgtagagacggggtttcaccatgttgcccaggctggtctcataatcttcctatgttgtgggagagacccagtgggagggttttcctgtgctgttctcatgatagcaaataagtctcaggagatctgatggttttataaaggtcagttcccctgcacatgttgtcttgcctgccaccatgtaagatgtgcctttgctcctccttcaacttctgccatgattgtgaggcctccccagtcatgtggaactgtgagtccattaaacctcttaaaaaaaaaaaaatagaatggtctatattttgagtgaactcagtgagaattattctaaagaagttaattgagaaaaatgtttccaaggattgagctctaccactaagaataggcttcaaaaagtttttcacaataaagtctctttcctgatagtcattttaaggcaggaatcaaatactctctaaccataatgataaattccagttaaggagagctagggggactacagaagtggaaggaaaaatatacaaaatataaatgtattgttaaatcaccacttcatcacttaattaacaaatttcttgatgtttcccctgaatcttacttttcaacatgttaaatcctgttatttaactgtgctatatgccagagtgttctctgacccccatcaattattgctattctgccccaatttttataaatttaatttgcccctaagtcttcatttgtttcaccttactttcttataactgtcaaaatcttgtcttgaaagtggtaaactatacacattttagaattagaaggcttttaagaattgaagtttattttgctgtatactctgccactgcacaaaaataatttaaacttcctcaatagtcttttctgacagtggtagaaatttaccactaattataaaggatgaagaaaatctggagtcttagcatacacagctagtgctcaaaacatttcttgccttttatttttatttgttatcctctgcattagaaatgacagtgtttgatggtgacttactgaagagctaaacatcctttcacctggaactttttgttctcatcatacattttcttccatgagcatgttattatctacaccttgatatctttgcagatcctctttcatctgttgtcccctgataaatttctaatcttcaaaatggagttcatttttcattttatattatagatgtacttgccacctgtccctttctcttcagtagggtctttgtggttgctctcagaacttgagggtcaaccagttctctgtcatctcatcttggcatttggtaagatgaggatttgggccctaagtcttgactttttaaattttgctaattgccattctgttttgacaatttgaagtgaattgcacaattaaaaggcacaaatgtgattacagagtcaagtcacttcaaatatgttttttaaacatcaaactggctggtagagtccactggcatattattccataaagatactctgtagactcaggttcacattcagactgagatgctccaccttatttatttttgaatcaataaacaccaaactaatacttccacgtttctcaagaagtgggcaaattttagagacaactttatatagtagaacattctatccaataatccaaaatagtactaaaattaccaacttacagattcatagatatcttttaaagattttcttaagcttatgtaataaaagaaattttagttttacagtagatcttcacaatttaatacaaataaactgcattgtaacttgctattcagctagtttttatgtatgctatgtacagacaggctatgcatggataaaggtgcaagagtaatgtttagctttatatatttacacacatgccaatataatgataaagtattacctatatttctcatattgagcttgagttttcctgcatttcctctaagaaataccagatggaagagctgataaaaagatacacaaattaatattgaagtgatgaagtttgacctttttaatatgaaaatcttgccaaactttccatattgacatggcaacattttatgaataaatctaatatcttatagatttagcacaattcaaaagtcaccatctgtttcaagaagtgaaggctctcacatagtttcctggctctaagactaccagcatgcaatccatagcttatataatattaactaccaggaacatgtgaaaagtttttatatattttagaaaattagaaacataggtaacatttttaattactgtcaaaattatagataatagagtatggatattcttttttcttaaatgaaattgaatggtctcttgctcattctccatattgagttataggtcaataccatctggtcaagcaagctgcaatgcagaggatatatgtggggaaagggcagataactggaatctgatgttgagcagaggtgtctgagagcctttaacaaattaaatatgggtattataagaagtagtctattttctataaattacttactaatatcttaatttgatatgaccaaaatcaatcctactcagaatcattcttcccattttgtgaagttaatgcggattttgcattacaataaatttctttcttaaacaactgtgagaaatgagctaattaaaatgaattttaaaaaatctgcaccaatttacatatataatatgtatgaggttttatcccatagacatggagacgtcaacaggagataaaaattagtccttttataaaacttagcagtttttattttgttttctgaaccaaatattatcaaaggtaatgtgataaatatgtctacaatgatttcacttgacatatgtttgggttttagcaaatactaataagggttcttgctgcccaactattagaaacttttccagcctctgtccagatgatcttaaaccatgcatttctttacaccgagctattaaaaagtggctattggagatgtgttgctctggcagtaatacagttcttggccaacatcccactttggctaccctaagagtttgctaaccaaaataaattattaggtattagggtgtaccttcaatagacatggataactttatacctctggataaatctttgaggaaatgttctcaggagtgttagtagcatctaaggaagggggaataggctatgtgcctttaaaacatgcagataacacagtaaatcacctagaataaaggacacagggcttttttagagaatagaatactgggtaaaagttagcttttgtgtaaaacagacactaaaggtgccagaaaattttaaacttcagaaacttaaaaaagtgtatatatatagtaagacaatttttctgaacttccccaaaagagaataacccttgtgaaaaccaatagctctctctatgtgatccctttcaaaattcgctgaaatgaaagacaaactgtgcatgagtatgaattacagtgtacctgtagaactgtgatctctgctccatttcatttaagaagaacttctaccttgatactgaattgacctcagtcactacaagtggcttattcaagtttgttctacttctcccttctgtcctacagatgtaagatagatttagttggaggaagtactggctaataacagaataaaaaataatagctaataacaaaaaataaagccatattttacaagttgggcttatggtttattaatttttgaaaataagtttttattaggctgggcatggtggatcatgcctgtaatcccagtactttaggagggccgtggagggtggatcacctgaggtcaggagttcaagaccagcctggccaacatggagaaacctgttctctactaaaaatacaaaagttagccaggtgtggggacgcacgcctgtaatcccagctatttgggtggctgaggcaggagaatcacttgaacctggaagttggaggttgcagtgggagcgtgggcaacagagcgagactctttcaaaaaaaaaaaaaagtttttagccatcatgctattttttttattgtcaagaaatactttaatattgaagacatcgtgtcaacattcatatgatgaaaaaggaacctaactcacatgctttttagggagaaatttaccctgcatttgcatagtgagagttttgttagtgagaattaagttggaaaaagccgtaccaaaagacctttaaattctaaattttgcccagttaatgatgaagtaagactaaacagatgagacagcaagagaaggtgacataaacaactggacagataaagcaaaggcaatcgtaaatccagggacatccacaatgacaggaatcagaagcctcaagctatgtatctctattttccctgccctctggcaggaatcttctctcatgtacattgtatcttactggcctaaacttttaagaaacttatgttctcagccaggcttggtggctcacacctgtaatcccaacactttgggaggctgaggtgggaagatcacctgaggtcaggagatcaagaccaacctggccaacatggcaaaaccccctctctactaaaaacacaaaaattagccaggcgtggtggtgggcacctgtaatcccagctgcttggaggctgaggccggaaaatcgcttgaaccctggaggtggaggttgcagtgagccgagatcgcaccattgcactccaacctgggggacaagagcagaactccaactcaaaaaaaaaaaaaaaaaaagaagaagaaacttatgttctccctttttcatcagttttctatgtattaacaatttctactcaactggtaattccaattaattaaacacactgaaatttctttcatgttacatttttttctcttgattcctcactttacctctttttatacttccaaattaaaacttcaaagagttgtatatacatattaccttgatttttctctaatcgggcttcttcctctatcctgctacactgaagtcttcaggtcatggaatcatgtggacagtccagtggactggagcattcgataaactttgccattgccttccatgacactctactccttttttggctgttacttcctacttactccttgtcagactcttttatgatttcatctttcagtatacagttattaaatgttagctcatcaagagtcattctaggcaatttttttctactgtatactctcatcctttcccatggtttcaattatcgtctgcacagtgatgactcatgaattcatattttccaaccagatcccttctctgacctttacttccatatattcaatggaaaattccactttgtatttcaaaggcaccttaatctcagcatgcttaaacttaaactcacgatcttctcaatctaacctgctcttcttgcattgtttattattatctctgtggatgatctgctatccaattgcacataaggaaatgaatattagtttttgacacctctattttcactcctagtatttaatgagtcattttgctcctaattatgtcataaatatgtcactttagtccaagccaccattatatcttacttggatatacagtaaccctctaactggcttcctcaattattccttaacatagctgcaaggccagacagcatttgcaaactgtctacctttcaaactttgtttttcattactaaggcaccctcttctgcttctctgttcaaaacacgctgttctttgcggtctctgaatctgtatatgccatggttttttctagcatagggttttgttttattgatagattgattgattgagtcttgctctgatcccaaggctggagtgcagtggcaggatctcggctcactgcaacctctgcctcctgggttcaaaggggattctcccgcctcagcctcctgagtagctgggattacaggcacgtgccaccatgcctaatttttttgtatttttagtagagatggggtttcaccatgttggccaggctggtcttgaactcctgacctcaggtgatccagccacctcccaaatggttttttcatgtactcttcccttgcctgaaactcataaccactgctttgcctgtgttttcttttactaagtttatctctattcatttttaaagctctttggtctctctagcacaggctaggttacttttttaagccttcctgcatcatgtttctttcattaacaacatatctcaaattattcctttattagtgtgtctacttgtcagtcaccctcactaaaccatatacacataagaattagtttttttttctgttttggcttaccattgaattctagtagcttagtatagtgctacaagtagagtaagaaacatttgttaaatgaatatatgaaactaaatatagaacaaaaccaggagaaacagaaaaatgagatgcaaatattaagacatcgagagcatgcttagcagatgagcactcaacagttttaaattaatgatatataatatgtaatatatagtcctagggtcagcctactctcactttgagctcttgtaggctattgcctataacacagagcagatttgcatttttacattcatagggatatctcctttttactttcttaagttttgataaaattaatctaaacacttggaaagtccttttcagttttactggaagcatcaatatttattttacaggttgtttttttcctgaggctatctcagaatctgaatggtttgaggactgctctattaagttattacttaaaagtaaagaagaaaatcatttctctaagaatttaacccccgaatagcaattatttcatgtataactgaaagtactattgtttgtataaattgttgacattgtataaaatgatgttcttattaatagaaatgccttttaaacagttttctgttatttagcttctcatctggttctttttagtgatcaacagcaaacacttagaaatggttgaaatatttgtctgttgctctgaaggagtttgttttgtctgtatagaactcagtgttgcaaagggtatacgtaatttacaaataatgatttcattaccttagagtaatttcattgccttcttgttataagcaaatgaattgcccagcccagacaccctcatttcttcattcattcagacatttactgagtatctcctatttgtcagatgccctgttaagtgcattaaaaatgagtaagaaaccatctctgcctgtaagaagtttcattttcagattggtgtccattttgttgatgtgattttcagactgatgcagtttcagagaaagtttatttgatttatataaacttcataggttagccaagattcctgctgatcagactaacttatctaattgtcattttaaagacgaactcagtcacagaatatttttcaatgacatagagtaactttggagaccattattactatatgaaaaatttgagctatactgatgaaaaattttgaattcttagttgctgcatgtaaattttgtttagtaatgcccctgagatgtgatcatcatttagcaatttctcttttctgatgttttataattttgaagcataaatgaattcaaagactgatttccaaaaatttatataatccagaaagacatttccgtttaacattctgttggttttggtttttcttttctactgagttttctttttttgtgcagtcaatggctcccactaaccaattcctagcagctgtactccatagatattttgttgaacaataaaactggatgttagttttaactgaacaacttgatgctttaatttatttgcttgcaccataatattttcaaataaaattgatttactctgtgtgcaatttgattcccataggatagtattaaattatagcttagttcaatttgtagttcattccaccaaattataaaaataagtaaaacaaaagcaaaaataaaaaagtaaacaaaacaattttcagatggacttttaaaattcttttcacttttgggtggctgttacacacgtaaataacatttaaaaaatagagttcaggccgggcatggtggctcatgcccgtaatcccaagactttggtaggcctaggaggatgaatcatgaggtcaggagtttgagaccagcctggccggcatggtgaaaccccatctctactaaaacaaacaaacaacaacaacaaaaaactagccaggcgtggtggtgcacatctgtagtcccaactacttggggaggttgaggcaggagaatcgcttgaacccgggaggcggaggttgtagtgagctgagatcacaccactgcgctccagactgggtgacagagcaagactccatctcaaaacaaacgaacaaacaaaatttcagcacgaaagaactaccgtggagtacagtacttaccgtattgtgataggggtgaatgcatttgtgttaatgctgtaattagcagaaacagtcaaaatattttgagaatttccacacccatatttaactgatggccttccttccacaagaaataaatgaagaaactgctttccacaattattcccattacctttaagaaaaaaagaatatattagtaattattgtagatttatattttattggttaacaataattaaacacaatctttgccatcaaagactaatgatttagggggttggtaggagtgctattagataattattcagtgtaataagtaccatattagaaacgtacattattgtccacaggctgaggatagcatggtattaacagcattaacttgacatgaattttaacttttgattctgttacctagtagctagatgtccttaactattttaaacctgtttccccatatgttaaaatggggtagtgagagtaactactgtgagtattagaactcctgtgataattaaataaaataataaatgaaaagtgccatgttgagtttttaataacttgtattattattgaatctaatgtttaaattttatttttgatttctaatttcttatgtttatttgtattttaattacaaaggaatatgcatcttctatcaaaataatagagaaatatatagagaaaagagataaatatttcttttccccaatctcattcttcatccccactttgaaatgttcttttctaccacctatctccccacatacaaatatttacatatcccaattttatttttaaaaatgagatcatactttattcataaattcataaatggcttcattcatctttctctttttgcttaaaatttggacatctgtccctggaagcccatggatctctctttttaactttcctaattgaagtataacttgtacagaaaatcacagaaattataagcataaagctcagtaagtaatcacaaagtgaacccgctcacctaaacatcacccaaattaaggaaaggaccatcatctgcattgtcagaagtcctaccaatcactattcttttctgctcttcatcaaaagtaaccactatcttgatgtttaacagctatagttagttttacttgattttaatcttcctattagtggaatcatattgtatggattctttaagtctactgtagtcttccctttatgacagtcccaaaacaggtaattacagtacaataaaatatcttgagagaccatattcacataatttttattacaggatatagttataatcattctattttattatgtgttggtgttaatgtcctacttttactaatttacaaattaaactttatcattggcatgatgtacaggaaaaaatcataatactgatagggttcagtactatccacagtttcaggtggatcttggaatgtatcccttgcaaataatgagggactactgcatttgttttggctcaatgttatgtttgagagatagattatgccacagttaattcattatcattgttttgtaataatccattaagttaatatttaaaatttaattactgtttctagtgtagatagacattttccccctaggctttcgttactgtgaaaaatgctgctatgagcattttatatatgtctttcagttaaattgcatacatttctgttgtatatatatctaggagttgaatagctctgtcagaaagtataaatatgattaactttagtagctattgccagttttccaaaataattgtttatatttaacactttaccagcagcatacaagagttccagctgatccatagccttatcatttggtatggtcactttgtagattttacctattctgtttattatagctttaattttactttcttgatattggtgaagttgaacatattctcatgtttactgactgttttgatatactctgttgtgaaatgtcactttgtgtttcttgctcatatttatatttagttgtttcttttttcttattgaatacaagctctttgccaactacatggattgtaaatatcttcttcagttctgtatattgacttgccaatctcaagggtgagttttgatgaatgtaaattcttaattttagtgtaaatcaatttatgtattgtttccttcagagttatgattagtcctttcatgtcatgtttaaatgttgtggggtggggggacgggggagggatagcattaggagatatacctaatgtaaatgacgagttaatgggtgcagcacaccatcgcacatgtaaacatgtgtaacaaacctgcagtttgtgcacatgtaccctagaatttaaagtataataaatatatatatataaaaagaattatttgccttccccaaagtcatgaatttattctacattaccttctgtaagctttacttaagttctacactctacctagaattaatttttctgtgtaagtactgtggagttgtgataagctgaattatgacactcaaagacacccatgtactaattggtggaactggtgagtgttatttgatattgccaaagagactttgcagatgtgattgaattaaggagcttgaaatggagagattatcctatattatctcggtgggccttaaacatagacacaagtgtctttgtaaaagggaggaagagggagacttgatggcagatgaggagaaggccatgtgactacagaaacagagactggagtgatgcagccacaagctacagaatgctgacagccaccagaagctggaagaggcaaggaatggattctctgaagcttccagagggaaccagtcctgctgacagcttgactttagccccataagactcatttcagacttctgacctccagaactgtaaaagaataaatttctattgttttaatggtaacttggtatagcagcaatacaaaataatgcagggatcattttttcattttccattttgatttctaattgatccaaaatcatcaaagtaaataattcttatgatgtaaatattgaattttcagatatttatttgtggaatatatatatattttactatttttgagtttttccattccctacttttcttctattgtttttatcagtatatgtatgtatatacatatcagtatatatacacatgtgatatacatatatcagtatatgtattttatgataatgacattgtttttgtactcaagcaatagaaaaatggacaaataaaagtgtcttaaatctctccaaaattacaaccttcagaaatggccagcattaatattcagtgaacatctgtagatacaaagattgatatatggatagataggtagaatttcttaaaataagagcaggatcacactataaagtatttaaaaaagaaaattatatgaaatgagtggttctcaaactctttgatctaaggaccccttaagacacttaaaatccagtgagaactctaaagagcttttgtttacatgtttcgcatcttttgatttactgaattaccatttaaaaccatgaaaattttcaaatgttaatttaaaaatatcattacatgttaacctaaataacatattttgtgaaaagtaattatatttttttcaaataagaaacagcaagagaattattctatacttttacaaatatctttattttgaaacttaataggagacagctggattattatatctacttctgtgttcaatctgttgtgaattgtttctttggccaaagtataggaagttcagcctcacacaaaatgttatgggaagaggaggaacattttcataactttttcaaatacatacaaactggacaaatggcagttcgttaaagtttagttgcagtgtggaatctaaaagtgtattaatgaacttcacgtccttgttacattaaaatgttattggtctttcttgcactttgaatggatgttttactcagtcataattttataacatcactaattgatcatttgaaaaatattggttcagagttatgcagagttttcagatatgacacatttattgtataataagatatcaaattcattaatattaccactgagataatcagaaaatgttagaaagctctcaagtttgttatggggaatgtagatttttccaaaattctaatttttcttagacagcttgagttttatcggcaaaaaatactattagctgttttccttgaggtaacaggcttactttattactttttcagaaaatagctgccaaatagtcatgtctgaataaccatacattatctgctagtcattttttcagtagttttcatagtgtctagttaaactggcaacttgtctcaaggcaactattatactttaatatgtagtcaactttcttaatgtgtacttccaatgttacagaatattaaaacttgtatacccaagtgttgagatttaataagattattgaattttattgcatctctaaggacatttttttaagtgtccatttttgttttgagtggacagtggaaaagaatacaatgaccgctagtacgatttggtgctgctgccttaatattaaggtgttaataattttattcattatgacttttacaccatgagcgaaaatgtcaacacagtgattttgaccttctggacacttgaaactcctgtggatccctcaggagtctatggatacactcggagtatccctgtgtgagagcttacctccacttaaaaggaaaaaccagaaaccagaatgaaactagacttattgctcaacattaattaagtgtttctttaacaattcagcaagactatgtagaaacctgggttatctgttccccctacctcaggttctagacgagtggattaaaagcaacagtcagggctcaaagaatggttcagagaaaggtgtctggaaaaattatgaaaggctttgaaatgagaaaataatttaatatttagcttactcatccaggttctctgaacctttctttgtctctgagctatttcccaatactgtaagttgcagaaaactaataataattcacatgattcctgactatactaatgcatgttaattttctgatgaaatgaaattattaccccatggggagactatttttttatctacttgtaaatttacttcagaattccttattctttatacatgtttgtgccccttgaattgtttcttgaacttgttataatatctcaccagttactacataaattaataagtaaataaaatctttgacatttttttattactattatactttaacaaagaaaaatcagctaaatcttaaagaataatttttaaaagggtatataaaaacacatgtcatttagcattaggtatatctcctaattaggtatatctcctaattagggatacctcctgatgctaaatgacatgtgtttttatatacccttttaaaaattattctttaacaaagaaaaatcagctaattctagtttttgatgttacaacacatataaggaggaatgatttgtatcatatccaaacaaataaaaccaaaaccaactctgaggaaaatttgcataaaaacagtgcaaatggggtccctgatactagggaacattttactctcgcactggacaaagatgcccacactgaggatgaccaagttggggaaggaaggaagaattcaaaacatggttgaagaaacatatagagccggggggacataaaaaatccaaggcacagaagtacgtttcccattagtgctgcgcttcaagctatagaacttattgagaatataaattcagtatgagagcaacacaaagtaatacataataataaaaatagattaagtcaatattgcagaagtaaggaaacagataaaacaacagcattaaagatttaataatttagaataacaaaaggcatatggttgaaaatcactcatttgagatccttctaaatgtcctattttaggatccacttaacccatctgggtttatcacttctgaggacttcaactgtacaatgagcaaattagcccactgcatggcatagggcaatacaactttatcttttctgcgtcttctgagatccattagcaggttgttttttttttcggcttctactctttagtatttttttcttatttttcccatggcttcctattcagctgatcaggctgcttttatctgaatttgagagtataattaaaatttttttgtattcttgactttttttctggagtggaggtgaggtggtggttgggagttggagcatatttagaaacacaaaactgcaccagcacttgtgtgtttttctccttggatctgtaaaaggttatattataaaatggcataaggcggttcttctttcttgaattgttgacttgttctccactcccatcattttgtgcgtggggagggtgttaatgcactaaaggacagtctgttatcctgctccattctatcgtttctactcagaagctttctatttcttaatatttttcataaactgctttatgttaccatttcagactcatatttttgagataagtcttaaaaataggatatatagtgtagggtagaacagaacagctgagcatttaggtcaagctgttgtgccatatgtacaaggtttgtttttcaaaacttcaaaaactgaattttaaagattgactatacacattcaacaagatgtatgtagtactatgcaagaatgagttatttttaaaggaagctcagccactaacatcaatgacagagatgaatagtcttattcaagtataccaacatcccattatggactgtagctgctttattgtacagtataaaataagactgctttaataaaggtaatgggaacaaaaatgaacaatgaagcttagttctcttcacagtctgctatatattaacaggttttaatttatcatattgatttattccattaacaacaattcgtggttttatataatattttttacaaaggtcaaagtgttttgcaaataacatatgatggtaggtgggaaagtagaggatctgacactactgatgtgtttccatgattctatagcaaattaatcaccttagggaacaaaagacatatcacttgattgacttttttcaccctcaaatcaattgactttgtatcatgtaaccctaggattctataagtagagaaaagctatgaataaacacattcaggaggaactctggtttttccaaacagtattaaagacaattttcaaacacaattatggtaaaaattatttgattttagaagggaaaagttagtggcaattaggaaaagagaaagaaacttgaattttcaaaatacaactactgaagaaaattctaagtaatgactattcttagataaatgtatgtatttttacattaaaccttatggattgagtaatccatatgtcatattaaatttagttcaacattgctcgttgaatgtagacatcaagcaatgtgaatctttatatatatgtgtgtgtgtgtgcatatatatatatatgtttgcaaatatatatagggcaaatgttaaaggcagtgtctggaacatttcccccataatgttctaatttgtgctaccttcaggcaggacttgaaagctctagaagagtttaccattaagtcgttgaaagaaagtcattctattctttcactgaaaagatgcttgatgatccattagagaagtatgaacctatccttttcttgaaatattaagttggtgcagaagtaatgcggtaatagttctttaggcttttaggctttgtagtaagttttaaaatgaatcatttattgattttttttctgaatgttttatccagactacatttcaaaactttataaaatctctagttctcaaattttgtttatcctaataaaatgattgtctgctaatttaagatttgttaagcataaaagtgctgcttagaacaatgaataatagtattcctctcaaaacatagattccagtatctaaatgtcatagtttttagagagataattctaagaagtttgaatctgatatattaaaatatatatgtatatataattagtcttataaaaagaaataatgaaataaatatcacatggagaaacaatgatattctagtcacctattttacaattttagtttgcttagatattagtttaattgtagatctggaatttgctaaacatggatactttatcactttattgaaatattgaagatattcattgtttatatggtaccactcccattaaacatgggtattcttctctaattgagctattgtaataatgctcccaatatcaacaatttgaattgagatcatttataaatattcaaaagaggttcattggttatcggtttgaattaaataaaatctaacatcattccttatagaattaatagttataagtgcagataaagcactattaaatcaggtacctagattattaaatctggaaatttccataaagttacctggatttctatcatctaccttaacagaaaaatacctcacatttttatggtgttttgtatttttcaaaacacttacatagatatacatttcaaaccttgtgaagtttgataatataaacatacctgcatcacttgtagtcaaactaagacatagaaagatgaatagatgtaccctatattgtacaatagctcacactaacttgggttcaaatctatccttggttatctactgacgtttcaatcagggctacctgtgggagcagtcagatgatctgtttatcctggtgctgcttcatgacatatgataaagactgtttggttatcttgcattgagatctctgttggaacacagatgtttcttctgtagttttagaattcctctttcctggttccccctaaaggtctggatttgtatacagcagtaattccagtagcaacctcagcagcagttgctcatgattttaagacagcttacagcaacaatgatgacatgggctgataataaccagtgttagggtaagctagtttgtcagtgggaagatggcagacagagaagctctggggagaactgaaggatcatggcagcagcctggtacataattaatgattacacccatgtttattacatgctattggagattggcttcaggccaatttctgaaatttatagacagcctgttttaattttttctagtctgctaattgtgcctaaccagtaaaaaacactagtaatacacaactcttagaggaaatgggtcttcttcatttgggtgaaatgaataaaaatgaaaactccaaatttcaccaattgtctgttttcctactctcccatttttgatgccacgatttttagtctatttgttgctaggatgaacatggctgttaaatggatataacattcgtaacacctctcagacaaaaatcttgcatcttaagaccttaattccctagacaaggtacaagaggaaaggagttaaagcattatctgaataagtcacttatttcaggcctgccatttgccaagcactgttttatgcaggttatatgtatctctcattgacttatttcttcataaatttcaattgtataagtagaatataattgttctattttaggcgaagtttaatgaatcacataattctaggtcaagggttggcaatctatgtggcccatggaccaaattctgacactgtctgattttgtaaatcttaattgaaacatggccgtactcattcatttacatattgtccatggctgctttcaggctactatggcagagttgaacttgtgcagcttgcaaacatatctacttcaaatatctatttctgagggttatagaaaaacttgccaactcctgctatattcctgattttttaagtaaatgcgtgaaaacattatctttgtttcaagctacattttgactaaaccattgaaatttgtgtttgtttctatttatcagaggaataaattataacaatgttcaatgggataatttcctaaagattcaatacctacttattttttatcacaactatcaaggttgaataactcagaaacaaaacttaagaactattctagccaagtacctatgctatgcaaggcactagaggaggttctgaggagagtggggagaatagagaactacgaaacacagtttcagattaagaggttaatatggtttggctgtgtccctacccaaatttgatcttgaattgtaactcccataattcccatgtgttttgggagggacccggtgggagataactgaatcatgggggcattttccctcatactgttctggtggtagggtataagtctcatgagatctgatggttttataaggagtttccccttttgcttggctgtcattctctctcttgcctgctgtcaagtaagatgtgtcttttgccttctgccatgattgtgagacctccccagccccgtggaactgtgagtccattaaacctcttcttctttataatttacccagtcttgggtatgtctttattagtagtgtaaaaacaggctaatacagaggtgtttgctatttggtgaggagatgtaagcacagactcctggtaaaatgaatctctgtgcaagttcttaatttatacttctaatttaagacatgtcacaaccaggtttcccaaagaattatgtagctatctactaaaaggtgagaaactagggatatatagaccatcacttattcaactttgtatccctcacattgcccaaagaaagctatgcacattttaggcactcagaatttgttgaatttgtctttgctgtcataaaaaagatgaaatacaatgaatagaagtttctcatgaatgacaatgcattaattcagccatccatgtttgcaacttactctttcctatatctgtcttgagctagctctattgggacccattaaggagggatgaagatattcaaagaattttatggtacacacaataaaattgattaaaacaactgagcaatctttttccttagaagagaaaagatgctatctaatatgatgccagggaatgctgtgggacttcattggccttgccacatcattgaaatgaaatatggtaagtgtctaatgaagatgttatatattctgctggaaatcattttatagggaaaggcaggtgttatgactctttagatttcatttgttttctccaggagtatcagaaatcttttagtcttccataaatgcaaatgaagaggccccaataattccactagcatgtcaattactcttatctaagattggtccttcttttgcttcctattttaaatacaaacattaagtaatataaagattgcttctgaatcctctcctcccactggagttgctcatgtaatttgcctcctgggacttggtcagatgtcttctcataattttcaaagatcacatacttccacatggcatgcttatttcttttcaaagaagcagcacagaatggatccaactgcatggtaatatatcccatgacgaagcctcctgattgatactgcttgtgtaatagagctcattttctgaaagtgcacctaaagaattttgtgtggtctcatcccttctctcgtgacctattagtagctcctttgactaggttccagaattctgaattggttcagtggcagattcaaaaagctttcttttcatcttgactgctgctctcagagctgtctctctcccacagagtgttcttttttaagctatcctttctaaggatttttaccgtaaccccgtaaggattcaagttttatcttccttttgttccttttcaacatcaattagttggtgaggcaaactgagacaaaataaatgtgcagttttgaaccaggaatataattcaaagctgacagtggtttatcagcctgatagttctctatccttgtctcttaaatatttgatttgatataaaatacaatgttcaaaaaatgtttgtgaaatggaattgagttgaactgaaatatttaggaattaaaaaatggcaaaattaaaatcaaagcaactcaaacaaaatcaacacctaatatttgaagtgaaacatctgttttaattttctcactagttttaattgctcctacacataatatactgatttcaaagtaaatgcaattatcccctaagttaagggacacaccttttaaattaccagtatctaactgaattacaaaaatctttgtgctcatctgttgtgaggcttttatgaggttgacagattctaagaggatagaaagtagcaacccaggaaacattctgctgaggtattcccaacagtgtaggattaaattaccaccttaaaaatgaacagaaagaatgctttacaaacaaaaatattttctcccttcatgggctctgaaactctctagagtaaacagctttgatgtgtccggtactataacaacaattatataagacaagggcagaaatggataatcgttacagtgggattattttcttaccaataatttctagtttgattgtttttgtaggtcattgaataaggaaggcagaaatgatcctatggcactatcatcagcttgacttttattggatttagattaaagtacgaactttaatggagtgtatatatgcttggcatgtatttctctggccttcaaagataacacatccaagtgttggtatggacatgagccaggagcgtgaacccagagcaggataattcccagtggttgggtgctgctttaactatgagctgtttttagttggtagaaataaattttccccaagaaaatgccttccaattctatataacttaaaaaattgcaaagctagaaaatcacttttctttgtctttcgattattatgtttgtgtcttttgttctgtttttcttttgtttactctgcaatgtactattacttccaaatttcatggtcatctaccagcacttagattttgtataaaaaacaagtttttcttttgtattgtcttctctctctctcttttaacataaatcagtcagacactctctaaagctatcatttaaacatgggtgcctctgctcctggggaataaatgatactggcctagcctggcaagttggtttctttctaaaatataacataaattctttgttttaatttaatgttaaaaactactaacttcacctggctttcctaaatgcttcttttaggcattttactcgtagtcaaataataaaatcttttatgtattttgtttagaaagtgtagaatgatgaatcaatttagcaaactgtttcaaagtagaggagcaaatcgtttgggaaataataagttgccccaaaggggataattgttttttattttttatttttttattattttattataccttaagttctagggtacatgtgcacaacatgcaggtttgttacatatgtatacatgtgccatgttggtgtgctgcacctattaactcgtcatttacattaggtatatctcctaatgctatcgctccccgctcccctgataccacaacaggcccctgtgtgtgatgttccccttcctgtgtccaagtgttctcattgttcaattcccacctatcagaatatgcgatgtttggttttttgtccttgccatagtttgctgagaaggatggtttccagcttcatccatgtcccaacaaaggacatgaactcatcattttttatggctgcatagtgttccatggtttatatgtgccacattttcttaatccagtctatcattgttggacatttgggttggttccaagtctttgctattgtgaatagtgccacaataaatatacgtgttcatgtgtctttatagcagcatgatttataatactttgggtattacccagtaatgggatggctgggtcaaatggtatttctagttctagatccctgaggaatcaccacactgtcttcctcaatggttgaactagtttacagtcccaccaacagtgtaaaaattctccacatcctctccagtacctgttgtttcctgactttttaatgattgccattctaactggtgtgagatggtatctcattgtggttttgatttgcatttctccgatggccagtgatgatgagcattttttcatgtgtcttttggctgcataaatgtcttcttttgagaagtgtctgttcatatccttcacccacttgttgatggggttgtttgttttttttcttgtaaatttgagttctttgtagattctggatattagccctttgtcagatgagtagattgcaaaaattttctcccattctgtaggttgcctgttcactctgatggtagtttcttttgctgtgcagaagctctttagtttaattacatcccattggtcaattttggcttttgttgccattgcttctggtgttttagacatgaagtccttgcccctgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagatttgtcaaatatcagatagttgtagatatgcggcattatttctgagggctgtgttctgttccattggtctatatctctgttttggtaccagtaccatgctgttttggttactgtagccttgtaggatagtttgaagtcaggtagcgtgatgcctccagctttgttcttttggcttaggattgacttgacaatgtgggctcttttttggttccatatgaactttaaagtagttttttctaattctgtgaagaaagtcattggtgactttatggggatggcagaaagtggccatactgtccaagggataatctgttaaggtactaaagacattacacctccaatatgaggaattgttaaaatgattgtgcatttatttcaaaagagaaaacaattgtcaaattttgaatactgctggtaatacaccttagtgatgttcattcacagaagaaagaagcccatacattctgcttatagagacctttatgagcaaattgcataataatgcagagaactctggatgtaaagacatttccttaagcaaatactgttaatactacttaaaaaaaaaccagcttatatcaagataatagatgttactaaaagagtggtaggaatttacttgattgtcaaatgaaccccagctttggaatgccttttcccaagttatcaagtattgaatgtaattcatatttagtgatttatatcataaaagtatgctctgaaacatttgcagcatttgttttactgctatagccatatgctgtcaaattcatatgcttgctaaattctgtcttgtcagctcagatcctgtttgtaagtcacgttccattgaatgactcataaagaaacttctagagaaactacaaagaactaaaatttctctttggtaatgcttcatgcactggtctggaaaaattctctcacaatatttaaatgaataaatcattgattcaatagatcaacgtttgagaaagaaacatgacatacaagaagtcaaacatttaatactcactgtaaagaatagttccatttaaactgtttgtttttatagtcaagtagatggtaacagttctgttatgttccttctccaggacaaacttcaaaaagggcagttctaaataggaattcccattgaaagatggaaagaataaacctgcatctaaaaaagaaaatggtattaatatgttctgatagcattatattgctactcaagtagataaaaacttagcatttatagttagcattcatttgaaaaggtaacactagtatttaaaatgttaggtccaattttaagaactttagatataaagtgtaataaatttatatttattgcctcaaataattcactaccagtacagaggaaaagactgaataagagttataatttgatgtttatggatgggttttaagacataacaaacactctaaaattgtctgaaaaaaatttgtgtacttgcattgtgaaatcagtgtttcaccagattcttttgcgatattttgtgatgtgaaggttgtattgtttgttaatttttaatttttgtgtttacattgtaggtatatatatttatgggtttcatgagatattttgatacaggaatacaatgtatcataatcacatcagggtcaatggagtatccatcaccttaagcatttatcctttgggttacaaacatcaagatatacacttaaaattgataaattttatttgatgtaattatatgtcaataaagtgaaaaaaattctgtgacacacaaaggttagagaactgtcacacagaggaattttattaatgttcattaatatttagtgcttttcaataatacttagttattttataagtagtattactataatatgcaaggttattagttttagacttatagaattatttgtattttaaataatctcacaaaatcttggtgcacataaaatttaaaacatttcattgttatagatctatattcatatctattaaaatataattggtacatagaacaagtgtaacacatggtatgttgaaaatgcaacttctttaacatttggtaataaaaaaaagaaaatgcaacttcttttttttttttttgagatagtgtctcattttatcagcacaactgaagtgcaatggagcaatctcggctcacttcagcctcaaactctcaggctcaggtcatccatctgcctcagcctctgaagtaattgggactacaggtgtgtgccaacacgcctggctaacttttgtatttttagtagagacagggtttcaccatgttgcccaggattgtctcaaactcctgagctcaagcaatctgcccaccttggcctcccaaagtgctggaattacagatgtgagccaccatgcccagccaactttcttttttgtctttctcacaatggggggaattttctctgccactggacggaaatttagtatttccgattatttttaccatctctctaagtcatacagtgagtgagaaactaatatccagtctaagaaatttagtaacagttaaatcttccatcagagatatgatttctcctatcctccttcaccagcctatctctgtagggtggcctgacacctgctgtcttccttgaggggcagaagtaacctggtttctgttcttctttttatcacctctcctaaggttagctgctgtttctgacccttccagctttgaatggggagaaagtaaggtggggtggaaaggaaagactacacagtaaagaagagctgttagaaatggcaattgtactgttgtaaccaggcatcttgctctttaggaagggaacatgtttaaaactggttgtttctttcatggtagggatgccagataaaatacaggatgctcagttaaattcaaatttcagataaataacaaataagttttttgttgttatttgtttgttttttgagacagtcttgcttcgttgcccaggctggagtgcaatggtgcaatcttggctcactgcaacctccacctcccggcttcaagcgattctcctgcctcagcctcctgagtagctgggattacagtcatgtgccaccatgcctggctaacttttgtatttttagtagagacggggtttcactatgttggccaggctgctctctaactcctgacctcaggtgatccacctgcctcagtctcccaaagtgctgggattacaggcgtgagccactgtgcccagcctaaataagtttttagtataagtatgtctcaaacatcacatgaaatatactaaaaatagtgctgtttatttgaaatttaaatttaagaatcctgtaattttagttgctagatctggcaacactatgactcatgagcatttattcaatctttggaaacctttgtcaactgccacgcctaggatttgcagccataccctgccttctttcttgtcacttctatcttggtcttgctctgatttttcaaactcttgttgttgacagtgatttgcctgtgtcagtgcaaacattgcacagattaagttaagtaggcaaggatgacttttcccaaggctattgcaataagggagaggtcagaactcagtctgagctcaactgctttgtaataaagtaaagggtgggagagtttttaagagctggagtgagagagaacacaggctgtctgtgtttgctaattggctttattcaaaggataagtaaactttctcttatctttgtattaggacatagttttacaactaggaatcaaggcacccattgaagttagtcttataccctcccctagaggtggacagatgggctgctgtcttcttttatgattacattttgggggagcagtggttccaagaaccttaagaaagattcctggctggtaaaactgacaagatctttaaaagatttatgtttcaaaggcaacagagaaataatgtaatacggaaagttttctaaagtaaatgctccaaggacctagtcaggaagaaacctttctaaagtttagttaagctaagaagagtgttaaggccatcttagtcacttaacaagcagcatttgggaagaacataaaatgacttcaggccagttgcttttcctgaggggtacatatctagtccgtggtaaagactcttaaattcctggtcatctcctgccctactgtatgtggggtatagttaatttccaaccaaactctgtctctgtttttcttctgttgttttttttgagacagagtcttgttcttttgcacaggctgcaactgtggtgcagtctctgctcactgtaacccccgcctcccgagtagctgggattacaggtgcatgccaccatgtctggctaatttttgcatttttagtagtgatgggttttcgctatgttggccaggctggttgggctcctgaccccaagtgatccacctgcctaggcctcccaaagtgctgggattataggcgtgagtcaccctgcccagccctctgtctctttctctctccccctccttctccttccagacgcgcgcgcgtgcgcacgtgcgcgcgcacacacacacacacacacacacacagtgctgctttagctcagctatgaatgtatgactataggtcaacagtccatggtgctactttctaagtgatccagctgtagctatctccaaacacattgtcaggtacggtgggtggaagagggtggggagtgaagtccacaagatagccttcttcaaaaacattttctcaaaattatctcttaaaatcttctggtccaaatacataccctttttaaatcaagaatactttctagttaaatcttgcttttaggtatggcacctcatttgtttacagtgttatatcctgttgtgcaaaagaaagtttatttttaatatcctgtttatgcctataacttgtgaaggttagttgttagaatcaggtataaacaatacaacttaactattattaaactgctttacttaagttatatggtatcacaaaagttaccgtttgttggccttctacacacaatcttttactcttagaaatttacctacctggttctgcattttattgaatctgttttttcaaaggttattaaggccttgttagcaagttcttcatcggtgcttatgagcactgatgcctagaaatctccataatactaagccgtcatttttattaaaactttctctttccttgtctttcatgacactgttctgtactttggctgtcttcttacctaccttttgcagactgtttcttcaaccactttataacacacatagtttccaaggctctgtcctctgtcttgagtcctctaatcatttctgacttttctacatctgctgctccttcagtttctaactcatagtacttagtgttccaagcttagaaactcagcatcattatctactcgtctcttcccaaactagttgctagatcctgacacttgcttaaatcaaagcttttgtctttccttctgctaccacaaccctttaagttctcattgtttcaactgaactgttgcagtggcttctttctaacttgctttccttcctacagtgtctattagttgtcattgctgccatgtcaattttattcaatcataattacctgagacctttggtcaaaaacttcagtggctacagtataattatcaagtaagccaggccctccatggtcttcctttttagtgcttctacacatacatatctcctgctaaggttgaaccaactttcttttgtttctctacttgtgttcatactgttctatctttgtagaacgttcttcctcaaatcctaggtataaaatttctcccttaattcaaggcctacttgaatattctcccaaatttgaactcctcaaagcattgtatccgcaacttttttagtctatgtattgttttttatcctacgttacaattgttggcataaatatagaattgataatatagtaaacctaataatttggatgaaggcagtgaagtgactttaattagtagaaatagaatgtcctaagcatatgaattctaagaaggcactggggaaaatatgagttaaggaggtgagtttcctttcctgtgaccagaaacgattataacatagttggaatgtcacttatggagcagaaggtttgcagatgctgaactgcacatgcatcaacttttaatgatagaagaaaagccatataccaatcaagttaagatgcaatgtaactagctagacactaggagaagtttggatatgaatttggataccattagtagaggaaaatggttaagtttacaaagagatggacttggcttgtaaataaataggatccttagcatataacttggaaactatttggatgttgcatatctgttgattctaccatagatatggttttagacagtttcttcgtgttatttttgcctatcttactgggagtcactaatgaattcaacgcattcaacaaacatctatcaagtgactactacatcccaaatactcatcagggaatacagtgttgagcaaatatataaagattaccctaatggagcttagattttagcttcatagaaggaaaccccaagttaggagttgcacatgtttttgggaggtcctggacaaatgtgccatcatgttctcttgaccatttttcttgacatttgttgtcaccaggagcattgaaactaatgtgagatggaagactagataaaaaggaaagtccataagcctatctcatctatcctcctacagtatacattctctgaagaaaagatctgtgtttgattcacctttgatccccctatggcatgtccaactttgcacatgttaggcaaatgctatattctttgataaatacaaatacaactaaaatgatcatacatggtagtttgaaaacaaaaatcagaaaaatattttataaataaaatgggatgagaaaaggtaatgatgagattccagcatttttcttgttgttagggcttttcacactattgataagtccaccagaaaatgtttgagaaaggatagtctttatatatgggtttatatatgaattaaattatttggttttataattaggttttacttattctgagaagcaatgaactcacaaagtacaataaaaatataattcaatttgctaaaaaatgacttccgtgttgctttgcaggagcacatctattatataattcaggtgcacctgcctactttctggctcacacactctttgaacctgttttcagtgctgacaggttttatgaaaattatgacaggaaacaacaattataagcaataaacatttgctattgaattgctttctaaccatattaattttcattatcaccgtgtttagtggatatgttgaaaaacagaactgccctgaatatggaaaacaagactaattggggttaggcagagtgttttcccgctgcttccaaaagcctcttcaggcgatgctatttgaacacactccaaatttatttctcttccaattataaatgaaaaaagcaacaaggtctttatacgaaacatgtattaaacatcttacatatagtatactatattacttatagtattgaattactgggtactgactacaaaatgacatctaaaatatactctgcaatgtttgaatgtcttaaaagatcatatagacttatcaaactaattatattaactttgatatgattcacaaaataaagttaattttgagtcatgggaacatctaataaatcaagatggagaatcttttaagttcctaaattatattaaaaaaaatctcaaattggcaaaggaagctatgaaagcacagtattgagtttgaaataacttatgctaaaagtatggattatcatttttattattttttttaaccaagcatagttctgtagtatgaatcagggccactatcaataacaactcattgaaattttatccaagagagtacaacagaatattataaagaaaacacaaaagagatgagtatctttaccctgaacacaacgcaacttagcagaataaaagttagtgattctgaatagaaatgatgcccctttgtctacagcacaaatccccttagccttctataaaggccttctattagctaacctcagagtctgacacactaatacacataaagctacaaatacaatgggtcacaaattattcatatacaagttgattgtatttcttggtaccagaagaaacagaatattgtttgctatttctttataatggaaatagatttgatttactcaatagaaattaaaaattaatactactgatgtttttgttgagtagtttttcaccttccccagaaaggacatcgtacaaactctgtgacgaagtttataaaaaagaaggtgactgaaatgatgcaattattattttaatttaaaaatattacattttccacttatgagtctaattttattaaaatctgtgatttaaatgaatatcaccagtttataagtccatgtatctcctttcctgaagaagcattcattaaaaaaataagtctaaccaataatattcaaaggtttagaaactataattacctacatttattataatattataaaattaaatctcaagatacatgaaattttaaatactatatataaataagaatcaatttataattttcagtgattacaattaaaatgattataattatgattatcaatatcttaaatatttacatatagtacaaacactaaatataatactgtatatcctataatatagtatatataaattatactaaacttttttaccacattatacatttttgcttattttagaatttaaaaaatttagatttagatgacttgagtttcatagactaaattattacacttacttgaataatttcttcacattagacattcacatttctattaatccataaacactgataaatttgttaagtgctgataaaaatttactactctcttgttgctgttagtacagctgttatttttgctacatctatttttcccccacagaagagaacttctaaaaatcagcagaactaacatttctccttttgattgtacctacttcattccttcatttaaagcatgaaaagaactgctctacatctgaccaaagcaatgcacaaggaaacaatgttttagaacaccctttctcatccttcactgtcacttccaatctagcattactttttcatccctgatttctctgttaacagttgatcatcatgatttgctatttgatcctgtcaaaaatctgaggccccaaagctctgaccccacttcctttctcttactaaataaaacatcgtttagcacaccaacaagatcttcaatgcaggaaaaataaaactaggacaagaaaggtatgaaaaactatcaatatttctcattgtacttgacatgccataatagctaccattctctctctagtctattcttaaatcttttctactttagaaattctccctgagtgatctcatttgttcctataactttagctactttctaatttctgaaaactgtcagattttaatctttaacatagatagagcctgacttaacatattcatctgtttaatggacagattcacttggaaaaatataggtaacctaaacttaacatatttaaacccattttattatttttcttctttgaaatgtaatctttttcaatatagaattgataatacctttcttgttatcaacacaaatatatacttctattgcagctcttattcaactgcatagtccattttttttgtatgactcaccatgtgacagctgtgagttccttaaatgcaggcagagtggcttaattttttttgtgtgtcctcagaaaataacacatttttggcaaatactcaacgtttgatggctgaaaaaacatgcctctaatttttgtcttgcgtttaattttagaatttccatctatcaagttattcaaataacaattttgtcatagtcatccaaacttcttcctttgttcctcttcccatccttccactcaccacatcattctatatttggttatttaattcaaatggttcctcttcacttggaatgccatcttcttctgcctgtactatttgaatacctcctaacttgtcttcattcctttcatatctcctctgttaattactgccaaatggatgttatttaaacacaaatttgaatttattctgtttaaagagtcttccctggtccttcattggcagcaaatagtaaccctttcagtttggcatcgaagactgttcttaactcaccttccaagactgcctgattccctaattaccccatgtgatagccacactctactacttggcactttgaacattcattaattttgaaattaataaatttgtaatattgtaattaacatacattaatgattccattaatatacttaaagcatattggtctttacctcgtcttaaatcatttcagtaattttatcttttgaaaacatttatccctttcagagaagtcttcagacacattgccgttgatttatatatagactataatacttttaaagtatactttgtcaatggttatgtccttattttatctctgttgttctaaaatttcttccctcacccccagattaacctttcccagagacagagaaagccagcaagggtctgggctgctgtgatgctttaattaaaagtgttccactctgttctgttttttattgagggtacatgagtaatattttgcaaaatatgtttgcagagttttattaagaaagggcatgcaggactgacttcacatgtgaagctacaattaagctgctgcgtgctatgacccaggcctctacgttgatggtccccagacttgttcccatcatggctgggtggatcaggcactgagaacatgactcgtgctgtttaaacatgaccatgtgattgaaactaggtgccaattaattaattcttaaaatatatcactttaatacagcttgggatactgacattgtcttttttttaattatactttaagttttagggtacatgtgcaaaacgtgcaggtttgttacatatgtatacatgtgccatgttggtgtgctgcacccattaattcaacatttacattaggtatatctcctaatgctatctctccccactctccccaccccacaacaggccccagtgtgtgatgctccccttcctgtgtccatgtgttctcattgttcaattcccacctatgggtgagaacatgcagtgtttggtttttctgtccttgcgatagtttgctgagaatgatggtttccaaactcatccatgtccctacaaagcacatgaacttatcattttttatggctgcatagtgttccatggtgtatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatgggtgggtcaaatggtaattctagttgtagatccctgaggaatcgccacactgatacctacaatggttgaactagtttacaatcccaccaacagagtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaaatgtctgttcatatcctttgcccactttttgatggggttctttgttttttttcttgtaaatttgtttgagtacattgtagattctggatattagccctttgtcagatgagtagattgcaaaaattttctcccattttgtaggttgcctgttcactctgatggtagtttcttttgctgtgcagaagctctttagtctaattagatcccatttgtcaattttggcttttgttgccattgcttctggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagatttgtcaaatatcagatagttgtagatatgtggcattatttctgagggctgtgttctgttccattggtctatatctctgttttggtaccagtaccatgctgttttggttactgtagccttgtaggatagtttgaagtcaggtagcgtgatgcctccagctttgttcttttggcttaggattgacttgacaatgtgggctcttttttggttccatatgaactttaaagtagttttttccaattctgtgaagaaagtcattggtagcttgatggggatggcattgaatctataaattacctcgggcagtatggccattttcacgacattgattcttcctacccatgagcatggaatgttcttctatgtgtttgtatcctcttttatttcattgagcagtggtttgtagttctccttgaagaggtccttcacatcccttgtcagttggattcctaggtattttagtctctttgaagcaattgtgaatgggagtccactcatgatttggctctctgtttgtctgttgttggtgtataagaatgcttgtgatttttgcacattgatttagtatcccgagactttgttgaagttgcctatcagctttagaagattttgggctgagatgatggggttttctagatatacaatcatgtcatctgcaaacagggacaatttgacttcctcttttcctagttgaataccctttatttccttctgctgcctgattgccctggccagaacttccaacactatgttgaataggagtggcgagagaggtcatccctgtcttgtgccggttttcaaagggaatgcttccagtttttgcccagtcagtgtgatattggctgtggatttgtcatagatagctcttattattttgagatacgccccatcaataactactttattgagagtttttagcatgaagcgttgttgaattttgtcaaagaccttttctgcatctattgaggtaatcatgtggtttttgtctttggttctgtttatatgctggattacatttattgatttgcgtatgtggaaccagccttgcatcccagggatgaagcccacttgatcatggtggataagctttttgatgtgctgctggattcggtttgccagtattttattgaggattttcgcatcgatgttcatcagggatatttgtctaaaattctcttttttggttgtgtctttgcctggctttggtatcaggatgatgctggccttataaaacaagttaaggaggattccttttttttctattaattggaatagtttcaaaaggagtggtaccagctcctccttgtacctctggtagaatttggctgtgaatccatctggtcctggactttctttggttggtaagctattaattattgcctcaatttcagctcctgttattggtctattcagagattccacttcttcctgatttagtcttgggagggtgtatgtgtcgaggaatttatccatttcttctagattttctagtttatttgcgtagaggtgtttctagtattctctgatggtagtttgtatttctgtgggatctgtggtgatgtcccctttatcatttttttattgcatctatttgattcttctctattttcttctgtattaatcttgctagtggtctatcaatgttgttgatcttttcaaaaaaccagctcctggattgatttttttgaagggttttttgtgtctctctctccttcagttctgctctgatctcagttatttcttgccttctgctagcttttgaatgtgtttgctcttgcttctctagttcttgtaattgtgatgttagggtgtcaattttagatctttccttctttcctttgttcgcatttagtgctataaatttccctctacacactgcgttgaatgtgtcccagagattctggtatgttgtgtctttgttctcgttggtttcaaaggacatctttatttctgccttcatttcattatgtacccagtagtcattcaggagcaggttgttcagtttccatgtggttgagcggttttgagtgagtttcttaatcctgagttctagtttgattgcactgtggtctgagagacagtttgttataatttctgttcttttacatttgctgaggagtgctttacttccaaccatgtggtcaattttggaataggtgtggtgtgatgctgaaaagaatgtatattctgttgatttggggtggagagttctgtagatgtctcttaggtccatttggtgcggagttgagttcaattcctggatatccttgttaactttctgtctcgttgatctgtctaatgttgacagtggggtgttaaagtctcccattattattgtgtggtagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccgttttttgttttccatttgcttggtagatcttcctctgtccctttattttgagcctatatgtgtctctgcacatgagatgggtctcctgaatacagcacactgatgggtcttgactctttatccaatttgccaggctgtgtcttttaattggagcatttagcctatttacatttaaggttaatattgttgtgtgtgaatttgatcctgtcattatgatgttagctgcttattttgctcattagttgatgcagtttcttcctagcctcgatggtctttacaatttggcatgtttttgcagtggctggtaccggttgctcctttccatgtttagagcttccttcaggagctcttttagagcaggcctggtggtgacaaaatctctcagcatttgcttatctgtaaagtattttatttctccacttatgaagcttagtttggctggatatgaaattctaggttgataattcttttctttaagaatgttgaatattggcccccactctcttctggcttgtagagtttctgccgagagatcagctgttagtatgatgggcttccccttgtgggtaacccgacctttctctctggctgcccttaacattttatccttcatttcaactttgttgaatctgacaattattttcttgaagttgcttttctcgaggagtatctttgtgggattctctgtatttcctgaatttgaatgttggcctgccttgctagattggggaagttctcctggataatatactgcagagtgttttccaacttggttccattctccctatcactttcaggtacaccaatcagacgtagatttggtcttttcacatagtcccatatttcttagaggctttgttcatttctttttattctttttgctctaaacttctgttctcactttatttcattcatttcatcttccatcattgataccctttcttccagttgatcgaatcagctactgaggcttgtgcattcgtcacgtagttctcatgctgtggttttcagctccatcaggtcctttaaggacttctctgcattggttattctagttagccattcgtctaatttttttccaaggttgttatcttctttgccatgggttcaaacttcctccttttagctcggtgtagtttgatcgtctgaagccttcttctctcaattcgtcaaagtcattctccatccagctttgttccgttgctggtgacgagctgcattcctttggaggaggagagctgctctggtttttagagtttccagtttttctgctctgttttttccccatctttgtggttttatctacctttggtgtttgatgatggtgacgtacagatggggttttggtgtggatgtcctttctgtttgatagttttccttctaacagtcaggaccctcagctgcaggtctgttggagtttgctggaggtccactccagaccctttttgcctgggtatcagcagcggaggctgcagaacagcagatattggtgaacaggaaatgttgctgcctgatggttcctctggaagttttgtctcagaggagtacccagccgtgtgagatgtcagtccgcccctactggcaggtgcctcccaattaggctactctggggtcagggacccacttgaggaggcagtctgttccgttctccgatctcaagctgtgtgctgggagaaccattactctcttcaaagctgtcagacagggacatttaagtctgcagaggtttctgctgccttttgtttagctatgccctgcccccagaggtagagtctacagaggaaggcaggcctccttgagctgcggtggcctccacccagtttgagcttcctggctgctttatttacctactcaagcctcatcagttgcggaggcccctccctcagcctcgcttctaccttgcagtttgatctcagactgctgtgctagcaatgaacaaggctgcgtgggtgtaggaccctgcaagccaagcatgggatataatctcctgctgtgccgtttgctaagagggttggaaaagcccagtattagggtgggagtgacccaattttccaggtgccatctgtcacccctttctttgactagggaagggaattccctgaccccttgggcttcccaggtgaggtgataccttgccctgctttggctgacgctcggtacactgacattgtcatgatcattgtattgtttcctacagccatgctaatggaaggaggagaatatggaagaaaattataattagtaagtcgttggtaatgaaaaccagaacacaaaaaaattggacaaattacaaaaagagacattttggcaaaaaatgtttataaaaagtgaaatgtgttaaagaatacctcatgaatactaggaaaatacaaatttcaatcactattaggtatcataattttatatctttcagactggaaaaataaatctcataattgcaagagttggtgaagatgtggattagatgaaactgttacatcttactgggtctagtaaacattttgtacaacacattggaaaactatttggcagtatccagtaataattaagaagtatgtaacactatcaatcgttttcctagatatttctagatctcttgcaaatgtactcaaggaagcatatgtaagaatatccagaatagtatattttgtactataaaataagaaagacaaatttccattaatagactatcaaaagtatgaattatgatacaggtatagaaaggaatactatagagcagggaaataacttctacaaatataagtggatcaatttatattatggataaatttctagagcatattgagcaaaaggagcaagctgcaaaacaatactgcatttgttatttacataaatttttagaaaaaataaaataatcctatctattatttagtgatatatagtaagaatacaaataaacacatggatgataaagataactcagggtagtgtttattcctgaggaggtggtagggttatgcaaagtcttcaaatgtgttagtaatgttttctttctttctttttttttttttttgagacggagtcttgctctgtcgcccaggctggagtgcggtggtgccatctcggctcactgcaacctctgcctctggggttcaagccattctcctgcctcagcctcccgggtagctgggactagaggtgtgtgccaccacgcccagctaattttttgtactttttagtagaggtacagggtttcactatgttggtcaggctggtctcgaactcctgacctcgtgatccattcacctcggcctcccaaagtgctgggattacaagcatgagccactgcacctggccgtaatgttttatttcttacactaggtagcgggcatacaaattattgttacattattctttatatctttatgcaagacaaattataaagtcattggtaattataaaaattagcacccagaaaattagagaacacttataaggccacagtgagatattctaatgcctcaatccttctaatttatcttctgtcctcatcattccagtgaaacaactgtcactaaaattatcattgaattcaatggctcattaagatttcaaaatacagtcatagtaattcatattttatgcccatttttccccctttggtatggctagtatggaaagtctttggaaatgagtgtttgagaatgacaatgaataataattagtaagtagtaagcctaattaagcatggttgcaataatagcccctgtttcagatgtgatcactttatgaaaccaaataaataatgttttctttacctagtatgtaaatattcagcaaagcctttttttctctattctgaaaagatgggaactttagaattagtttgcctttgcctagcaaggatgaaattataccttcacagtcttgtctcaaggttatatcaactctccaacactgtatcacaattcaatctatgaggaacttgtttgccaagtattctgtttgatgatcttccatgttgatgatatcttgttgacaatatctggtgatcggacacagaaatagacagtatctagatgccttaataaaatatatgagtacttaagcatggaggataaatctcatggaaattaaggaagctgacacttaggaaagtttcatgggtcctttcatctagagcattcctttcacctaaaatatccctttccaaacagaaaaagttactgctagctggtgggttaactacaaccataaaggagcatgctgaggacaactggcacactaagaataacatcacagagaatttgaaaaaaattgtatctttttctgtatgattttcaactcaagaaatatatttaaattattgctttatatagataatcttttcctttttgattatttgagactgtaattctgaaacagtttttcttattctggaaaatttccttttcaagatgctaaaccgtctcagttttttgtttttctgaggatatacttatttggaccttattgtctaaatgaaggtttacctgtgcagatatttctagactgatatttagcttctctgtgcaatttgaaaatattatttcactcttgatttaaaataattgtatatatgctagaataattatactactttctgtcaatcatttttaacttatcttgcatatttgctttgtctctctctgctacattattcaggcctaacttcctgttctttaattcttttcttagctatacctaatctgctgtttaattcaccttttaaaatttcaatgatgatatattttattacattgcctggaattttgtgatagtttctcttttgccctgcttgtttttcaatttcctatggcattttcctgagcatttaacatatattagttttttatttttgagtttaatgaatctcacagccaaaatcctttggagtataatgctgctgtttattttttttttccacagcattttgcctggggagctcatctgttttagctggtattcccttttttattatgtggtttttttattgatatttattggtgaggatcaatagtaacccaatttgtagaatttacatttgcaaaagtaaacttacatttgcttcttccaaatatcctgacactttcatactggcacttcttatatttctagttgagaatttcttcaaccacatttgtaaaataagttagaaccctgaaccttacatgagagaagggtcattaaagaattcttagggtagggggtggttacttacccaactgtagctgacgtggctgagcaccagtagttttcttgttgcttttcttttctgttaggcactccccctcctccacctgctcattgtcattgaatctgaagtcccttggagttctaaactttatttattaacagttttcagtttcaactcttgattttgttcaggcacaaagatctttttttttgtgtctcatgctggccttgaaatcctatatcttaagtagctaaaaccagcaaatgttgtggtatcactgtctgtcatgcttttaaaaacggattcctctcagttttttggctcttactgcattcctttattttggaactgtggaaatgacattctgaactcaactacaaattcaaaagaatgtttattttattttgtccaacattttaatagatttttttttttagtgggaaggttttcagactatcttctgtgccaactgtcaaaagtagaatcccagtgctatattttgaagattgtgtagattatttgaaacccaagtaacagcaccatctctctcaattagacttgcctggagacctaacagcaaaagtttccttaaaagcacagacgaatcaaaaagcctaataacttatagaataaataatggtttcttcagtatttcttattcatgtatattcatgatgcatgcatgcacataaaagcaaaacaaaatgagataaaatgttttgagaacaaaaacaaaaatagaaaaccagaacaaaacagaaaccacaaacttggcaacaaaaaaaaaatgattttgtttgttaggtttatcggtatgtctctacaaatatgaaaaatgtagagtaatagtctaatagtctagttcccattttttttggcaccagagactagtttcatggaagacattctccaaagactggggtgggatgggggaatggttttgggatgattcaagcccattacgtttgttgtgtactttatttctattattattacattgtgatgtataatgaaataattatacaactcaccataacatagaatcagtgggagccctgagcttgttttcctgcaactagatggtcccatctgggggtgatgtattagattctcatagggagtgtgcaacctagatccttcatatgtgcagttcccaattgggtttgtgctcctaggagaatctaatgccactgcttatctgacagcgggtggagctcaagcagtaatgagagtgatggggagtggctgtaagtacagaggaagcttcgctggatcacccaccactctcctccttctgtgccgccggttcctaacactccacactgataccatggcccgggtgctaggaacccctggtctatgccacttgtagataatttaaagaattgaatgtgtagcataatattcttctttatgtttttgaaataatgacttttaaatataatattaagttcccaagtatttcaaagtgtgggtaaaatacatagaaaattgccagaaaaatactgaaacacacttaagaaaaagcttagaagattttttgaagagtaaattttttaaagtaaatagctatcattttcaagagtgaattttggcagacttttctgactattaaaatgatgaatattgacaataacactaattcataaaaatatcttaaatgataataaaaagaaacccttcccataaggcaaaaccaagatgattaagctgccaatcagaaaatcttgattatatcaaatactctagtccatttaaaaatagccattgtttatgataaactgcagttgaatgaagagaatatttttcaaaatctaattactacatcaagtatttgtatcaaaatgagtttagtattttttattttacaatagattataagcaaagaaaaatctaaacttttacataatgatttttaaaatactaccaaaattcttgtatatttgattcacattgtgatgattatgattattttgattgtaaaagcgacattaccaaagtaaaataatagtttcatattgtaatataatttgatatttattaaatggatccacataattaatgatgttctttttttagctatcaacatacctttcagaaatacaaacatatcttttttttcatgacttcaaatatctgtagtgattttttcccaacctacaacttcctagcttagtagagggcagagcattcacatgtaattaaaaaaatccttacttaacagagaacatttgtagcatggtgtagaagaaagggaatatgataggtagagaaaaaagatgccccacatgatgcctttacaatagaaacagtttaaagcctggatgatgatagaacaagatggtttgaatcaaactcctagaggaagaatatactgcaagatggtggttatgggaggaaaatctttcctacccactctatggaagaattgtaaactagataaataacttaccagcaaaagaaaaatgttataaactaacatgaatactattgttaaaatgccagaagacattatgagataaggaaacacttattcattataaaaatatttcaaatgaacttttttcaacgtgtgagggaggatcggagatatactagaagtagacccttaattcacagaatttccactctaactgggaagttagtcaattaactacttcaggcagcatataattagctacttataccaggagaaagaggcaagaacatgagcaaggggagcaatgtagcaacctggaaggtacattgagaaaagtctgaagttcagttggccaggagcacagactatgcgagattaataggaaatagagctagaaagagaggtaggaggaggatcatagatggtgatatgccagaataaagaaattgagtttcattctgcagtcaggaacattaaacatctatgagcagagaagcagcaacattagaattgctcatcagtaacactaagctctcagcaatgtacaagcagcttgaattaggaagagcaagaagtgtttttaaaaaagctttaacaatagtacaggtgagaggaaatcaggatcaaattaagaatgagggtaataacaagaaagagggaagagactggaaagactttctgagctaggagagacaggacttggcaatgagtatgttgtgggttaaggtgaagtgagatcttaaggtgaaacagcaaagttttaaagtctgagtgacctggataatgattgagacagaaatgaaaatgggaaaccgaggatgaagagttgagcagtgggagagtaatgaaaccagtatgtacattttgattttgttgggtatttatgtggaaataatcagtaggtggtttcaaatatggaagaaatgagagctggacataaaagctgaagagcttaccacaaagatggaatggtaaccttataggaatctgatatcaagttgggtaaagataagatgcattttttgaattgctatgataaagaggagatgggagaaggagaaatcaggaaggcaggaaataagaagtcctcttgtactgaaatctgatggagggagaactaccaggaagcaggattagctggtagtaggaaggagagagagagtgagtgtgtgtgtgtgtttgcttatgtgtgtatgtacatgtgcaatagctagcaagcacataactgtttagcaaggatggacccaagtgaatacagagaaggaaataaattattctcattttctgttttactgctttagtcattagctaaaatcttgcttcaggttgtaggtgccttgaatatgggatgaactgaatttaatgatagtagtttactttgttggacctctaaggggtgtcttactatagtagtcagttcaaagcctctggttttaaaagagcttagaagtcagctactttttactccttcaaaagatggtaatgtctctatgaaaatgaggatgttctgggtaaaactcacttataatatctctcttctggcaagctttttttttttttttttaaagaaatatacagtagtttccaaacttgttattttgcagcattcccactaatcctgtttagtcttaaaattgttatgacatcttgttttggtagtcacgaccatcaacagccttttaagtcaattctctttataaactgtacaaatcggctactatttgtgtgtcctgggactagataaagtatgaacagcatcatattcagttcaaccaatacagataattttatgtttctgaggcagacactgagaaatagagagatgaatgaatgagagagagggggcggggagagacagaagatgaaagagagcagaagaggatgaagaggagaactaggagtaagaggaaagaaaattcaaagtgtgaggaagcagaatcatcagaatctgcaagatggtggttatgggaggaaaatctttcctacccactctatggaagaattataaactagataaataaataaaatagcttttattgaacatcgctacgtgccaggcaatgctctcaaaagcactattatctctgtttttgaaaattaataaactttatttattagagtattaggctcacagaaaattcaagagaaaagtagtttgcatatacttcctgtccctacacatgtacaaccttctccactaatgacatctcacatggattgttacaatccatgaacctatactgaaacatcgtcaaagtctatagtttacgttggagttcactcttggtattgtacattctatgggttttaacaaatgtacgacatgtccatcattgtaatatcatatagaataatttcactaccttaaaagtcttctgttcagcctattcatccttccctccctctcatcccctggcaaccactaatcttttctctttcactatagttttgccttttccgtaatgccaggcagttgaacttatacaataggtagacttttcagattgacttcttccatttaataacatttaagtttcctccatgttctttcatgacatgatagctcatttctctttagcactgaatagtattccactgtctggatctaccacagtttattaacttttcttgcttcgaagtctgctttatctgcaatgaatagagctactccagctttcatttgattagtgttagcatggcatatctgtctccatctccttacttttaagctatatgtgtcttcatatttgaagtgggcttcttttagaaaacatacagttgggtcttgtttttgatacattctgaaaatctgtcttttgttggtatatttggtctattgatgattaaagtaattatttatataattggattaatagctaccatatttgctggtattttctatttgttgcctttgtcctttgctcctatttttgtcttctacatttttatgccatttgtggttttaatggagtattttatgtgatttcattttctttcatttcttagtatatcaattgaactttttttaaaaaaacttttttagtggttgcactagagtttgcaatataactaatttagaactaatttaagtactttcaaagtactccctggcaaccaatgtcctcaatttttgtttgcctgaaaaaaaatctttgatgaataattttgcagatacaatagaaaaaatatgaacagatcttttgaagaataattctgcagatacaaaattataggtagtgttttttttctgaacactttaaatatttcattcctttctgtttttgtttgcatggtatctgaggagaaatccagtgcaattctttgctcttctatagggaaggtgctttttcctctggcttcttttagaattattttgtcttttattttctgcattttgaatataatgtgacttcatgtagctggttttgtgtgtgtgtgtgtgtgtctgtgtgtgtgtttttggcatttatcgtgcttggtgttctttgggcttcctgggtttgcggtttgatgtccgacatgaatttgaggaaactcagccattattgcttcaaatatttcttttttccattctctcctttttcttcttctgatattctcattacatatgtgttataccttttgtagtcatctcacagatcttgggtattctgttcttttttcccagtctttttttttctttgtttttcagttttaggattttctattgacatatcctcaagctcaaagattcttttctcagcagtgcccagtctactaagcccataatggcatctttcatttttgttatagtatttttggtctctaatattcctttttattcttagaattttcatctctctgcttacattattactactatctgttcttgcaaattgtcgactttttccactgaagccttcagcatattaatcatagttttttaaaattcctgacctgatgatttcaacattcctgttatatctgactctggttctgatgtttgtacagtcccttcaaacagtgtatgagttggattctctagaggaacagaactagtaggagatatatatatatatatgtgtgtgtgtgtatatatatatatttatatatatatatatatatatatatatataaaggggagtttataaagtattaacttaatgatcacaaggtcccacagtagcctatgtgcaagctgaggagcaaggagagccagtccaagtcccaaaactgaagaacctggagtctgatgtttgagggcaggaagcatccagcatggaagaaagatgtagctgggaggctaggccagtctctttctcacatttttctgcctaccttatatgtgctggcagctgattagattgtgcccaccagataaagggtggatctgctctcctcagcccactgactcaaatgttaatctcctttggcagcaccttcacagacacacccaggatcaatactttgtatccttaaatccaatcaagttgacactcagtattaaccatcacagtgtcttttgcctcctagtattcctcatatttttttgttgaaaggtagtcataacgtattgggtaaaaggaactgctgtaaataggcctttagtaatgtagtggtaaggtgtagggtgaggggaagagttctatagctatgattaggcctcaatcttttggatagccggtgtcctcagactaggaacttaccagtacttcttaattccctttccctactcttaggtgggaaaggatagttggagtgggcaggagctgtgtatttccctttcctgaggtagtttaggctctgataaaatcccagaaggttaggttctgataaaacagtttctcttgagggtagatcttgttgagaagaacagaatgctctgtcatatttcaaaatgactctttgcttttcctcttgctggaagcatgaaggaatttttctctgacattgattttgaggacctgatagggttactgaggggaaactcaaaaaagtgtgaggaccctcctatgtttgtgtccccttggaattttctcagacttgtctacacccagcttccagcaacttgtcaattacagttcacatttttgtaccctgggactggttctcacggagatttctgctccaataaattataattctctgtattcagctggctgtttttccaatgttgagggctgttgtttgccttgtgacattacttctctgatggagctcattaaagtttttgtttttttagattgttcagctttttgcttgttatgacagaatggtgacttccaagctccttacataatggactggaaatcagaagtccactactgcttttttttttttttttttttgagaagatagctgaatctttaagcctccgtaaaaggaaagcaattttctgaatgttgcagttagaaacacttgcctttgaagactaattctgctgcttattaattctaaaattgagaatcttaaaatgtcacctgactctgaaaaggttatggaagaatgactcccacacagaggttctattcctgactgccatggtcccactttccacccgatctctcctcctcactaacgctgttgccttgaagactttgtctgttattggaccccatcatccccataatattccttccacattactctaacaatgatattgtctaacatgttttgaactctcatttggtgagagctaaatatgatttttacttggataatgtattttgaccttaaatacaactctatggttacccccttttacaaaggagaaatcaggcacctggaaaggtcaagtaacatgctcaggaacaagtaaaggtcacgtaacactctcaagaacatgttgctaggaaatgtcaacttagatgctataacttcagagaccttcctctgtatattactgctattgcattcagtagaacatttacatcagctgccttatgtgtttggataataaactgtatttttgtattttaccattttgcaatatgaagtaactaactctgtaaacattaattattactctatcattattacatctttcctcccaattttatgcatataataggtttttaaacatttttgtttttcctcactctactaatactttacacaaagcatcacactaagttttttactttcttcaaccttcctattttcttcattattccatccttaatcctattcatctgtccgttctatttctttcatttctttgaaacctgtggaaaggcattttaaataattatatttctatgtaatataaaataatttttagtttgctatatctattttgagatcacaaatgcaatgccactgatataattatcaagttatctcatgcactggaaataatcacaaactctaaaaaagttaatgaataaatgactaccaactgtaagggattatgactataaccacatgagtatactatttcactatttgaaatgcctcacatgcaaggagaacttggacagatgaaggtcaaaattcagatataaacctaaaaaggttcagtagtacagttcaatgggaaaagtacattagaaagtccatgaattgctaccacttacatgcctggtctttttatctgtagcccatatgacagcacagtctcattcaataaaactctttgattttgcctaagaaccatgagtacaaaaacacttgaatatatgggaagttgttgggttcaagtgtggggcaagcaatgggtatgaaaataagggaaagtttgaaagttcatattgtaaaccaattttctctcttctattaaaaactaatgggatagaagagtgcttccaaagaaacctcttagaaatcacagctagagattgcaaacacattgtttggctggtaggctccctgtctttttttctataacagaatataggcttctgttggattaaggataaaaatacattgtaaagtgctacacggtatgaacctggtgattaacgatattttgttcacatagaatctaaagaatctttttttttaaaaagtaagcatggaggaaatttaaaggctttcttactccctctttctacactccacttcacataaataatatagacattggggtaaagaatgaagtagaatattttatatatgtatatgtatgtatgtataacttagacatactctcagattactccacattgacctttaatgatactcagatttctcgcattaggcactgaggggatggatataccatgttataaaaaatgttggtggatgactctgtgtgtgtgtgtttgtagatcagaagatcagttttgaatattaactttgatatctaaaaagacatcagagtgaagatgcctgtatggtgtttgttggctatggctatatggatctgaagtttacaggcatgatctattctgaagatgcacattttagaattaagggaattttattaattgaagctgagcaatgggtatgggagagatttattttatatatgtatatatgccacatttttattttaggtgtgagagatttctttagagaatatgggaagataaagaagaaaatgaggtttgatattaggacctaaggaactgtaaaaagtgagaggatatagcaaaggagtctaaaaaaggcagacagagaggcaggcaccataaggaagtatggcattagaaaagctgaaaggagacagtattttggaagaaagaaccctcagttgtgtaaagtttctagatcagcctgtgttacagcagggctagggagtaaggaattggcagtactgaattagaacctataaattaatatttgaaaaaaggagaagaatcatagggcagtagctgcacagtagtagatttttggaggaattttattgaatgggaaggactagaggagtttaaatgctgtcacaagggcctagtagaacaaaagaagttgtagatccaggaatgagagtgaacatttcatagtttctgttacagggggaatatgatctgagttacttagggtcttaattacaaaaagtaaaattcactctactagtttaagctgaataaaatagttgtacctcattggcagagactctgtcatatgtttatgtctgccttagaaggcaggggttatgttgtagaggcaaatctcatagcaagatattttctaaaatacagagaaggtattataaagatgataggcacccaccataggagaaaaagaggctataggagtcgagcacggatggaagaattggccttaattagtagtttagaaattgtctccatggcagtgcggataaaaagcaaatgggtgatgatctgaaagttttgaaagttgccatctgagggcaacaattttttttctcagaaaagtaggacacaaattgagaccgaaggtaatagtgaatgtctgaggtttgaaaatgtggaaaagattgaaaatagtcattgtggagatagggagagaaggctgagaaaaatgacataatatttatgagctgtgtggaagtttcagtgtaaagtggtggccatgaatttatagtagtaccaatcttcccagctagatgactttatttttaaatagtaatcagaagcctgggtgatgacatggagatgacagatacccaggcttatccagatttaaattctggttgaaagtcctgtgaaatggtagagaagaatgaaaatttaaatatattagaaagaaatatattatggaagcataaataccaaatacattctcatagccacatactgccattggctaatgttatataaaatcccaggtgtacttgagccattagtgtctgctcataaggacagatatttatccctattatatatttaattttaattgagttgctctgttattccatgcagctggttaaaattttttggctttgattttgtcatcccttacattacttttctttcaggctttatttcacctgaaaatatgataaacagataatatcttaatccaaattactaatgaaaatgttgaatgagagaaggcaaattatataaccctctaatatgttgttttaaagagtttaatccaaattcttagatatggggattttaataatcattttctcagtgatagaatcacaaaattttatagctatgccatacctggactccatgcatttttttcacagccaagaaagctgttggtcaagaagtttaattgatttttcccaaagcagcgactgggtggtggacgttcaacaccagactgagtttgtatatatgtattttttattttttaactgtatattgacaaattataaggtatatgtttatggagtacaaagtgacattatagtatatataaaatatatacacacacaatgtgaaattattaaatcaagttagttaacatacccaccatctcaaatacttaccatttaatcctcctaaccacaacattatacattgacaaccagttctggaattggtggctttttatacactagtcttttctatcacatgaaacaagttcttttcacattcaaatggtttttgacatattaagtaaatttttattttctatgaattaaagaataaaaatttacttaatttttattatatatatcttctatatatctagaatagatatatatctagaataatatatatctataatatctatatatctctctatatatatcttcaggaaatttgattctccactttttagtagttttttggttacaaatgttactgtgaatgaggtcccagggggagttgcattaatatcatctatcccccagagattgtagtcaggagacactgcactggcatcgtgaaaatgaaaatgcaattacaacaatgtagagttctgtaattataaattaaattttcattctatctgttccttaaggttatgttgattgaaaactgaaaactagttttgccgttaccagttgataaacaaaaagtttatcatagacaaaatgcagactgtaatatgatatacaaagtccatttgaaactatttttcaacctgtaaatgtaattataattagagttatactaagttataaacttttataacagtaaatgtcttttatttgttccaaattgggaacaaattaaaatttagttttaagaatgttttcacatttaatcactgcagtactataacataggctttgaacagtgatactggcgtttgaatctcagatctgttatatgatagctgtggttgaatattatgtaatctttttagcttcagttcacttgtatgtaaaatgagaagcacattacctgtctcattaggttgtgagaattaaataactatatttgtctctaaagtacaaggaacaatctctagtttacagtatttactccgtaaataacagatatgacttttgcacttatagaataagaaagaagggagcaaaaattccttgacagcattttagcaagatagaaccctctattgtgtaaaaagtttctagatcagcctgtgttacggcaggactagagggtaaggaattggcagttctgttctctttttctgaatggagttagttttaattataaactttaccatgggaagcatctagagatacatcacatataattttggtaccgtattttaaatgttataatggctatattcttttatatttcaactagtaactgtgaagagtgtttcttactgtcctgttttaaaacagctacgaaagttgctaacatcagtctacatcacgagttggcaagcaggttaaatccagcatgctttcagtttttgtaagtaaaattttattggaactatgcccattcatttacatattttctatggctgctttcacagtacactggcagaattgactggttgtgtcagactatatgacctgctaaacctaaaataatttactacctggccctttacagaaaaaaacttaccagcctttgttctacttgatttaaaccatgaaagctatgaggaaaaagtggtaaatagattgaaaaaaatttctccagacaatattatgagctagatttgaaaaaacattgatatataaggtgcaaaattctggaatttactaaagaagttataattattgaaatattccctggtatttttgtcttctattatttgctatccattatactttttattttaaaattttatttctggtgtttattgtttattttattagctttattcttcataatgcctttctaaactcaaaaatataccacctaaagggctgatatctgcaaggtggtagagtagaagactccaggcttcatcctgttaaataacaattagacagctatccatgaacaaaaatagccctaggaagagctcaggagtctcatcaagaacctatagcagcacaatagggcaaaaacactaaataatcgcatagagaggattgcttgggtgattgatgtgccagaaacatctagagatagctaggtatgaagataagggaaaggggctatcactgtcagccatgcagtgagtgccaccttgctttctagtggcttactctgcagagaattctggcagtcttagtcacagggctgtcaacagccaccatagtaggtgtggattttccatagatttcacagcaaggtctccttagtgtttgtaggcatggaccccagtgcctgttccacagagaactctggcagcttttgccactgacgtaaccaagagctgctatagtgctgaagatctccaggggagggagatgctgcttcccctcgcccaacccaacaagaagctacagatgtgcttccctgggacctagatccccagctcccctgcagccccatacatgcccctgaccctggagctgcggccactctgtgccttgatcattggagccactgccaaaatgaggtagtctgtgccctggaactcagacttgcagtcactttatgcatgcccaagctctagaccttggcgctatggctgctccaggagtgcctacaccatggacactgaagctacctctgtagaaggtacatctatggcccagacccaggaacagtggttgctctgcacatgagtatgtcccagatcctggatttcaggcttctctttaagcacctgtgcttcatgcaccaatgctgcagttcgggggtggggttggagagaggtctgaatgccaccattgccctgaaccctggaactgtagtcattgtgtgtcacttgtgctccaaatcccaactctgtgctcactacccaggcgccacacaccaaacaccactgccatcaccactgtgagcatgctcataagctggacctggcaccaagaaggatccttttggccatgattttccccatgagagaaaaagagataaggaggactccagcagccttcaccactaaagactccaacagcccttgccactactgtggatactcatagttttagcagctgaggatccctgcaatctttgccagccttgatctcagctgatggaactgcatagagtctttacaacgacaccctcacctagccagaaccacctgaccctacccagctggtgtcctcacatccacccataggcaaaggtctttacccacttaaaccagtgcaaaaagtcttgaagaagactgttctattaaatgtgcaaacattaactcaagatgataaataaaaatcaaagaaacatgatatcacaaaatagaacacacacaccgtaatattctagtaacagacttcccaaagtggagatctatgaatttcctaacaataaattcaaaatattaggttggtgccaaagtaattaccattaaaagcaatggcaaaacccacaattactttggcaccaacctaataagctctttaagaaagcttagtgagctacaagaaaacataggtagctaacccaacaaaatcggaaaaataatacatgaaaaaaatgagaagttcaataaagagatatcacaaaaaagaaccaaagagaaattcaggtaatacagaattcaattaatgaaataaaaactgcaatggagagcatcaacagcagacaaaatcaagcagaagaaagacttgacttctgtggacctgaagacaggtcatttgaagacgtccaaaagtctctcaagtcaaaaacaaaaagaattttgaaagcaacagaaaaggaaagaactttttaacatataagaaaacccctatatggctatcagtggatttctcaggaagaacttcgtagtccaggaaagaatggggagatttaaaatactgaaagaaaaataaaacctgccagtcaatattttatcctatagtagatacataaaatgagaaaagaatcatagcataatactgtagaacatcatcaaatcacaaagagacagaaaggaacaaagggttgacaaggtattaacaaaatggcaatagtaagttattaccaatcaataattaccttgaatgtaaataggttaaattctccaatcaaaagacatagagtagataaatgggtaagaagaaaacactcaaatatatgctccctactcacttcagtttgaaggactgaaagataaaatgtctttaaggactgagagagcaaattaagttttaaagacaacatagactgaaagtgcagagatgaataaaaacattcaatgtaaacggaaagtaagagcagaggtgtttatacttatatcagacaaaatagtttttaagtcaaaaactaaagagagacaaagaaggtcattgtataatgataaaggggtcactttattaagaagatatgccagttgtaaatatataagtactaaacatcagaacacataaatatataaagcaaaagatctgagggaagagacagacagtaatataaaaataatagaataaaatttaatacctcactttcagcattggataggttatcccaacagaaaatcaataaggaaaagtcacaattgaattacaatttagaccaactgaacctaatagagatatactgaatattgcatacaacagttgaacaaagcacaccttcctcaagcacatgcagaacattctccagcatagattgtattttaggctacaaaaaaagtcttaacaaacttaagaagtgtattttctgatcacagtgttataaaactggaaatcaattacagaggaaaaactagaaaattcacaaatatgtggcagatctaaaatatcataactttgtacctcaaggaactagaaagagaggaacaaccccccccccaattagtagaaggaaataacaaagaccagagcagaaatgaaggaaatagaaactagatgaacaacaaaaagatcaatgaaactaagagttggttttttaaaaacatcaacaaaattaagaaagctttagctggactaattaagaaaaaagagaatattcaactaactaaaatcagaaatgaaaaaatacattacaataatgtgagataaattagaagaacaattacaggagactattataaacaattatatgccaacaaattggataccctagaaaaatgaaaaaaatcctagatacaacctaccaagaatgaatagtaaaaaaaaaattcttactcaacatagtactagaggtcctagccagagcaattgcacaagagaaaaaaataaagggtatacaaattggaaagaaggaagttagattgtccctgtttgcagataacatagtcttatatatttaaagaaatctaaaaacttcaccaaaacctcttagaactgacaatgataaatgcagtaaagttttgggatacacaatcaacatacaaaaataagtagcatttctgtatactgataatgaattagctgaaaacatttcaagaaagcaatttacaatagctataaaaatacctaagaccaaatttaagcaagaaagtgaaagatctctgcaatgaaaactataaaacactgatgaaaaaaaatggaaggggacacaaagagatggaaggctattccatgttcatggattagaataataaatattgttaaaatgactgcatttccccaggtgacctacagattacatgcaatctctatcaaaatacaaatgacattcttcacagaaatagataaaactatgctgaaaatttgtataaagccacaagccatcttgaatagagcaattctgtgcataaaacaaagctggaggcatcacatgatttgacctcaaaatatactacagagctatagtaaccaaaacaacatggcattgacataaaaacagacacataggtcaatagtatagaatataaaatgcagaaataaatccatgcatttacagctggctgatttttgacagcagctccaagaatataaattggggaaaggacaggctcttcaacaaatggtgctgggaaaactaggtatccatatccagaaaaatgaaactagatccctatctctcaccatatacaaaactgaactcaaaatggatgaaataattatatgtcagacccaaagctattaaactactattaaaataagttaaacacttcagaacatttgtttgggcaaagattttaatggagaatagctcaaaagcacaggcaacaaaagcaaaaatagacaaataggattatatcaaactaaaaagtgcctgtgtgacaaaggaaaaatcaacagaatgaagagacaatctgtagaaggagagaaaatatttgcaagttatttatctgacaaggggtaattatccagaatctacaagaaactcaaaaaaactcaacagcaaacaaaaagaaaaacagataataataatctaattttaaaatgggcaaatgatctgaatagacatttctgaaaagacataggaatagccaacatgtatctgaaaaaatgttcaacatcactaatcagggaaatgcaaattaaaatcacaatgagatatcatttttctccagttagaatgactactaacaaaaagataaaaaataaatactggtaattatatcatgtgcattctgtaaattaaattttgttttttaatttgagtgatagagttcacttttatgttactgaactggtttccataatcatttgattcagatcttcagatatagtagaaatgtgaaactgttcagtgacgggtttctcatttatataatgccaaatctaatttaaagaccattttcactgaaataaccattttattgagtatttttacataatattaaaataattagtttaaccagaaaactttatcaacacatttgaaataattttggcttacgatacgtataccacttgattgaatttcatgcaacttcctaatggccgctttgatacagcataagtataatcactaaaagttacctacaaaaatgctatcaagactatattcaatttgctagaagatattaatagaaggatatttagataatacaataagttcacatttgacttcatttgccaaagaaatatttaaacctgttaaatttgtgagtaaggttttatcaattcagttgtgtttaataaacatttagtgagttcatacccatttccagtaatgggtaattttaaaaaaatactttctctgaagaaattgtgtagcaaaacttaatatagctaaggatatagacagagattttaattcaacttttttatttgtaagagaagagattgcacagaggtgaaattgcttataaagggcttttcacgtagaaggcacagacgcaaatcacagaggtgtgtgaagatgcacaggacaactatcctggagagattaaagtgcaccttattttccatggcattttcttagccctactttttggatccttaaaaaatcagttctttttccatgattaacttttttatgtttaaatttactttgaacttagtttccaaaaaaattacacaatattaaacttattagtgttttaacattacatttggacctaaacaaatttaccatattattgtgtttttttaagtcattttagaaaaacgtatatcttttggccaggcgtggtggcttacacctgtaatcccagcactttgggaggccaaggtgggcagatcacgaggtcaggagatcgagaccatcctggctagcacggtgaaaccctgtctctactaaaaaaaaaaaaattacaaaaaattagccaggcatggtggcgggcccctgtagtcccagctactcgggaggctgaggcgagagaatggcgtgaacccaggaggcggagcttgcagtgagaggagatcgcaccactgcactccagcctgggtgacagagcgagactccatctcttaaaaaaaaaaaaaaaaaaaaaaaaagaaaaacttatatctttttagatgacaaagcaaatgacaaccaaaacaatgataatacaaatcttgctaatgatggcctattcaaactactttctaaaatcttcctgtagttaaattttaatgaaatcaaatagaaaagaaaaaggtaacagatcaaaattctttagatttgagatatgaatgtcattgaattatggcttcctgataggtttctttaagcccctgaatataaattgttattttcacatctagaaatcgactgggagtcaggaggatatctaacaatgctaccaaagtccagttatgggatggtgcttataggaacatactattataggtagtttttaattattattatatttagttatataagtttgtgagtacattagttttctgttgctgcataacaaattaccatagacttagtgacttaaaatgacacaaatttattctttcacagtttccattttctaggcccattatctaggtttcactgggatgaaatcaaggtgtgggttggagactcacaatctacttccaagctcactgattattggcaaattcatttccttgcatttgtaggagagaagtctttgtttatttgcttgcttgttttttgttttgatgactgtcagctagggaccactctcagttcctagaggtcacctgcagttctttgccatgtgcccccctcccccatagacaatttacaacatctatggatgtttgctctccttcaggccagcaggaatgcatctctcctccttctccctccagtcaactatgacccagtctgatgaaaattagcataatcatgcggatgagcaggccatgatcttttgccacataacttaacctaatcaaggaataaccatcttactacattcataggttaacccacattcaaaaggagataattatgtggaacaggagttccagggagcagaaatttgtagaagtatttcaggattctgctgaccacagtgatatacatattatttccattttacagattagaagattaggacttagaaaggtttagtaattgatttgcctagattgatatggctaatatgtggcggagctaacagctgtctaatttaaaagctgggactcataaccgttatgtttaacatcatcttgtggcctaatggtaaagaaattaaattacccttaatatagttaatccactttcttagtttccattcacttgtctatacagaagacttaaatttatctctctaatgttgaggacttgcttgagctatagtctcctatctcttaaaatcttctgcaattttctaattttatgacctagcttaaatttgactcatccaaaaccaatttcaagaaattacccttcttaaagtaccagtttctattaggtgtgacaccatttttcttgcctgaattgccatctttatgcctttttctactttgcagcattatggactaataaagggctgatatcccagtacccatcatggagctcatctatagacagggcttagtcaatacacctgtttttgtttggtactcaaggctagtcagtaaccaatgcttttattttttaatttgaaatattaagaacatttccatctgttttgttttattactattagcattatatttagtaatgataatgtgtgatttacccttattttgggggtagcacctttttttagttatttaataaatatattagctgttttccaaatgctgcaaacatgcacagtttaaccttgcttgaagtagcacttcaagtgcatttaatttacctacagatttaggatctaatagtgaaaaattagtaaataaaaatgaattgtagaattgttgccaccaaactgagattggaaaatacattttaagtattaaattgctattaaatatataagaaccactttcatagcatagcatgaaatcttccctggaagaatactgcctttttattgcttgtggatatgaattagtagagtaactcattagatatactttctagccccagatttctaaggaaatatacccataaagatttttctaaggctactattcactgatgtgaataaatatacctaatacgaataaacattttatggtattaagaaagagtactggggagtggttaagactatggagcctagagccagactgcctgagtttttatccccttgtctccatttactagttgtgtgactttgataagatgcttcaccaatctgattcttgattttcttatttctaacaaggaatattaacagcatttatctcattaatatgttaaaaaaatgaaataatattttaaagaatttgagaacttgtaccttatcactgctaaacaaacaaataaattagcagaatatttaagatactgtaaagattaattcttcgtagactatgcaaatatagttgcattattgggatctttaaaaatattcctttaaaacattagatttatgatgcaaaaagtaatttagaaatcgttaataataataaatgacccaggataaataacagaaatgcttacaaagcattttttttttgaattttcagtgttatcagtgaatatttattgaataccttgtatattgtaagtattgtgggggtacaaagagttacaatatcatgaaactattgttttaaagaatttacagtctaataacagtaatagggtgtgtttataaagacacagaacctggtagcatatgctttttgaagctgaagagatatctgagctctgatgcaaaccagcatcgtttcttgccaagatttttgtttgttatcctgaacagttaggaggcaaatacatggccacagtcaacatatgcatattccattcgagcatagcatttaaccttcaagacaaagcattttttaaatagagaaaacaaggcctcatatagttactaatattatattaaaaatactatgttatctctcattttatattattaattttcctgtatgaggtcaaattttcatctgggagcaaatttcttaaattgattcttttagttgacatatttttgaagaattttggctaggtagtttaatttctctaaacaagcatgggtaaatgaacgccggaaaataaaagcaaatctatttgtgcataagaaagactgcagcacaggaggtgtgagacacagccttgatctgcaccttttagcaatcttggtttgggagaaagacagctttatcgttcctaactgccagctctgtacttggtatgagttggatatttttcagattaaatcaaaaggcaaaaattgggtcataaattctatggagttctgttcagggaaatatactgggaaacagggtgagatggcagccagaaatgtcccctttagggcctggcagaaacaaacaacgagatataaatacaaaattaaaattgatacaattacattacagagttattttagtctcaatatccccattcaaagattgtgcctttggtttaaaagttaccagcagcaaaattttgcagagttcccatttccaggctccagtgaaaattctttccttgggctcagtacatccataagggatttgtcagagctttctaattttacaactattagataaaatgataaggcagctgggtcactggaaggcgaagcatccaaaccaggattttgctggcttaaagaaaataaaaatgatgtataaaatagcaagccccacggaacaatataaagaaaaggcagggaaaagtgtactgctgtaaaagatgtttaaagcaaggattcttgtagtgtcttattttcatttgaaagctgtagccgggagcaaagattcactttgttttggcaagttagaaatatttcactggtttttatttttactcaaagtaagtacaagaaacatactgataatatgagattcttcttactctctctgctccacgttctggccttttctttatgcttggatactcctactctcatctactttatcttctctctaggggaaagttttggaaagctggctagaaacaaatgaaaagtaagttttccctgagaagtgttaaatatattgctctaagcatccagtgtaacatatggatctgacctctgtgggatgtgaaccaaatatttgttgactgagtgatcatttctacaggccggaattttaacacaacatttgatgttggagttactgcagttcagtggaagacaaatgtttatgccatatataattttgaaaatattctaggctccccctagaccatgatttatgaattatttcagcagcttgttgtagagcatggccaaaaattttcgtgtgttaggtatttctagaagctgaatcaatgaagcaaatttcttgattactggtatgttggaagaaccctaatcattgtatcatataaataaaactcttcaaataatcaaacataatcagaaattcaagtcagcatgacattatcaaaaagggagttggaagaagtgaggacagaggaaatgagagaagaagatgtgcaaagagcgataaagctgatttaacctcagtcctgagtagtatttgggtttgtgacctagtggatgaaaatgactgtgtcactgaaggatgagatagtcccgtataaaaattcctttcttccagaaagtgattaatgtcatcccccattgaacaaagacaaaagttctgatcaaaatttaaatatagtttggaatatatttctgtggccactctgcacaagcaggatagatcctgactcccattttttttctgatgatgtcaaacacacacacacacactctctgtctctctctctctctctctctcgctctctctctctctcaaggagtaatgacaggtttattatgcatacaaccaggctttctggggataaggcaggcctttcaagtgggtccaaaacatcttgagagtgcagggaaaagagaatggcttggcttttctggtggttagtggatggagttagactgaaggttcccatgcatgggtcagccttacatggtctgaattatgccccgttgtaaaagaaaggagcacttttttttttttaaccaggctttcttaccagcttgcccaattgtaaggcatgaagggaagtggaaggagtgaagtttaaaagtcgtcaactgtcggccgggcgcggtggctcacgcctggcctgtaatcccagcactttaggaggctgaggcgggcggatcgtgaggtcaggggatcaagaccatcctggctaacacggtgaaaccccatctctactaaaaaatacaaaaaattagccgggcgtggtggtgggcacctgtagtcccagctactcaggagagtgaggcaggagaatggcgtgaacccgggaggcggagcttgcagtgagaggagatcgcaccactgcactccagcctgggcgacagagcaagactccgtctcaaaaaaaaaaaaaaaaaaaaaaaagttgtcaactctcaaacatcagagagatggaatgagaccctcgattaccacactcaatataaattgtatcagcccattggtgtatgcacatttgcactattctcttcttttttttttttttattatactttaagttttagggtacacgtgcacaacgtgcaggtttgttacatatgtatacatgtgccatgttgcacaacaggtgctggagaggatgtggagaaataggaacacttttacactgttggtgggactgtaaactagttgctggtgggattgtaaactagttgttggtgggactataaactagttcaaccattgtggaagacagtgtggtgattcctcaaggatctagaactagaaataccatttgacccagcgatcccattactgggtatatacccaaaggattataaaccatgctgctacaaaggcacatgcacacgtatgtttattgcggcactattcacaatagcgaagacttggaaccaacccaaatgtccatcaatgatagaccggattaagaaaatgtggcacatatacaccatggaatacaatgcactattctcttctacatcagttttcctctcaagtctcctcaagatttgtgcactttctgtgactctagcatattgcagttactccagtatcaaatgttgtgttaaaattctggcctgtagaaatgatcactcagatatcttactaatttgttggcattttaaggttcttccaccaaaacatcacgttctgcacatcgtttttaaattcttattttctctgccaggtccagctcctttcttactgaccagagctctatcagcttcttcacacttctcctccttaactgcttatctttcaaagagcagttcaagtcccctcttcactgtcttcctgcaatcatttaggtccttgtcaatgtctgtatatagtttcatttctaaatcccagaaacaactgatggtaataattgcatgtttatatatttacatatatttaaaaatatatatacacatatatttaaatacatatatacacacacacatatctatatacatacatatatgtatgtattcaaatatatagggtgtctgatctattccaggtgcctagtccaatgcctattctaggctccagtaagacatagactctgtagcatggttatgggttagagatgactgtgaaatgctcagctgacctagcataacaagggaactactttctggaagtattcttaaataaaattaaactctgaaaggcaaatgtttatttgaaatatttaatctgtctttcactaggaacatacaacttttaaaactttggtaaactacattactttataaatgcaatctgtaacctgaataatatatcatgtgtcttgtttgtatctaggtttctgaaagcttaaatacagattcaacattagttacatggaaggaaaaagaatctcactaatttacttgaacagtattgtatgggtataattcctagactaagtgacttttcaaatggtagtaactgctatacaatagctacaattacttactatcatctaaaaattataggaaggtaagctgcgaaaattatttttcattggaagatacttttaaccaaaaggttcagctttagttggagtagattttttcccttttattgctgtctaatattaacacaaactaggttatttcttttctctacggatttgtttatattgtgttcaaaatgatttctccatgtttccatttattttgagagactaaaatttataaaaattttcacattcacttgtcttgatgtaaagtaattgcttctattgaaaatgtaattcacaagcttttgaaaataatgtaagctatacttatggctcaagacagagaaaaatagtttaaaaatcaataaactaaaaaacaaatgtatctggggcaatacacccaaatgaaaagcaaagaaagatatctcaggttatcagattcatagagttttgaaactgtttcaaggaatcttgaccatcaatgagagcatggaggtgcttattttccatatacttattatatgggaaaataattagaaagtttaaacgcagcaaagaattgtatctcaaaaaatggtcttgatattttgaaataattttaacaagggatattaaatataacaccagaaatttaacaaatatatttaatcatgaaaattggcatctaacattttgccaatgtcatctacaatcttgagtctcctaggtatgagatctgtctacctaggtcaaaggctattgaacttgggacatctaaagagcttcataaaagacaactttctccaatataatagtaacttctgatgtgtacagagcttattacattgctacacgtttttacctgagcagtacgatcttttatttttagctcctttggatgtttcaattgcatttctaaaaataatattttcattgcacttgcaattttgtgcatcattgcccctaactgcatctttaaaatacatgctgtgaatatttagccctaaagcataccatgaactttctaaaatggagcatgctttgattgctgtgacttcttaattttctccatgaaatgaatatctttcatgtatatactatgaaatcaacaatgctaaaggaagatactatccctcagatggcctgttcagttctaattctcataacatacatattcaacaaaaatgaggccatgtttatctctaatccctaggcaatccctaagcaacagacagaaatgtaagggctgtcaacattccatgatctcgtgagctctaaactgcaagagagaaattttctaagttctataacagaacttatttcaaagatttcttataaaagatacattcccacaattgataatctgtatagctcattcagcaatgttctacttatttgtttcaaagtcaaataaacagtacttattcattcaaaaagtatttattgcatgccttctaagcaataatcattatgctaatgcttactgctcactgtgtatggaagggtctcataaggcacagtaaacaaggtaataaatcaaatgattatacactgtgataagtgctataaaatcaatctcagggctaagatctagaataatagcagtcagtaaagttctctctgagggatgacatttaaatttggcagtgaagaaatagattagagtggtgaggcaaattatatacaaccctctggtcaagtcttgcccactgcctgtttttctaaataaagttttgttaaaacacagccacacccatcattcatgtattgtttatagatgttttgcactacacagcacagttgagtagttggaacagaggttgtatggcctataatttagaaaatctttgcatctgttcctttatagaaaaaattttcacacactaacttccacagtggttgaactagtttacagtcccaccaacagtgtaaaagtgttcctatttctccacatcctctccagcacctgttgtttcctgacattttaatgatcgtcattctaactggtgtgagatggtgtctcattgtggttttgatttgcatttctctgatggccagtgatgatgaacattttttcattttgtcttttggctgcataaatgtcttcttttgagaagtgtcttgtctgttcatatcctttgcccactttttgatggggttctttgtttttttcttgtaaatttgtttgagttcattgcagattctggatattagccctttgtcagatgagtagattgcaaaaattttctcccattctgtaggttgcctgttcactctgatggtagtttcttttgctgtgcagaagctccttagtttaattagatcccatttgtcaattttggcttttgttgccattgcttttggtgttttagacatgaagtccttgtccatgcctatgtcctgaatggtattgcctaggtttttttctaggggttttatggttttaggtctaacatgtaagtctttaatccatcttgaattaatttttgtataaggtgtaaggaagggatccagtttcagctttctacatatggctagccagctttcccagcaccatttattaaacaggaatcctttccccatttcttgtttctgtcaggtttgccaaagatcagatagttgtagatatgtggcattatttctgagggctctgttctgttccattggtctatatctctgttttggtaccagtaccatgctgttttggttactgtagccttgtagtatagtttgaagtcaggtagcgtgatgcctccagctcctcagggatctagaactggaaataccatttgacccaactatcccattactgggtatatacccaaaggattataaatcatgctgctataaagacacatgcacatgtatgtttattgcggcactattcacaatagcaaagacttggaaccaacccaaatgtccaacaacgatcgactggattaagaaagtgtggcacatatgcaccatggaatactatgcagccataaaagaggatgagttcatgtcctttgtagggacatggatgaagctggaaaccatccttctcagcaaactgtcacaaggacaaaaaaccaaatgccgcatgttctcactcataggtgagaattgaacaatgagaacacatggacacaggaaagggaacatcacacactggggcctgttgtggggtgcaggggggagggataacattagaagatatacctaatgttaaatgacgagttaatgggtgctgcacaccaacatggcacatatatacatatgtaacaaacctgcacattgtgcacatgtaccctaaaacttaaagtataattaaaaaaaaaaagttttcagatccctagcagtagatgccttccgaacaaagaggggagaaggagcattccatggagaaggcataacaggagcaatgccacttagagcaaaatacaactaaacatggcatattagagaaactgaaagaaacccaggtagcaagaggtaaagtgggaggagattgtgggaaccaaacaagctatgctgagccttggaggctgtggcggtgaacagtgtgatttatttatttatttatttttgagaaggagtctcgctctgtctcccaggctggagtgaagtggcgtgatctcagctcattgcaacctccgcctcctgggttcaagcgattctcctgcctcagcctcctgagtagctgggattataggcgtgtgccaccatgcccggctaatttttgtatttttagtagagacagagtttcaccatgttggtcaggctggtcttgaactcttgacttcgtgatcctcccccccttggcctcccaaagtgctgggattacaggcatgagccactggacccggtgtgaatttttaattctcatgattacacgaagccattggaaagcttttagaggggagtgacgtggtatgatttatgttgtttagagattttacagctaatccttatggagtatttactatgtgcacagttgtaagtcatttatatgcattgatttatttaaaagtcttccatattatgaagtgtaattgtaatacatagtttacaaagaaaagcaatgttgcttgctcaaaataatgtgatacacttgcaaatcgtggaggcaggattggaatccaaacagttgtcatgtagagtctatgctcttaaccattaggctgtacagcctcacattgcctgtggtgtacagtatagaccatgtgacttgtgtgtgggggagcagtgcggggagtacagtatgtgtgtgtgtgtttataaaagcaggaatatgagtaccttaggaactgtgaaaatagtaaaagtgtagtagatggtagtgacctgagctgtgagactgaatatgcagatgaaaaatggctgactttcagtaaagaagtagtcgcttacattcagtgctgacaagtggtgaagtgggaagtagattgaaaagcatggattcgattttcagccgggagactcttgctgagagttacacttcaaatagtaacatactactttgcagaaatcatacatggtgccatagactaacaaggacaattgcatttaaccctgcaattaattctgtttttccagaagagtaacatgaatatgactaaactatgtatggtgaaggactattttcttcccgagccttcatttaatttttttctttacaatttaccaaactgctagccaaaatagtattctctatttatagactaaaacttttcagatgattaattttgttgtataatgtattcatttttatatttcattatagttgtctttctctgagtaaaatacctgtcaatgatgttttattgtataagactaaattatgttcttgaaactagatgatttgctttcatatacagatcaaaaaattcctttgttagtattaaaagtaaggtataaaaggttatatacatttttaaaaatataaatggcctgtcatagaatatactgcgttaaaataaataacttataattgaatataatgagttattagttatcttggtgaagggacagcagttgaattatcttatttaggaacaactatctccagtaatctttggattaaaaaggtccaaaaatgcttatggagacagtgtagataatctaaagattatctacaatctttagagataataaattttaaaaatcaagaatctcttttcttgcaagagttcatgtgtgccttttcttctttgaaaagagacatagcatagcttaacataattattcaacattataaatctgagtttaattatagggtgaaagaaagtgtctctcatgtaagaagacaattacatttaagttatgatgattaaaaatatccacaacccagccttagcctctttattccaaatctaaatatacaggactcttaaaattatataaatatttaaaaatattcagtatattcaatactatttgtctagtttttaaaaatttttatactttgcaataaaataaaccaaagaaacaaatataatacaaatgaatgttcatatatttaatacttgaagattaatacagtagtatacaataggcagaaataagtaactatcataaatttttcatataaaaatcatgctaaggtatatataaatgtggattttcactatagtgtaccattctgtttttatgtttatatgtaagtaaaattgaatgtactacgtgtaacttagtagacattactctacacactgattatatgttttgcattttacttttgtgttatcattctaaatcctataaatgtttcatactatgacaaagggcagataaaatattatattaaagtcagtctcaggaaggaataattagtattttttgtaacaaaaaaggatacaaatctaattttgatttttttcctcatattaacttatccttactcttgttcacattttttatttaaatattaaaaatgcaatcaagctcatacatggacattttttaaaatgtcaggtggtacaagaaagcttataaaaactagcctgaagaaaggtagacgttcccatatctcaggcttactaacattttcagctttttcatctgatatctccctacatatctatagaaatgtttattgattatttttgttacactaagcttggcattatctgtgggttttctaagatagaggagaacttggctttcttttgcattacttcacacacacacacacacacacacacacacacacacacacagagaaatccatttgtattggtttaactatgtcaatagtgctcattgcaaatacagagatcgatttatatttatatgcacacatgttttaatgatgttttaaactttattttctccatatcttgtatttttaccattattcaattatcagttactctaccattaatttttctatgctacccatatatgtatcttttccctagaaccatttctcctagagctttccttctgtttgcactgctgatctctgggcctaactaaatagctcttataagaggacttgccttcacaaatgggtttccctattttcctggattccatatctttctttttttttttctttctctttcctgaggtttatctctaagtatcccctaaaggatgactggggtgagagatggttcttatatacgaatgctaagggaagcttctctgaagtggtgatctttgagctaaagcttgagccatgcaaagatctaggaagagtgaatagttagataaaaagctcctaaggaagtgtgtgctgtggatgtcagttatagcagggagggtagagcctagcgtcatggggaaactaaaagtggtacctaacaaagtgtgagatttattgaagcaggatcagggtcatcttgggctttccagtccatgataagagttttgaaatttatttttacttcactaagaaactactggccagttttaagccaaggaatgataagagctatttttataataatatagaaatgatgaggaaggccttttcagtgacctgcatttcttcatcttcagaataataaagctggtggaatagatggaaaaatgatttagtatttcaaatctccagactaaggagatagatgtttttagcaaaaaaaaaattaataatagcaaatactaaaaaggttatgaagcatgagggctctaaaaaatatgtctagtgaaaatatatacccagattagggaatacacaaatgatgaagaaatgaatacaaatgcaggaaataatgtcaaaagttttgacgatggattagagggcaaaaaatctaaattcgaacctgacagggaagtataattaagaagatgtgtgggaatgtagatatgaagaatgttggtgtggtggatggaagggaagcaagcaatagaaagaagttaaagacaaaagtagcaaatatgagaaaatgggaacccagtgtctcaatacaattcagagtaaagatcgagattcagcctgactaacgaggagctctgcatattgatctagagagattttgagaaaggaaggacagagggaaaaacagatctccatcaggtaaggcgtgaggttgacaaatgtctcttattcatttcacaaatacctatgaacatctattttctgggcatatgctaggtgctatggatatatgatgagatgcattttgtgttctcaaaatgttcataactagtaagaaaggcagaaagttaaatacatttttcattgcaatagaagcatctgcaagacaatatgcgtatccaggagtagcctttggaaccgaacctgtggtatctctgggatatacctcagtctttagactaaagtaaggagctgagtgagggtttcatagagtaggtggtgatttcctgattttctggagaataagtgagtacttaaatagtaggcacagaaagatgcagagagggaattctcaacagtagtggtgcttttttttttaacagaaaaacaaagttagacattgaaaagtaaaagtttctcagtatgggagatcctcaagaaattcagaaagtgattataaacaaagaatagatcataaactactatgaacattatgctgtagtgtttaggtattacaagacaattgcacatatgatcaaaattttatttagaaatattcctgtgatcaaaacagagggatactttcaggggtgagtgagaagggatttaaatagacactataacactatggggatattttaaaataaataattaaacgagtaatgggaagggagaaaagtgtttggataatatttaaacaagattaataggacttggggttgcttgggtgtaggtgaaactgaccttaagaaggagtacaggcatacttcagacacattgtaggttcaattccagaccactacaataaggtgagtctcacaattttttaggttttccagtgtatataaaagctatgtttacattatactgtagtttaagtatgcaatataattatatctaaaaacagcatatatgccttaatttgaaaatatttcattgccaaaaaatgctcatgatcatctgagcctttagtgattatttttgctagtggagggtcttgatgttgacagctgctggctggtcagtgtggtagtttctgaagattgggatggctatgggcatttcttaaaatgagacgtcaataaagtttgccacattaattgacttacaaaagattcctctatagcatgtgatgcagtttgatggcattttacccacaggagaacttctttcaaaactgcagacagtcctctcaaaccttgccactgctttatcaactaaatttgtgtatattctatattcattgttgttatttcaacaatgttcccagcatcttcaccaggagtagattctttctaaaaaaaaaaaaaaaaccaccttgtttgctcttccttaaggaacaacttcgtatccattaaagtatcatcatgagattatagcaagttagtcacatcttcaggctccatttataatcccagttatcttgctatttccaccacagcagaagttacttcctctactgtagtattaaattcctcaaactcatccatgaggtttggaatcaatttcttctaaactcctgttaatgttgatattttgaccccttcccatgaatcataaatattcttaatggcatctagaatggtgaattttttccagaaaattttcaattgactttgcctagattcattggaggaatcactatctatggcagctataaccttacaaaatgtatttcttaaaatataagacttggaagttgaaattaccccttaatccaatgactgcagaatggatgttgtattgtcaggcatgaaaaaaaattaatcaacttgtaaatctccgtcagagctcttggatgaccagacacatttgtcatgagcagtaatattttgacaggaatctttttttctgagcagcagggtctcaatagtgggcttaaaatagtcattaaagcatgttgtaaacagatgtgccataatctaggctttgttcttccatttctagagaacagacagagtagatttaatataactcttaagggccctaggatttttagaatgataaatgagcattggcttcaacttaaagtcaccacctgcaagattccctaacaagaaagtcagcctatcttttgaagctttgaagccagaaattaatttctttgtagctatgaaattcctagatggcatcttctagtagaaggctgttcaatgtacattgaaaatccattgtttagtgtaacgaccttcatcaatgatcttagatacatcttctgaacaacttgctgcagcttctacatcatcacttgttgcttcatcttgcacttctctgacatggagatggcttcttaaacctcatgaaccaacctctgctggcttcagacttttcttctgcagcttcctcgcctctttcagccttcatagagttgaagagagttaggcgttgctctggattagtctttggtttaagagaatgttgtggttggtttgatccatctggaccaaactttctccatatcagccataagcctatttcacttgcttatcattggggtgttcaatggagtagcacttttgatttccttcaagatcttttcctttgcattcacaacttggctaagtagtgcaagagacctagcatttgacctgtttcagctttcaacatgccttcctcacgatgcttgatcatttctagcttttgatttaaagtgagagatgtgtgactcttccttttacttgaacacttagaggccataataatagggttattattttgaattggcctaatatcagtatcattatcattgtgtctcaggaaataggcccagagaaagagagagacagagagagagaaaggagaattactggttggtggaacagtcagaacactcacaatatgtatccattaagcttgccatctcatacgagtgcagtttgtgacatcccaaaacaatgacagtagtaatatcaaaggtcactgattataaatcagcataacatatactaatactggtaaagtttaaagtatgagaatcatcaaaatgtggcacagaaatgcacactgttgaaaaaatgacacccatagaattgctggtcacagagtccttactttgtaaaaaacaaaaacaaaaacaaaaaaataacaaaactcagtatatgtgaagcacaataaagtgaggcatgcctgtattggatgaaaactgccagattttaatattaagcaatcgagagaatagtgactttaagcacttagaaatgataattaatgtcaaagccaaagcgagatgaagcaagaaaaaggctagcgagtgtcgattggattgaccattcctaaactcaagcacaatttctgtgtctgttgaaacagaacttcaattgtacatagtagatgtaaataggtgagctgtaagtcgtagacgaggaagggttgacattagaaagctggctagaaaaagaaaaagaggaatggctaaatgggaacataaaactcaaaataatctttctggtatacctattttatgaagacggaaaaatcttgggcatttgtgaagtgagaaagaaacaagatattgggaaaggagggtatataacacagcaaagtcttggaggaacagagaaggaagggttggaactcagaattcacacaaagatagggcattcattccagagacagttaggacatttcattttcaaggaataagagggcatataaaacaatagctgtaattacggatatatgtggggtgaggagagtcaagagagtatacttcttatggcttctgtttcaattgtgaattcagaggcaaggcaattaaatagggcatttgggagagtgctgctgatttagaaccactgtcccaagaaaaaggaaaaaaccctagttgactagagaaaataaaaagcatcctcataattgtgctgttttttcaacagcactgagcagcctgcttgtacaagtggaaaattcacatataggacatggatagcatcaaatgagaggttgactgcttcaagttataaactatttgagttattatgatgtgttaatgttggcaggtaagaaattaaaatccgaagcatgttgttagacttttatgcctagtgttccattattggaatgctaagcatgggagagttatttatatcctacttctcaaagatacctccaaagtctgattgcaaaaattcaaaaaattgcaacctcaggcataattgggttaatagactgggttatctaggatctagataaagagttggcctggggatgggagttccaggaaataaaacaggtacagcatatataagttttaataccaactctgaaaagaaaagaatttgagaaggctgataattttggcataatactataagaaaatgtatggaaaatcaaggagagatgaataaaaagtcttcagaacataaaaatagggttgaaatcctgaattcatgttcacccaatatatgcattttcatcaatttcccaaagaaactttggcaactgggaagtggtcatagggagtgtatcctgaactaaggactttaaaggggagatataaggagtagtcaaagaagacatacattctagtggcagcaagggctttcttgagatggttgattaccatgttcagcaggtggagttaggtggctaagaaatcagttataattaaaaatatttttttaaaaaaagaatatgaaagacataggtagtaagttatagtcagaaagtgatttctgatcttgagattttagttttgaaaagctccacatatttaaaagggataagattttgtcactgaagtctaatgtgctagaaaggttatcaatatgggcattgaagagttgagcagagatggcatagagttagctgtattaaatatttgataagtaaataaataaatgggaggctgggcacggtggctcacgtctgtaatcccagcactttgggaggccgaggtggaaggatcacgaagtcaggagttcaagaccagcctggccaagatgggaaaaccccgtctctactaaaaatacaaaaattagctgggcgtggtggcaggcgcctgtaatcctagctacttgggaggctgaggcagagaattgcttgaacctgggaggctgaggttgcagtgagccgagatcgcaccactgcactccagcctgggtgacagagcaagattctgtctcaataaataaataaataaataaataaataaataaataaataaataggataatggacaagtgcttggataaatggaaagtaaataaaaggcattagaaacactgagtgtaaatggtggtatttggaagttgtataatgatagcaatgagaatgaaaaggggtggtaattaatatgaaaaacagaacatctgggccaaaatatattctattcctggggtaaccccccatctattttgtctgaatgtttatattgattaataaacctgaatcacaaaattatattctgccaatatctgtacatatctaatagtgagaagccctatatgattatttcttagctttgaggcttttgatgatactgaattaatttcttgcttcacagaatatttaagtgaaaattcttggtgtggtttattcacacagcatatgatgtttaatattagtagttctggtggatactttgtgttacttcttcagatgtactctcaatctatttccacctgcctctcatcccaaggaggtggacctgtatggatttcaatggagtaatattaccttctgatgaccatctgagttcagccaatgagcaactctagcaagagatgagtgggaaggagcagaatgagtttgggctgtgtatgcccccagcttcattcctgtatcacgtcccctgctaggttggattcccatatggaaggtcgcgggtcctctccaggcagtcctttctacacagctggctctctcactataggttttggcaactgctgactgccttctccccttaggcactgggaatgataaaaagctcctctactgttaggctcggcattccccactctcctttatggtttctctactccttggctatacagtcctaaatactccttcatgaaaccatcctcaaattttcctaatttgagtgtgccatctgtttcctactgggaccctgactcaggcaaaatcaaaaaaattatcaacaaccttgttattaacctgtgtaaaaatgtgtctttatgaccttgcaatattttctcatatactacttttaccatgtatcactatactacattttaaagatgcatttcattggattattattttataattttcattcccattttaagttcatttagaggaaggcaaactcccaaatataaatgtagctatgtctcttaattcgtttacactaagatccttggtagcacaatactttattccttggcttgtgagatacctagagatttctagagaaattcttcacatatagatatatgtgcccatctttaaaaatattttagacaatgatgttggttggcatggctatgttgaattgctaacaagccagaaggcttttgtcctggcaggaataaagtgatatttgatcacaggatgcagttttactatgaaaagagagaaatcacttctcagaagctctgagttaaattagaaagcaggttgattacttttaatactgcagatgattgactagaaacaaagaccatgtgtcagaacaaaagtgttaatacctgaaacagcctctttttttatttttatttttttgccaatgaacaaaaatgactgcttggaagatcattaataggcatgaaaataagcccttttaatgtaatatctttattccaagttgaaattcactgactgaaaaaagtatttaaattcataagatataatcatataagaatggtatttctaatttattcctaattggttttaatcagttagcatgatctatagcctaattttaatttataaaacaatgagcaatatttttcttcactgtaagaataatattaaacacttagatctttaaaaccagtactgactgtatagtggtgttttatgtgtggaagtctagtttgcatacttgccgcatatttatactctccagtacactctctcccccacccaaatgttcactggcatgcccaaggcaagttttcccttcataatcccatgtcaaaagccagaatgcatgtcagtgaaactaccaaccaaagtttgaatcagatatattcagatttgagctggaagtgtaatgttttcatcagctaatactggccttaggggaggaaggagcaaagcagaccggacaataagtggtgaatgcctaggagtcctcgaggtggagagaaaaagatcttcctcaagagggtcattgagtaccatggagggatcccatgctgaccgttacctctgagcagccccccgtttatggtcttggatacttgaagagtatccaataattaaagaaattaaattatagtgaagtataataaatagtctggtatatatggaaacacatatggctctttactacagatgggatatgtcaggaaagtctttcaagcagaagtgaactataagctgagttctgagaaaagggcttgacttagccagaaaagtgctacaagaccagcccccaaaactggagcctcatgttcagagccagagagaaagggaaaacatggccaggtcagtgagaaataagcaatgcagtgcctctaaagtatgaggtatagcagtcagtgcagaaagggaaaacgagaagtatttaagaatggatttggccaggtacgcaggaaccaggtcatagcacacctcatgtttgctaagtttatagaaggccatcagggattaaggaaaggagtcatgatcaaccttaggatccagaatgaattccagcagtagtggaaggcacacattgtttggttagaaaaatagagtttgataggaagtgacagaactgttatgttgcttcacttcaagcaggaaatgatgagagcctaaattagtttaatggtggtatgggaaggcagtagaagtgaatgagacaaatctcagacatgttcaggagacaagttacattgaatatggaggtaagagagggaagaaatctagactgactaccgtgtttctgaggaggattggtattcactccagtgatcaatggattcagtaggtaaattgtttaaaaaaatgtggtatatccaaacaatgaatattattcagtgctaaaaagtgagaaagccatgaaaagatgtggaagaaatgtaaacgcatatcactaaatgaaagaagccagtggaaaaaggctacatgctgtatagattccaactatgtgatattctggaaaagcaaaactatggaggctgtgaaaatatccgtggttgccaaaggatgatggagagagggatgaatagaccttgcacagaggatctttaaggcagggaaactactctatatgatactacaacagtagatgcatgtcgttctacatttatcccaatccatagaatgtgtaacagcaagagtaagcactaacatggactatggactttgggtgatgatgtgtaaatgcaggttcatttattgtaaaaaaaaaaaaaaaaaaaaaaaaaagtatcactgtagtatgaggtattcttagtagaggagcttgtgcatatggaggaataagaagtacataggaagaactctttatattttgcattcaatttttctgtaacctaaaagtgcaattaaaaataaggtattaaaatacatggctcagattctgggaagtaagttcaaatttgagatgtctttgagagattcaggtggagatacccactaatgaatgggatttagtttctgcatcacagggcagaaaactgggtctctctctccagaccctgtccccagctcctgggcatggatgttctcggcttatcagccagatgtgtcagccacagacacatgaagaaaagtcagggaccacagtctctttattccacaaaatgtttttgaccctgccaataattagctaagccaaaatgagtttctggtatatatatagtcaattattcttaattaactgccatcctttggagaacataaaggatatttatgatgaagatttctgtgtcatctttttcttttggaagtcattggggtatccccttttgagcaggttaacttctgaaatgtattttgcttgggatactgcaagttctcattatctcatctaacatcaaaagcatgaaaacagttttcagaagtgtgttagacttaagaatttcaggggtttccagctgagggaaaggaattcccaggcatgtacaacaactcattaagctaaatgaattgctaatgctggggtttgctatggacgcagctttgactgcatctgtcaggctggtacatcttttcacttcactgaagagtgttataggtctagaattatgccacagcaagccagaaagtgggtattatgagacaaatgacattactttttttgtactttgttcatgcttcagactaccatattgcttcactttttgagattaagaactagttaagtttcacaaagccatgactagaaatatttaacatgttctttagccaggttagagaatgaaagagaaaactcttccaaaaggaaaatagcttcaataatctttctgtgtgaccactggtcctgttttatgcactatacttcaatttgctatgaagcaagtgaggcccagagtgtgcttggaggcaggcaccctaatcctaacatgctaacttaggactctgggacctttgctgggaacttctcaagtcacagcacttgttttccacgttctcctacatggtgtgctaccccgtcagctctgaagcatgaaagtgaacacttgtttctgctgcttactgaaactccatcctttctccaaccccatgttatcatcctgggtcctcacactacagccagggagggctgggaagaagtgacaacttcagttgcctaacttctattaggctgtgaaacacatatggtcccatgatgtgagtaggtcgcgcagaacaagaggggctagctggccacgtgttggggatggatggaaaaaatgctctttttttccaaattttctatgatactgtgaacaagacagtttctcaataaggggtccttctgtgcacatgtttgtgtatctctagctagcaagctaactatctcactcagagaaaggtttgcttttctttttcttttggtggctggatatatcagttttatataattttacctgataaactacttattgttattctatgaacacaaaaggatgataaatttgagggatgaaaatttgacagcttctattgaataagaagcatgattattttacagaatgttgttacctttagactaatatagttccttgccttttaattttctttttaccatatttctctatgcttttgttttaggattatacattaagcagctgtatcatcagtcttaaacatacatgatgtaactgcaaactgacaaacattcactaattagaagaaagactaatctgaaatgcacacaaaatgcatggaaagaaatgacttttttaaaatgcaagcaacactttaattggacaactatagcattactaagcagtggatctacaatgacacttagaaataaaagtgtgattaccatgttcattatatgtaaaatgtttgaaaagactgccactttattttattactctcttaaaatcctttatttgtcaaattctttctttagtttcacacccatatatgaaaaatcacaagtgccaaatgaataaagctttacttatcctcttgttgcatttccaattcactctctagaataagtacatgcttaaaatttaaaaccttatctttttttctttactcttgtaagaaagttctacatgcatttttaaattaagattttaataattgagcgaaaaaataaaaggtttactgtatgacttcagactacattttccacacggaatgcaaaatagtaccataggaagatctgctcctctttattcctctttctcttccagtcttgctgtcatccaataatgacttattaatagccatgactcaaggtgaatttatcataaagctcatgtagcttaagcttcagggctcctaatttacactgagcccttccaaggtcctcagaagagccctaccaatgtgttcacatgaccttatgtttttgtcaagtcttctaaagtaagatagtgtaactctaacttaaaatataccatttttttttcatgacaaagtcttctgtcacagttttcctcgtgttgtataatcttgaagtggccacaactgtggggacctacttaagggcagttcagctggaaatacattttagtttggattcatgggttatatttatgagattcacagtcacttgtgaatataattagctatttctagctatcctcatataggaatgaatttcaggaatattaccatccattgtactcactcacctggtattatgatgaggaattacaaatagaaaagtcatgtcaaaacatgaatgtgtcaccagaagtgtgtgggtttatttaagattaatcactgcacaagaacacgttagccttgaaattttactataacatatttaaaagaaatattagaggctttccaaaatttgttacaatctaagtttggcttgtcccaaagcagaacctgaggcaagaacttgagtatagtttatatggaatgtgattcacagacacaggactgaagcagcaggggaaaagggaagaaggaaaagcacatatgggtatgccattgaggattcttctatggggaatgcaggcttgggtccaccagtactttgaaaagtgtaggacatgcttctcaaaatcagtctaaataatagaaggctgggacatttactgattatttctgtccccaggagctgttaatttccctccactccagctaagctccactgagttgaacagcaccatgggagatggccctaaaggagaaaagtagagaaacatctttgaggtgggacactggaagctgactcagttgtttatcaaagttaggactgaaattagaagtgagcctaagagatgcaacatggaaaatttaaagcatctaatgggtaaatatttttatttccatttttctgatgaaaaattcgaagttcagtgaggctaggtcagttgcctgagattgcatggaacataggtagtagagataaggtctgaatgtgcatttgtctgatgccaaagatcattcactttccaccacatcacatgcttccttagggagatcttctaagtcaatgagtcatctacacttgaccctgttcagtaagatgaaattgctgacttgggctgatgggagcagatgaagctaacaggatggtcaagtactttgctattcttttttttagtatctgccgttgggagatcaattgttcctggcacttagaaaaggagatggtagaaaaggagattgagctttgtgaacaaatcactaattcacatggacctattgaacaccctgttttagaaggtgtaatacaacaagaaaaataattgtgttgtaaacccaaataaaatgtagttaccaatatcatgtcagataacttaaaggtaggaggaatggtaatgctgaataatagatgacttagaacagtttatatatttggcttcagctgtaggcaaagggagaatacaataaatatttactaattccttactccatgccaggcactgtggcactgaccatgaaatgaggctattacatagatgagggaagtccattgcctaatgacctgccaggaggctaatggctatgttagataattctaaagtttaccaacacttcatctgtctctcctgtgatttcagaacaaggaggactccactttaccagtcatgtgactgatcttggcaataaaatgtgggctgcaatgatgaatgccacttctgaactgaagtgcttaattgctgatgctcacttttccagccttctttgcccgtgctatgtagattgtagaagcatgtgtttctgcggaggagccataagagcacattagtctggaatgtttagttaccagatggagtgcagcttccctgcagccacggtggactttgcatgtatgaaaaataaacttttgttttgtcaagccagtgagactttggggttgcctgataccatagcatattatagactaaactgaccgagtggcagaatgcaaaaaaccctaggccaaagtgacttcaaagatcatctgttctccttttaggtttaaaatgttgtttcttgcttatgaatttttttgtttatcatatttttggtataaaagtaatttgtgaactgtttgaacactgaaaaatatagaatatactcaaatgaaaatcatcttatagtctaaacacagttaaaattttgttgtatttcatctcattttctatatatgtatatgtgtatgttttgaaattatagatatgttacagcaactaaaattttgtatcctactttgtatatgaaatatcattgctaagttttgttatattagacattcttgttgacctattttttaagcaacttggtgaaagtgtgcaaataattttttgcctttatctcatctgctagctctttttcttatgtagtacacagtccttattacttcttttcatacagagagaataggcattttatctgttccctgatccagcagcccagtcccctatgatggcaaatgttgcctaaattctatctcacacatcaatagttaagttgcttacagtgaatcaatcaaatattccatcaaaataacagttgagtgtttgagctgaccaactgtttgcctcactgacagtcctataaaatcagaatcttgtatttttttaccctaaaattgatcttacatcttacatctttatctttgtcctatactttctttgtttctatttttcttgcataccagggatctctgaaaaaattatagcagtaaaactcatgttaatagtgatccagttggatgagaaatgattggaagtcaaaacacctagaactatgaacttcccaaccatagaactgagaaatgttacagaaaaatgttataaatttcaaatagaaaaaatattgcaactttatttcatttgatgaaaaaacccaggagaaaatgaaaatttttaagacatttaaaaagtgtattgtcatagcctcgatattagaattcataaatgacaactctaattattgagacactttcataagtcataccccacacactatcaatatggtacagcattttcctttgttttgcttttctcattatctgtccctgacatagatatcatttttcagctttttctagtgacgctgcttagttactttttgcagaaatcataactggtgaaatcatctgaagcttagctaagtataatagtccactagtatcccactatcaaaaaataactcctattctacacttggagaaaacgtgcatgcatttgtgggcttctgaaagctatagcagaaactctgcaggcagaaattctttgtatacgtaacgacacatcaataggcagctacactgcaagtcctcccacatatccagcttaatagagacgcgatgaagaggctcactccaagtgtctaatcctgtcatgtattttatatagagcccatggtggtcaagtgctgcaggaaagttaaatattctcttagatgggcacgaagattttgcgaggataggaagtatctacaacaattcagcagaattttctgggataataaagatgccaaatagcagcagcagctaccatttatttagggactaacacgtgatagacacttgtaccaggcattttagaggttgttaaatctaacaagtatatgaaataggcatgtccagtttataaatgaggaactaaaatagagaggttaagtaactcgtacaatgcacacaattaaaatgtgaaggagacaatattcagatctttctgactttaaagcctgttctcttagccattgtgttatattgtctctatgtctgagttaacctcacagatcaccttgtctcttactagctgtgtgacactgagcatggatgttaacacgccttcattttctcctctgaataattaatgccctgccttcatgggggtggagggttattgtgaatatcagaaggagttaacaaatgtcaaagtgctctgtcaactgaaatgccatatgaatgggaactatgttatagtcaccattactggtaataccaattgttttcataattggaactatcctgcagttcctttcatgtaaagaatgattctagggcctgggattcaaagtgtggtccacagagctgcagttttagcatctcctgggaatttgtcagaaatgtggaatctcaggccctaccctacacctagtgagttagaacctgcagttttacaacatctccagatgattcttaagcacattatgtttgagaagtccttgtaaagggctgaaaagaaatctagattaaggataatgatctgtttagaagttttagagattttaggccttaatgcaggtagcagatggggatccttatgaattgttccttcaagaatctcaagattgctgggatgtctctagatgtggttaacagatcttatgaaatcacacaacaaatataagaaacaattggactagaacttgagtttctaacatattcaagttttttttccaatgatgtagtaaaatgtactacgaaatatttttaggagatgatattttagagaataaaatgtctaaaggtattactaaatttcctttttcagatttgattacttaaaaagtgaaaatttttatatcataaattacctcataaacaagagccacagacacacaacatatatgtaccaaaatatatagcaaggtatatgtgtaagcgttaaacatataaaaaaatccttaaccttggctgggcccagtagctcatgcctataacatcagcactttgggaggccaaggaaggagaattgcttgaagccaggagtttgagaccctctcgatgtcaagaaaatggaagttgaaagctaaaagaataccatttttaaatctatcagattggcacagcttagaaaggcttgattacttcaaatattaacaattttatgaggaacttgtcatcttcatactttttataggaataccaattggcgcaatatatctggaagtttctttggatctatgcacacttaaaatgattatatctcataactaagtaattacattttaggcaaatgttcttatatgacatatgtatatttttgtttaagtatacaaatatttttgtgtaatcatattcaaacttttcaataagaaatagacaatacaaaggtctataagtaggaggatggatacatacattatggtgtaatgatatattaaaatactctgctgcatttaaaaataatgagatagtttaaagaatgtttgttaaagttatccatgatatatacttcagtgaaaataaattacagtggaaatatatatgttttcacacgtgtgtgtgtgtatatttatatatatatatatatatatatatatatatatatatatatatataattttttttttcttttgagatggagtctcgctctgtcaccaggctggagtgcaatggtgccatcttggctcactgcaacctgtgagtcccaggttcaagagattcttgtgcctcagcctccctagtagctgggactacaggcttgcgccaccaatgacaagttaatttttgtatttttagtagagacggggtttcaccatgttggcgaggatggtctcgatctcctgaccttgtgatccacccgcctcagccttccaaagtgttgggattacaggcatgagccaccgcgccctgccaacacatgtatatttaaataagtatatatatcatcactttaaaatattgatatgactatatacttgtatttcaaacaatcttgaaaatacaaaagcaaaactgtagaagcagtaatatttggaggtgactctggagaagaatgaggactcagttttaccatcatatatattgtcttatttgaatttattatagcaagcaaatagaagatttgtaatttaaaatatagattaaaatggcactttttcctagattttcattatttttcttaagaagagcatcattttctgatgtttttgagcctctgcttttttctttgagcactgcctttcctagagctgaatgattaactctcctccttagggatatttgttgtgcagttcacaagttcaatgcattcaggtttttaaacatgtgctttatttcaattttaaaattatttttatcttgtttactcgaaatccaagaaaactttttgaataaaaaaataaaaagtctgctcattaaaatacatatgcaactttagagcatgggaaataaaaggactggaaagaagacaggaattagtgctggacaagttgtaaaaataatggtttccaaatataatgtttagattatgaggaagaaaaaaagtgataacaaatttgaaagttcattgtctttatcactctgggtattttctcttgatgaatagcaaagagagactcaagctatgaataggtcacatagaagaaatattagagattattttaaaatgtggttgcatctgtcttgtgttcagttttgtgattagattttagtgctctcaggcatcaactataccttgctgcttctataattttctatcctgatccctcaatttttagtagtttaggggcttcacagtcaattacaagggatgtctctggatttgaagcttttaacctagcttttagaagcagggtcagggatattattttgttccattgcaatcaaatgacattttcagttatagccatattctaagattgtcatttcttgctaagactttggaaaaggctatgattttgcatctagagagtcacctttctgagttatctgaaaaggaaaaccaatgagattttcacaatatctttgactaaaaagtttcaaatcatttttacagcattcattaaggtttacaaggctatatatgtaagtagagagaaaatttatctaaaatagagaataaaagtagcttagcaggacaaaggtaacaataaaaccctatggagatgaggcaaaaacagtggtttaaaaattgtatgctgtgtaggaagaaacacattacgtaaactaaaatgtggttgcaaagccttatctcacatctcagtgtgcttaagatgtcatgtgatttataatatactctaagtgtataacgcctaataataactgtgctatgccaggtaccaatctaacaactttacatccattaacagttatcattatatactcccaaccatcctatttgggatttgggggttggagttattatctcattttaagataaggatacctagccactgagatgttaaattttttgtgcatagtcgcacataaacaggaaaaaaatgaggatttgaacctagagatgttgacacttgtgtttataaatgtaatcatattttgtagatcacaatgaacaatgactgaggcaattagaattagtctttgaaacacaaagaaagcagaactatatgtatttaaggaatatggaaggcccctagcccaattaacatctcaccactggttttcttattaactaaagagtcactctgttttcattggaatacactatttttataactataaaatgtagaatttaaacaggtaatgaacagaagaggaaaactaaatagataattcataaacgaatatgttttcaacttcataagttattagggaaagcaagacagattaaaacaactatgaagtacctttttacattctttaattaaaaataaaatcagacaatatcaagagctggtgatgatgtggagacacaagaactgtcatactttacaggagggagtccaagctactatgaagagcaatttggaattatctaatatagtcaaagatgtggataccctttgatacagcaattttacttgtagttatacatgttagaaaaatctttacacatgtgcacaaagacacctttacaaaactttttatttttgtagcgttgcctgtaaggggaaaatacaaacaattggagagcatatagataaaacgaatgaacaagagctgcaagactcaaaaaatgaatacatttaaaaaatagtggatctaagaaaagcagattatccaaagatacagtatgataggattattataatacttgaaaattccaaaataatacttactgtttttagatatttatttgttgaaatagtataataacttataaagtaataataaacaccaaagtttatgcatagtgatgggtacctccaggaaagaggatttgaaaattgccaggctgggagcggtggctcacgcctgtaatcccagcactttgggatgccaaggcaggcagatcacaagaggtcaggagttcaagaccagcctgaccaacatggaaaaaccctgtctctactaaaaatacaaaattagctgggcgtggtggtacatgcctgtagtcccagctacttgggaggctgagccaggagaattgcctgaacccaggaggcagaggttgcggtgagccgagatcacaccattgtactccagtctgggcaataagtgggaaactccgtctcaaaaaaaaaaaaaaaaaaaaaaaatgcctcacagggagtttcaactttgtcttttatgttttattttatatacattttaaagtaaatatagcaaaatttagaaatttgataaaatggcagggtagctacttgacattcattatctcctatgctttgtttatgtgaataaaatattttacaataaacataatatgtgctctttatcagaaaatagaaaatgcaaaaaagaatacctcatttactccattacttaaagacaacaattttaaaattttaaaaattgttgtctttaagtaaatattttcttgcagtcatactattttacaactatttgtataccatatacacaattgtgtgttccaagtagagatatgtcatgaggtgtgtgtttttttctttccagtctctattaaaataatactctacccatgaaaacacatggaaatattattggctattataactccaggtgaattattttgagtgatagttttccaatcacagccacctattttgaggtcctgagggattgtaaaactagcaagcatatttccatagtaggaaatgggctaaagtttggtgtgctttctaaagggctccagagtccaaggggcaggtcagtaaggcctttgggtagtcgaggagaatgggcatctgcatgcattactgagagaggcggtctgtgaaggataaacttaacctgctttacaattttgccttgggctagccctggagagaatgatgaataatcacacaggatttaatgttgtactgtatctaatatgcagtttgaaggaatagtttatttttggaaacactgactgagacataatttatcatcagcatctaaaagggtgtgatcatttccaaccatttccaaccagcacagcatagcagcacataatttttttttttttttggtaaaatatgcctggtgtgactgattaaagagtgaacagtcctctgcagccatggatgcatttgtgatttgtgaaataggtgcctgattttcagcaccaggctctgtggacccagctctgttttcaagcaaagttaagaggcacatgcattggggtaacttttaaggggtcaatagaaaggctgagcttcacaacgttggtctgacaatatgtaattagagatttcttttatgacatactaatataaccctaggaaggataccgtgtaaactttaccagttgcctcattgctatgcagaaaaaggaagggttgaaatgtcaggttctggtttggggtaaggcgaacgatgttgtgtaacatctgatcgtttatttaaaatgtgtatattttattcatcacagattgttggattttgatttttaaaatattgcattgtattacaatattatttatcttgattactgaggttccttgtgtctccttatattttgtgtgagtgccttacttgccacactgtagtcccctaacgataaaatgacagcagaaaacatgtggaactccgcacaaaacccttcagctacctctggaggtgatgacatgggctcaaacatatcatttatatatatatatgtgtgtgtgtgtgtgtatgtgtgtatgtttatgtgtgtgtgtgtgtgtgtttgtgtgtgtgtatgtgtgtattatatatatatattatatatatatgatatggtttgactctgtgtccccacccaaatatcatcttgaattatactcccataatttccacatgttgcgggagggacctggtgggagacaatttgaatcatgggggtggtttcccccatacagttctcatggtagtgaataagtctcacaagatttgatggttttatcagaggtttctgcttttgcatcttcctcattttatcttgccaccaccacgtaagaagtgcctttcacctcccactgtgattctgaggcctccccagtcatgtggaactgtaagtccaattaaacctctttttttcccccagtcttgagtatgtctttatcagcaatgtgaaaaggaactaatacagtaaattggtactagaagtgggagtgttgctgaaaagatacctgaaaatgtggaaatgacttcggaactaggtaagaggcagaggttgcaacagtttggatggctcagaagaagataggaaaatgtggaaagtttggaacttcctagatatttgaatggctttgaccaaaagtctgatagtgatatggacaaaaaggtccaggctgaggtggtcttagatggagatgaggaacttgttgggaactggagcaaaagtgactcttgttatgttttagcaaagagactggcagcattttgcccctaccctagagatttgtggaactttgaacttgagagagatgattcagagtatctggtggcagaaatttctaagcagcaaagcattcaagaggtgagttgggtgttgttaaaggcattcagttttttttttaatttttaatttttaattaatttatttttttattattatactttaagttttagggtacatgtgcacaatgtgcaggttagttacatatgtatacatgtgctatgctggtgcgctgcacccactaactcgtcatctagcattaggtatatctcccaatgctatacctcccccctccccccaccccacagcagtccccagagtgtgatgttccccttctgtgtccatgtgttctcattgttcaattcccacctatgagtgagaatatgcggtgtttggttttttgttcttgcgatagtttactgagaatgatgatttccaatttcatccatgtccctacaaaggacatgaactcatcatttcttatggctgcatagtattccatggtgtatatgttccacattttcttaatccagtctatcattgttggacatttgggttgcattcagttttataagggatgtagagcataaaagttcagaaaattattggcctgacagtgtgatagaaaagaaaaacccattttctgaggagaaattgaagccagctgcaggaatttgcataagtgacaaggagccaaatattaatccccaagacaatggggaaaatgtctccagggcatgccagaagtcttcactacagcccctccattacaggcccggaggccaaggagaaactggtttcgtgggccaggtccagagtccccatgctgtgggcatcctagggacttggtgccctgcatcccaattgctccagctgtggctgaaaggggctaacatagagcttgggccatggcttcagagggtggaagccccaaggcttggagaggtgttgagcctgcgaatgcacagaaatcaagaatttgggtttgggaaccttcgcctagatttcagatgtatggaaatgcctggatgcccaggcagaagtttgctgcaggagtgcggcactaatggaggacctctgttagggcagtgcagaagggaaatgtggggtcggagcccccacacagagtccctactggggcaccaccttatggacctgtgagaagagggccactgtcctccagaccccagaatagtagatccagctacagcttgcaccgtttggctggaaaagccgcagacactcaatgacaacctgtgaaagcagctgggagggaggctgtaccctggaaagccacaggggtggagctgcccaagaccatgggaacccaccccttgcatcagtgtgacctggatgtgagacctgaaatcaaaggagatcatttggggcttatttctgcacagtacctatcagcttttaatgtattaacttatattttctgtctcttttccactaggatgtacactccatgatgtaggtatttttgtctcttattcactgaattatttcaaaattgattagttgtaggcataagtgctcaacaaacttttgctgaattaatgaatacgttgataatggaatgtaacttctgtttttttcatgtaaaagtgatatttttgattaagcaaactaatatttgatgctgagaaaaaaaacctacaaagaaaactaaattgttcaaaaacatagttgttcaggtagctaactaaatacctgcagtggtgagttggaagactctcagtgatatgcattgaattaattagataatctgtctctcttttcccttctcactctctcccactctttgcataaaatcaacatttacaagagaatccctctttctgagcacttttctgtcactaactcagtctcactcttcattaccttttttacctgaacaatcgttgggtcaccaattataatatctgtctattgattaactcacatctttgcccctttttcttttggctcatttgtttaagttacctatcaaactgcaataattatactttttttgaggatattaatactcgctaaccacaaacaaaaatcattctgacttctgctatgttttgcactatagtacttgaagaagagatggcatgggctcagggttaattcattcattaattgagtcattccatttattcaacaaacatttagtgaacacctatgtgcaagaatagtgttgggtgttgtggacaaattaatgagcaaaaattggtcttctgtgtgttcttgtgtagatggatttaaaattatcactatagtgaaaatgcagtagtatatacagttgttcattggcatctatgggagattagctcccaaatccccacaaatccccaaatccctggatgttcaagtccctgatataaaatggcacactatttgcatacaacctatgtacgtcctcccatatacattaaataatctccagattataatacctaatacaatgtaaatgctaggttaatcgttattataatgtattgtgtagagaaaaatgacaagaacaaagtctatacaggtcaggcgcggtggctcacgcctgtaatcccagcactttgggaggccgaggcaggtgaatcacgaggtcaggagattgagaccatcctggctaacatggtgaaaccccgtctctactaaaaatataaaaaattagccaggtgtggtggcaggcacctgtagtcccagctactcaggaggctgaagcaggacaatggcgtgaacccgggaggcggagcttgtagagagccgagatcgcaccactgcactccagcctgggcgacagagcgagactctgtcttaaaaaaaaaaaaaaaaaaaaaaaaaaaagtttatacatattcagcacagaagaaaccacccagttttctcctgaatattttcaattcttgttgatgtgaaacccacagatatggaagctgattgcattttaactatcaaccaactatcaactatcctacatattttttttccgtttaagaaattttcttttattctgtggctcttctttccgtattgtgggatgtctacaaccccatgaatgttcgttatagcaggaaataagagctccttagagataacacctggttaaaggtttgaagttctaaaagccagccttaatgctatgcttgttacaggtttcctttgttcggaataataactttttttggtattaagtaattctgaccaaaaaaagtatataaagtagatttgattattattccttttacaaataataaaactgaggtacaaacaggtagctcactttctaaaggccccagagttgtgaaatggtaaaaccgagttgccaccccaatgatctaaacacctcttgtctggcttttgcaggtgaaaaatgacttccaatcattgtccactcaataattataatctctggtaaaaggccatttaaaaatagatttatggccttattttctaatcacttttgggatatgggaacaatcattttaaattgaacagtacctaaaattcataagcacatttattagattacagtagcacatatggtattattttcctgaaaattgaaccactggtttgaattgcacgaaatgtccaagttaggttattcattctcatgtactgagtgtatcatttttttcttaagaaattatatcgattcctattgaacaccagattggttttaatatttaacaagttaaagcattcctgggaacatggaagcaaaaattcacttgtatttagtctttgtgcataaatctagcctcttctgtagtaggataattgtttattcaagatatagctaaaaccaaccttaaaaagacagctattatactagctgcttgaatttggggccctctgctgaattcattgaagtagtttaaatctaaacttaatttttatcttttcaatgcagacatttcctgctttaatgcatctttgtctttttggccatgggacgttgaagaatgaatgacaggatatgtgcagctatttgatagaatacatttttaaaaggaggtgtgtgcacctgccaaatacacagcctatgtactggttgatgaaagaattctcagcaatgcatcttctcttggggtccactcccagatttcagtaatagacttctttgggaactacataaacatacttgtgtgaatgatgccaggactgctgttccattgccaagaagggcacatactagtttacagtctaggtatcctgggggctaaaagcctcacaggcctcagagaatatcattataaatgattttattcatttcattaaaaaatctgtataagagagactcattactaaatgtacagttaccttaatgaattggcacaaaacatgttacttgaattaccaattttatatcaatattttccccatcccttatagaaaaactgctgaaaatacggaacaagcatttaaaaaagttcttaatagaagatacaaataaataacatgtttctatagtgtacactttgtactgctgggtgaggtgacagaccatctgtgaagatacataaataatagctatctaaggatctgactgaccacatctaatcaagaaacattgttgataactgagaaccagcagttagggcatgccagacccaaggggaagcaaatgtttttctcccatcagtaggaagctgctgtcatgaggtaataaacaaattaagatctcccacaacaaaatacaagtggtatatcttggggataatgtcttagtaattgcattaatggaaggtcattttcaacacatgattatttcttgtgggaagtaatctttttgaagaagtacctgaagtatgttttatgttaactttgaaagaagataaaaggcactcatgattttttttatgccagcaaacactggggataatgagtcaccgaaagtgaatatttttcatgctatcttgttaaatagaaaatgaacaattatttaaagaatgtttcattagaaaatgattttaaagtggaattatataaagacctatgcaggacctgtttctacaaaccaataagaagggactcagatgatctctgtatataggtggagagctggtagttgtaagatattgatattattcaaggatttctccatttactgtaatttctagatcgattttcaggaagagtttgcagtttgtttatgtgaatattatatttatctcttttatattttttctgttcaagtttttcttgtttgttaaacccaatatattttggtttgtgggaatttccagaagatgttgataggatagggataggtttaggggagagattcccttaaaacctataccctcttgctctacctacatgcagattccagccctctagggaagagaaagaaagtgtgcttttctcagcataagtcccttccacccacgtaaaagggtacatgagaaactagtcaggagagaacattatttgagatccctctgaagattcatatgcacatcccctttcagtcagaacacaaaaatctctcatttgcaaaatgacatttataaaatatttctgtggttatttgattaatttctgtcatcttcactggaccatatgctctaagaacaaaaaggcaatatcttttcttgtccactacatttccatgtatccagctcagccagggaggaatgactgattttgtaactcaggaaaccccaggagttttcagccctctgtttctccatcaaggctcacctggaattcctaagattgcttgagtatggtgccctttgtcccttagacagaaggaatctgggataatatctggcattatccctctgctaaaatcatatagggaaagctaagtcctctgttggtgaaagcgcaatggtttaggattaggaattagaacccaaatccttctcaacccaatcagaggaaggaaagcagcagaggcttcaaaatctatgtcaccttttattctctctggtccccttgtttctcccagttaatccaaggaagttgtggcaaggctgtacctgaataataatagcatattaatctatacaaacattttaacatttgtgattgatttttatatatcacaataaagattatgctactaaattaataatatgaattgtttgtattattcattttagcttcgaccttatggtacctccaaacttcatagtttactgttcagaaatagtatgaattcatgtattaattcatttagaaaatgtttagtgagtgctgttctgtgccaggcactgtgcttgctcatggaaatagatactaagggaaaaagacatactgtctctgtcttcaaggagcttacagttaaggagatctactgtaacacaagaaatattgttttgtgtctcacacctgggggattatttaatagttggaaagaaatttagatggggagaaacaattgttttaacaggtaaaaaagcctattagcctataaatagttttctagcagagagaaaaaaccttgcaagtctaaaaacaaaaaaaattaagagcaatacatataatactacataatattattttttcttctaatcttccaaagttacaaaaattattagctcttatttcaatcatttcgtttaggttgactttttatgccttcttaaaaagttctttcatctattttcttttaattccaaaagtgttcagaaagaaaatccaagctaaaatgaaagatgaatactctttgcaatattctgacattttgtcacacccaaaagaaacaaatctaatctacacattctttatttaattatttattgccttggtcaatatgtaactatctaattgcatacatttttatatttcagtacagtttgtgctttgaattttactaagaggttttgagaaaaaaataaccgtttagctattatgtgaagaatgtcatgcataaatgggagtaaatattacttaacaattgtataacaaaataatattttgcacatggtacttaaggcaaatctttctgtaaggcaaaaggatttttttaaaaaaatttaatctggcactttagaaaaatatgtgagatttgaaaaatttcaagtgatatatgcatttctactttggaatccattttaactttcaagacaaagcaaacagctgttagagtctgagaagctaggggagagaagcagacatgaaagactattccagaaggaatcctgaactagtttataagatgctagtcacatcagaaaaagaccaattgttttttctacaaatgtcaaaggaagattttaaagtgtggggttgattttgttttccagtttggaaaaatgtgttactcctaggtgttgactctcagacaatgtttctgaagcatcagaaaatgtgtaaagtaaactcctaaatggtgatcttgaggtatctgcaggcaaactctcaaatgtagtgattgaaatgaagtctttctcatcagcctggaaaataaccactgttttctccactttacttcttaattgctaaagggcaatatcttaactctaatttatcccagcacagagtttgttttttagttgctttaaaacggagactatattgataaaatatttttatagctttgctacagcttaaaatacttttcttaccatgagtattgccttggaaaaaattattacaaaagttgttggatttagatcttgacccctaacatccctctaaaaattgtaatatttgttgaaaaagaacactttattgtgtaattgaggaactactaaagcacacctgagttttatatgcttaaatcgtactggtaattctatagttcctcatgttatttgtttagcaatatctcctttgcactatactaaaagctagttaaatagccaccatgttgatattgttcaccagtgacacctttgttttgagttggtggcagagtttctacatgtatcagtgagacccttgaacaggttgttcaatgcttcatttatgatttcccattagtatggcctagtcagtccaagaaacaagggcttttgccgaggacctcacttcagaaataaaatggaacaacaatatattttgatttgctgaatgaataaaaagacaaattgttggtcctctgccttattgttatgttgaagttaattgaccatatttaagcagacaaaataattctactaaatagaaagattagccattacttctacagtgaaatcctctgaaatactgcatgtattgatttggatctttgacttttttcccctgtgttaagcatttttgcatctttcactctctgagttaaatgaaataaatgaaacttaaataaaatatgatatgcccaggacaaggtttgtgcacatttctagtaaaaatgacgaatgggtttagtgagttatttttagtcaattatgttaatggctgactataagtagggtcataaaactgtacatatcaaatatgtgtagttctttttatatcaattatacctcaataaatctgttaaaactaaaaaagcagagtgtctattttaaaagaaatttgtgctacaatctttcatgaaaacaaagcagaatagaaagaatgcttcaaattgtcatggctgatacagtaattgcagtatagtatagtaattgcagtgttaatctatgattttaatttataattaatctataattttaataagattttatttgaataagtttaatgtattaagtaacaatagttttcaatgaaaccttaaactgttctttcttaaaattatgtatactaaaaatgtacaagtcttcatatttactttgatatgatttccaattgtgcaggtggtttagaatttggaaaatgtatacttcagagcttgactattacataattacaaagacgaagcatagattatgtcctcaattatgaataatacttcatacttttcatgattagtttttgattttactgagccattctctggggctttcacaagtattggcaagggacttgaactctggcaatttaacaggtcgtttaatgctttaaagatgattcccattaatatggctccatcagaccaaaaatcatggacttccataaggctttttcaggacctcaattacgttaggtatttgagtgcttatccaatatactgatttgattacttgagatgtatggattttagaagaataaaagcaatgtttatataaggcatttatgcccaattctgaaagtaggaaaagatagtgcctgacaaataaaccatcataatgaatggaatttctatcaactaagatctttcctcctccattcctacaggttcagccaaattgggtcctaaaatacctgcattaattgagtgcattatttttgttatcatgggagctaatgctgaatatttcatagcatcttaatgttggaaggcaaatgtagtggtcatttatttcaattgcttctttaatcagaaaaactttgccctttaaatactcaagttgcttcaatgctaaatggtacaaatttgatcaggtgataaatatagatcataatgtttaataatgataacacagcaattatcaacctaaaacacctttgctgatatgactactacttatgttcgcttaacgagtattcccatagcttgcaattttgactcaacattttaaagaagatgcttccagcctgctaggttaggttcaagtgatttgcacaaggcttccactaacaggaagaaatgtctatgtccctcgcagcagtcacacatttaatcaaatacagctcataaattacatttacaatctttagacttcaatcaatagggtattttatagtctgtagaaaaattatctggagagaagtaggagaaatacaagaaggatgtagctggggcctgtccaggtctagaatctgcactcttgtcatgctgaagggattaacctaccgattttaacaaagagggatatctccaaatcagctgtgtgcagggccagggcaaagttggtgctaatgaagcattctgggaagacatgatcaatagcaccaaagcaaagaaaatgtttatgttctttcattcaacttcggagtgaattacaaaaattaattggggaaaagatcatggtgcttacagtaactgatcccagtttacctgcttctctgtaaaagtagcttgctaatgataatgtatcttaagatctcatagttgtacaatattatactttagtggcatatttcctggacacaataatgtgctattcctttttcactctcactgtgataaaaattttgctaaagttgtagaatcacagtttataaaataacagcttcatttagattttccaccacgtgcacacaaataggttatttaatcagtttctaaaattatatgagcagtagaagatgtcctgctggctggtccaaaatactttgatagaagaagtgagaaagatttcatttagatgctctaaatctttctgtactttctattaatggttatgcaagttttgtggcaaatcatgctcccaaataagagaatcataccgcaaggaatgattaccatatatttatttagtttctggtatataaaatggtacctatgatatgaaattaaattatacatcaatgtggaaaatgatggactttttgagtctcgagctatcttaatgtcagacaataaggattgtgattgtgatgatggattattgatgtttaagttcctgagagtaaaatgataagaacttttcacaacacaaatatgacaatgccaatattcagaatagtgccatcacttggctttttttctttcaaatttagcacatgggtttatttatggcagacaggtatatattctgtgtctcctgaagtcccaaagttctcagactattcattcaaattcagggcaggttacaagaaaggatttagaatctggctgactctgactttctgacttacaggtaatgcacaaagtccaaagggcatacgtacatacagacacacacacccatatatatgcacatatatctgcctagatgtatgcatatgatatattaaaaattatattaatgaaaagataagcagtagcctgggataaaatatttgcaaattttacattaataatttgtatcctaaatttattaaaccacacaatataaatccaataaaaataaggaaaacatttgactagacattacaacaaaggagatatatgagcggcattatgtacattaaaagatatttaacatcatttgtcattagaaaaaaacacaaaatgataagatattactttctattcattactactactataattcaaaaaccagacaataggccaggcgcagtggctcacgcctgtaatcgcagcactttgggaggccgaggcaggcggatcacgaggtgaggagatcgagaccatcctggctaacactgtgaaaccccgtctctactaaaaatacaaaagattagccgagcgtggtgcggaggcctgtagtcccagctactcgggacgctgaggcaggagaatggcgtgaacccgggagggggagcttgcagtgagccaagatcacgccactgcactccagcctgggcgacagagcgaaactccatttcaataaataaataaataaataaataaagccagataataacaaatgggtgagaatgtagagaagtgggaaaacttgttacatttcttattgaatgcacaatggtgcagtcgttttggaaaacagctgggcaaattcttagaaagttaaacgtaagtttacaatacaaaccagagcttctactcctaggtatctaagcaagagaaataaaaacatgtccacataaagacctgtatatatttttcataatggctaaaaattagaaataattcaaaggtccaccaacttgtaaatcgataaaaagtagtatatccataccatagaatactactcagcaataaaaagcagtaaaaaacattatgctaagtaaaaataaaacaagccagatatgaaataccacatattgtacaattccattttatgaaatatccagggaaggaaaacttatggtcataaaagtggattaaggattacttggggtaagggatgacaatggggagtgaatgcaaatggacacaaagggatttttttgggggtgatggaaatgttctaaaattagattgtggtgatatttgcacaaggcagtaaatttacttaaaatgagtaaaatttatgctatgtcagttttacttcaatactgctgttaaaaaagcaaattatactcttagacactagcattagagtctcaaggtaaaaatcaggttagaacatgattcagagaatataagaaaatttaacatttctagaattccagaaagaaatttttcaaaaagtttgcaaagttttatctaaaatttattttgatgttgtgtatcaattattaccctccttagatttgtgagctccataacagtaaaggtcttgaccttgttcatcagttttttcctggcacctagaacagtttctactatagaggtgttactcagtaaatattgataaatgaacgaatgacatgatcctcatctagttggtcaacttatagagaagtttcccaatgattcagtgggggtttagaatcgggcatgcagatactgataagaaaaaaacaggaggtagcagaaggcctgatgcgtgatcagagatatacaaggacagggaaggctgagattgagaggggcattatcaatcaattccaacaggaaatcaatgacatactcaaacaatttgaggaggagttttttttttttttttacaaaaaggattattgacaaaactatactcaagatataaagaaatcatgaagatatagcaagctggggctagtaaatgggagaagcttcagcagagggtcctaagacaggaaaggagggaggacttcctgaagcccagatggagagagttgaatggagaccttttgttaaggtgttagcccatgattacttctcatggcaaaagccagtaagagaaatacatcgatctcattctcctccctctttctcatgtcctgcttggctctttattgttcaactcaaacagaagtccgggcccatgggagtctgctaaatatatggatagctcagccttctcctacagaaacatggtagagaaaggtggaaagtggagatgggggtgcaaatggaaggtaacctgcacaggagtaagccttagaccactggagtctggggctaagtgtaaggaagaaggaattgaagtataatgcagaagctgaagattaacactgggtatttaaaccccttgcttggataaatagggaaacgaatatagaccgatgaggtttcaatactatacaccttatatttgggttgtctttgaagtatggccaggctgagattttaggtaggcaattagtgggctgcaatgcgaacagctgggagagacagatgaaagaaaacaggtgctgatcttacctgcattaaacttcactaggtttgcttttccgcattgtcccactctcaaaaaagaaaaatcatttgctgcctttttatatagttacaataaatagccactaacagaaaataaaaaaatcttgattaaggaagctttggctagtcagaaagcaggggttcaaaacacaatgtatcccctaagcaacttgcttttctttagataaatgtatttgttatggctgcggtaacaaattaccacaacgtgggtggtttaaaataacagaaatgtattgtctcatagttactgaggctagaagtctaaaatcaaggcatcagcaaggccataccccttctgaaggctctagggaagaattctttgttgcttcctcctagcccccagtggttgctggcaatctcttatctcttacacttcttggctgcatcgctgccttgtagttcctaccctgtcatctctctgtgtgtttctgtctgtatccaaatctctccttatagcagcaccagtaattgaatttaagaggcatcctaatctagtatgacattatctacactttcttacatctgcaaagaccttgtttataaacaaggtcacatttgcaggtagcaggaattagtacttaaacacatctttttaaattatacagttcaacccataagaataaatgataatacaaataataaagatctcatttttatgtagcatttcacatagtactttcatacacattttgccctttttccaatcccaactttttctcatctttttaaatcactctgctgagaggcaggcaggataggtatgacatactgaaacaatggtgagtataaaggcattgtgcttactttctgcagctcggattgtgatttgacccccttatgcctttacccctgaacctaccgcttcttctgcttactatattgcttatccgtaaatttattcctttacaggtttagaatggcagggataacctgcccactactttatgatacaaagcacatttcttttttaattgtgtatttaacattaaacattttatggtactgttagtttagttattgacttggtttaaaatcatccaaataatgataattacggtatccatctatactcttgactgtttctctgaatttatacatctatatacggaaagtaagtggaatttaaagacagtataatcttatagggatctgtgggcccttaaaacatttttagtttagaataatgcctggagtagtcaacatataatgtcataatgatcttgaattcaggctccttaggctgcattttgcattctaaaaatgaatgagttggttgaatgagtgtataaatacatttcaattatagccatatctatgctttacataaaaaatcaaacctagcttttactgactgatctagaatgtacttactcttaaagtaccattgagaaatacttaggtatagcaagattttgaagcaaaagaaaacctttgaagatataatattgattaatgattattgatataacagtcttccactgcacgtaacaaaatacccagctcaaactggcctaagtgataacagaaattattgtcttagagtaactaacaatctccatagattaaaaaaaagttttagatgggttttattggggagttgggtttatttctctgccatttccttctccgtgtgttggctttttatcagggttctatacccttattaagcaaggctactgaaccacatctgacctgcacagccgggctatcacctttccagcgttcacatcaaggagtctgagagtcacactgctcgtaggtgaggtggtcatggactcaccctgagcctttcttcaggcaggaggactgaaatgtgctgatggctccaaagaaaccaggacctacccctgggtcaaaggggaaggatatatacttgaatgaaaattagaataagttttaagaagagggatggcagaataatcaatagatgtctacaacatacacccatcaaccttttcaatattctttcctgatctatgtagagagttgatatcaccccagaaaaatatgcatgcacaattaaagtattgtaccttactttctttgtcatcttttttttttaattctggtaagaacacttaacttgagatctcttctattaaattattaaatgcaaaatacagtatacataattatactcagaatgttatacagcagatctctaaaacttatatgtcttatataactgaaactttatacacattgaccagaaaccccaattttcctgtgcccctagcccctggaaaccaccattctattttttatgagtttgacaattttagttaccacgcgtgagcgaaatcaacactgtaagtgggaatataaactggtgcaggtgctatggaaaacatggtggttcctggaaaaaaataaaaacataactatcttatgacccatcagtctcacttctgggtatatcttaaaaggaaatacaatcaagatctcaggcagcaatgctcactcacctactgcttacctcctactgtgtggctcatttcctaacaggtcatggaccagtactggcccaggggtgggaacccctggaataaagaatcataactgagatgttgttcaaggctaatctagaatcatatctgtgcttttagtttcagatcaatggtgacattagattctcataggagcaggaaccctattgtgaactgtatatgcaagggatcaaggttgcaagctccttataagaatctaatgcctgatgatctgagcttgtttcgtctcgaaaccatcctcctccccttcttcctgctggccaaggaaaaattgccttccgcgaaaccggtccctgttgtcaaaaagtttgggatcgctgctttattcaagagaccaacgctgaatatctggtatgtcccaggtactagctatggtgagcagcagggactgagagtagaggaacactacacggataaattccacatagttcctaccatgacagaaactcatagtcttgagtattcttctgaccagcaatggaattttaatatagcagctaactcataaagatacagtgaaaattaaatgacttcatatctgtaaagttcttgtcataatgcctacaactatgtttaatatttaaactgtgatagtgaccaggggataggtttaggccaaaaaactaaagttatgaaagctatctatcatataaatacaaactttgtgggaaaaaattcagtattattggcattcatttagagggtattaacaaatcacttgccctatcgtagtgacctaggtggtccagaagctggtaggaatcagtccttggagtttaggagtttattgtcctttcagagtttcatgtgaaaacttgaaacagcatcttaacctgtttgattccctccctctatccgcttcccatttatcccccaagttagctgtagtttagaactttaaatggtaaggatggatttttgtaaaggccactcatacttattttttagtggtactaccaacaatctatttactcatccttttaagcttttcagtgtgataccttaatgggaacttttacttaaaaagcagggttcgattaatcatttcactttgttgctatatgcttacttttacatatatgtattaaaatagaacatatctaatgagtggtaaaatctttatgtagaatgtttttgtctcagtgtatcttaatataaactacaatagaatttaaaaaacaaatctggaagaagtatctgcactccaatgttaattgcaaaattatgctcaacagcagatgggaacaacctgagtgttcatcaatggatgaatggatgaagaaaatgtggtttatatatatgatgaagcattattttaccttaataaggaaggaaatcttgccatatgtgacaacatgggtgaacctggaggactatatgctaagtgagataagccagtcacaggacaaatattgcatgattccacttacatggggcatctaaaatagtcaaatctatctatttttatttatccttatcaataagttcatatgtctttaaataaaatatctggccaataagagcaaagtctcatttttcaactgaaagtgaaaaaaatctaaggatcatagtttttaatttcttaaagatgtaggtgaatttcttgtatatttttgcttaatttctaggcatatgctagaagtgaaatgtaatttagaggactatatttctttccaattgctcatttgcttgttgaataaatatttttgttaaatatcacaatcgtattactttggggaatgttacttataatagtaatacttaaattgcaagatgtaatgttataatctttttatcatcaccaaagatctttattaacattttaaatctaaagctctaaaattaacaatttaaagttacatagatagaaaatcattttattcatatgttaaggttaaccctatactaaaatattataatcatttttataatgagggcatttactctgtgaaacaattagggtaatgtatacaacataaatgtaaagatattgaagataatgagatatgtctcataggacatatgttttacaaatcttagtcaattatttagtgtaaaagactttcatcctaaattaaaatgaagataatacctcactaaaatgcatgtaataatttattctattatctcaattcatgtcttgatcatatttgtttagatggataaaaccacttaagaaaaaatggtaaaatatctggtggatatacaaatcacataatcatgagttaataagaactcatgttggatttcaagagttttttttctaaaactagtagactaaagaaggtaatctttgcaaggttgttagaaatacccatcacaaaaatactgcatataagttactgagggctttttgatgttttacactgaatctttaaggtttctttccttgccatatgtaaagaaacaaatttagagcatattttgcatttatgttttcttgttataaatttattcctgaataagtatcttctctttaggctttaataatatctgattccttgggtatgtatactggcataaatgtaactcactcaatatttctatgcctctatttgatattattaatttacattgatttattcaataaataaatagttatttaatatctcctgtcctaacctaggttctccagaaagcaaagcctcagacaaaagctagtgtgcttctatccctttcaggaagtttaatcccagggagcagaagtgagggaagatagtagtaaagaaggaaaggagagaaaaccaacgcagggatgcataatctggctaccgctgagtgtcaaggataaattattgcttcattttgcccaactgcttcgtgagagcgtacgtaaattattacttctccagatagtctgataaggggaggtaattcattcactggcttctgtctctttgtggtgagactgttagtttccctacatttctgaattgcacatgccagggcataaagaacactggggcatctcaccagatcagcttcagtggggaagcccagggaatagtaggtaagaccagcacaggatgggcatgaggtaaggcattgtccggtcatgccctgtgaagtttgtcacgcaatctcggtcaccccaacggcaactgtggctagaataagagccaatatccctagagaccttatctccagatgacctaaaactaagaggacctaaaatggggtatatatcaggaacaaaacagacagatattcttgcttttttggaggttgcattctggcagagggataagacaataaagaaaaacataatgaataacttatatcccatagtagaagataagtgctatgggaacaattgagcaggtaagagaggataaggaatgtttgggtggtgggattcaattttaaacatgatggtaagggttggcctcactgagaaggtgacattagagtaaaggcagatggcacacagtcccttgttgctggcaaatcagtaggaagcaagtgtggcagggtccatatggtccagtggggatgggaggaatggaatcagaaagggaagaccaggtaagtcaggggcttagaggactgtgcaaatatttcattttttactctgaatcaaaggagaaccccagcagggcttagagccaaaaagcattatacaaattatatatattggattttggcttctctctggagaagacacaagaagaagtaacaggtgggagcagaaaggccagaaaaaaggcaattcgagtattccaactaatttcgaatagttttatgattctttaagataaaaaaaatttgattgtaaactttttgatatcaagacaccatttgcatagcagaataaattttaacatatcacgattgtgtgtgtgtgtgtgtgtgtgtgtgtttgtgtatgtaccaaatacgcgtgaagtttcttttgaaatttggaatctgattcagtcatttttattttggagaaacatgaaaaaaatcctttttcattcaaatttttgaaatgtggattttaccatggaaaaaaaacttctaaattctctagctgaggatgtcggtgcctttaaatatgatgctaatttttcttaaggaaatatctctcaaagtcaatttgtttctgataactaatttgttgttcagtttttgaagtgctttcaaattgtttgaggttctctgttatgtcttcatatataaagaaatttaaactttaaggaccgttattgaaaaagattaaataaatgaccttaggcttttagtctagtttccatttgactttatgacaaagttgagtttaaaataaaatttctcaaaatctgatattaaaagatgtaatattattttgaaaattctccctcctttattatttgttgttgttgctatcaatgatattttaattgaaaacataagttatgaagaatggattttacaaataatttactataaattattcataatttacatcatttggtaattttatccctggaagtaaagcaaaactttatattttgttcataattatcaaagttactctataacaactataattaatacatatatgacagttaatagaaattattgacttcctgaaaacatccatttttttctcctttttctccttattttctttctgtgttttttattttctattcattttcagaaagcaagttaatttcttttaaatgagacaatttcacacactgtatatatatatatattttattaggtgattttcaccatatcttgtactatttgatttcctttcttcagtcttcctctgtaaactattgtaaagctaatcagtgttaatagattatattttaaattattcttctaattagttctccctttttgaaatgtcattaatcccttgaattaattaatttcatatgaatatgcatgacatatttttctaggaagtccgtttaatttagtttggtgattgcattgctaatcacctagataatttttggttatcctcatcaaataatgtttactgaggcttatgtttatgaaatactgctatgagaggtgctgtaagagccctgtgtggcttcatctaccatgattcacacttgttatgtctatttaattttccatactttgttttttttctctcgggcataacttgatttctctgatactttagatgcaattaaagagtctttagtggtcagaagttccacttcataatttcagtgattgtctatgttttatctgtccagaaggttttccccttttgggggcgacattaaactctcacatctttaggggactactcagttctccttttagcatattccatttactccaacccttggtccaatatggctgttatttggctggttaattgaagtagcagaatcattggccaatggcagtaagcatgtgactcaaacctagccaatcagtattcttccctaggtttgtttttttcttccttggaataaaaaccagtgctatgaaagaagcgatacaggttattagttttccatctgttaaatttttctgagttattctggtgtgaatgtggatgtatgttttactagaaagcccatctaatttagttttccagttgcattgctatctacctagataaaagaagtgaactggaaaataaaaacaaaattagggatcttcaataaaaaggcattttgatgatatttgcagctctggagctaatcatctttgaatttaactgtaccaggccctttccttggtttagttatatgaagacaacagagtccttgtattatctaaattgctctgactctgtaattttctacatgagtggaattagtttgggttgcttaaatacatggtgatcaatcattacatagcaaatcacatcaatgagtttacatatatcatggctaaagcctacatgcttaactctacagatggaaaagcgggggatgatagactttagcactgtgcctgagcatcatctccttactcttagtaggaatcagagagatgtgacctttggcccataatacactatgaattcactttcctcctctgaaggaggaaattgacatgacaaacaaaggattttttagcattgccaggaggatatttaaaaagcactttaaacgcagtgaaataaaagcaccaataataaaaaagtcatataaataatatataatcccttactcctgacactggtagttatttgctcatattcttacaataatattaaatcactattaccaggagacctaaatttataaaccaagtttggcctccaagcaagtccacaattgcctctgtaggcaagaatgttggcttttttttcttacttttctgcttgccttgtaatttgaaattgtactcatagtgtggcaataaacttgtaatagtcagcttttagaattactagacatctccttggcatgaaaaagcaatccaaagcctccggaacactatattgattcattttaaaaccaacccaataatttttctagtgcaagaatggaatgcatattattttatttaaaaactaaagaatgtatgtccaaatagtttcagataatacttgagagctagttcctttgggtacagtttctactttttcaattgttttggagtagcaaatataagaatagaagataaagtacttgcaggcttcttcaataagacatcccttattgctataaaactaccttgggctaattccacactaaaactgacagagcatgagactcaagaaattaagtttttaaaaaagacctaaaatgccaattttaaatcacagtataaaccaccaaagtaactttcagagtttttgaaataagtaaaatatcaactgtgtgatgaaacttaagatataaaaccgtgagcttattacttctcatgaaattccagattgatattcacacggcttcaatattacatgtaatcaagcacagtaagaggcctggcacttagtaggtattccaaaaatgttgaattaatgactaatcaaatgaaagaaaagacacatttcagagtttataaaatatccttggtgccaagtgaattgttataaaatcttaaattctattctttcagggtgctaattgttattagtgacccatttcttattcctatacacttcatttacactttggcttgtgtttcagacagaaattggtactgaacttaggagctgattcttaaggcattaagaacagatgaaaataaagtctatatgagagctaggatttttgtctactttgcacattacagacagtgaattaagcatattcaaagagggagctcaaggtataattgataaatatatgaatgaagtggaaagtggagagaggaaaatcattttccaaattgtatacagataacacattaggaagacgttatcagatctgaggtttgagataaaacaaaatgaatgaataaaagtattggataaagtactggggagaaatgaaatgggtttggatagatctaaagcagttcaaggtttttctattaataacacttttgatatattaaaatactgagaatactatcagttggaaaacataactggattaatatttttccttgtcaacaacaaactggcacatttaaattcccactccctttccccaaaagacaagatatcccagagtttaaaataaagttttatactttgcaggcaacttgtcaagaatgcttgtgtttcatacatgtgtaatcctccattgtattaaacacctaaagccaaagttattactttattcacaaatggtcatagttctaacacctactaccgaccaaaaataggtcaataaattaggtttaaacctcattttctttttttgacttttatttaggcttgtggatgtgcaggtttgttacatgggtaaactgcatatcactgaggtttggggtatgaatgatctcaacacctcagtagtgagcatactacccaataggaagtttttcaacccataccccctcccattctcttccctttggtaggccccagggtctgttgttgccatctttatgtctatgtttacccagtgtttagctctggcttatcaatgagaacatgcacaaacctcatcttaataagtgaactctacaagtatttactgcaaatgtaacattgagttgggtattacaggtatcagaaaagattccaaaaaaagatctttgtcctaatgggctatgtaatcttttgcttttatttcaagatttattttagatttgaggatacatatgcaggtttgtcacattggcatattgagtgatgctgaggtttggggtgcaactgatcccattgcccaggtagagagcacagtacctgatagtttttcagcccttgccccactctgcctctccacttatggagtccccagtgtctattgtttccaccttcgtgtccatgtgtacccaatgtttagctactacttgaaagtgagaacatgctgtatttggttttctgctcctgctttagaaactatataatcttttgaaggagacaaggaataacatataaaacaagtgaagaaaaaagaaaacactgacaaaatatagagtaatgccttataacatggtaaattgaccataatcaaagactgtactctatgatacagacaacatcctccactggacattaaagattttagattaaaagcaatggtctgcttgtataaattttattattaaatcattaaattgcaataaagaattccttcaggtaaagactcttttaatacactatttaataaaaataaaagcagattatatgctctataatgattattcattattaaaaatgttttgtcctgaatatattcactcatgccaatcaaaaatccctgtaacaaagtccaaaattttctatttttggttttcaaaactacagtaactgcaattattatttataaacacacaatgaatattaacttttctttattacatttctggtggagtaatgcaaatgaatcacctttgaaaacaagagacacattgaattttcacagggccttaggagacacataacatttcattagattacttaattatcagaaagttaccaccaacagaataaatggtagcatcccagtccactaaaaaacgtgttttttatctcaaaaatgccatagacaggattaaaaaagcaattacttgtcacttctgcaaagattgtaatattcaacttactttaaatggaagatttttctaagggttagaaaattagctgctaaataggtcacagcttttgcaagcaattcatttttgttcgaaatattatcaatcagttgaaaaaggtaaaggacttctatgatgttatctcggatttggcagaatttaatttttgtctgtccatttctatttatgattgtatttacaggtgtcattcaatcattgtttcactcactcattgaggaagactcactatgtccttcagtattaaatattcattttcactaatacactaattgaatcttaatataaaaaaccatgcagaattatagtgtgaaataaaaaaattgcttttctttaaaatgtttctaattgtatctgttttgctttagacatacagcaatttcctgtttttattaagactacttttaaacttttatccatatgtgaaatcatcatatggaatctgtcctacaatcacactatttccccaactcattcatttacaatcacccagatggctagtttttgccttttctttcctcaaaattatattgccttcctttttattaagaaaagaatagctctaagaattcccacgagtcacacaactaaataccagaggtgaggagtctgtgttcctctgggaggccaacacatggggagaggtgttagagtccattgccccaacatactcaagggcattactcctccattctcttttcattttttcatatcaagttgttgtttctactgtatcattttcatcagcatataaacatatcgttattttgctcattttagaatgaaagtcatttatcatgtctctgctacctcagtaatccactaccatcagtgatcgtgtcctgcttctcttaatgcatcacgagcttcctcttaacctcaaggaaaaagacaaacatctcatcgggttgctgtctacctcttcagcttcagctcttccactctaagttcctgccattctgaattcacttctttctactcactctgctcctgagatttcataccagctgtgccaccaactggtacacactttcctgtgcctgccttccaccctactcctgtctaccctctttcctgtcgcctggctgcccctcaggcatcttttgggccttggctgacacagcacttttgcagggatcttgatatggtttggctctgtgtccccacccaaatctcaccttgaattgtagttcccataatcccaacatgtcacgggaacgaccaggtagagataactgaatcatgggggtggtttcccccaacttgttctctgtgatagtgagtgagttctcacaagatccgatggttttataaggggcttccctcttctctgggcattcattcttctccctcctgccacgatgtgaagaaggacatgtttgcttccccttccactatgattgtaagtttcctgaggcctccccacacatgcggaactgtgagttaattgaacctctttcctttataaattacccagtctcaagtatgtctttattagcagcatgagaatggactaatacagatctgatcctccagctagattagtgccctactcatgtgtgtgcccttctctatcagcctgtccaagtagtagagtgaacattctgtaaggtgaggactttacctcatttaccactgtattcctggcacttaacacaggacatggcatgtcaggcagtcaaaaagtatttgtatttgaatggataaatgaagaattgaggacattcaatactgttcaataaatattagcagacaattcagctgaagaaacaaagtttgtaataaaaatctagaagtttggttgtgaaacatgacttataaactcagattatacaggctagtataatttctaatatttaaaacttttaaatgtaaaagctataaaaaacacttctttcttaactaaagggaaatgcaaagttttcaccttgttttccaaaattatttcatatggattgattgaaacagtggtgggacatcaaaattaataaaattttacagccttcaaatgtctgatttcctaaaattttccctttttatggcaggtctcctctcttgaatttcacctgtaggattttatctccctttattttatgagaaaacacttcttttctttttttaaaaaattttgtaacgcaattttaaatttcaatttcttgagctttatacatgttagttgtaagcaaaatactcccatcttagatcagagcttttatttcagtgcatagttgtgataggaagtgaccctgagcgcctcatttaaaataaaaatcttctcactgtgtccctcccgtttgtcctggtcctggcctctctcatcacccagctttattgtcttccatggcaattatcaccattgggtcgttttgccattgactccttagtgcctgtctcttgtgttagaatataagccacatgtgggcaagtgtctcgtctgtgtttctcaccagtatataccaaagtgccttgtatgttatggagacttgattaaatactacatgagtgaatgaatcttctagttatttgatcaaaaaagctacctaaccatgtgccttctgcctgataataaaatgttatcattttaaagttttcttctttttcaaaagtaaagtaggtataccatccattgaggttagcaaaaggctagcatgttaaatacccacttcacttctgtaagtaagaaaaagctctgagctcctccataaagccacttcgctttctgcgttctttgaactgtattttaataaaaagtcaccattatgcaaaaaaaaaaaatgcatttgaactactggcatcttacactttttctcttctggaaggctaacacttgaaactacttgaagagaagtagctaaactatgaaaagtcactgaaaatcatttctaggaaatagaaaatttgccttttgctccttgttctgatttcacaaatgtaaattgatttcacaaatcagttttgaaatctgaattgatttcataaatctgattaaaaagaataagaattttattttttgtttttaaatataagatttatgtccatcagtaagtctttattcatgttcaatgctatttgtttatgtaaataacattgctatggtctgaatgttttttttctcccaaatccatatgctgaaaatctaatcatcagcacaatgacattagaaagtggggtatctgggaggtgattagattatgagggtggagtcttcatgaatgaggtctgtgcccttataaaagaggctgtagagagctagctagccacttccaccatgtgaggtcagtgagaagccatcatacataagtcagatagtaggccttcactagacaccaaatctgccagtaccttgctcttgaacttgtcgggctccccaaatgtgagaaataaataaataataaatatgtcatagcagtcaaatggactaaaacaaccacatattttaaatcattgtccaccaatacaggaagacattttttaatgttctgaaagtaatttcacttctaacccacagtcagctacatattgactatcattaactgaataaaaaagctttatcagaaagaaaaatactgtattcacttgattattttttccatcctgttttatttaaacatgtaattctcctctaagtgacaagtcatattcttgaaaatctcagaacctcacatcaaattcttagtccatctgccttttctgtaatcagtgaatgacaaattaattatactttattttagctgagttttatgtagacacggaaaggctactgcctactatgaacctgctttaaaaacaatgtgaagacttggaagtttatagaaatctaaaatcaaaaagagcaggtctaatatcctatattggagatgtttagtgccaaacggctctgttgtgatgacattcattttccttttccgtggaaaaaaactgtgattttcaaagcttgagagactttatggtcaatatcagattgccaaccttatgaaaataattgtcatcatctttgtccaaacaactacgtgtcagagagctacttccagatgtgctattcacttaatacacatattgtctaatccttactatatgtggaaagttgatagtcataccatttttgttttagatgtaaaagttaaaaaattgatagagctggccctagactcatctaaggctcttttcacaacgccgggctaaaaagcatcattgtgatttcaggtaataaccatcaggctaaaatactcacatacttctcaggcccaggaaggttacttaagtgagtaaagcaaagtagatgttgggttattacgaagaagagcacacaaggcccttgtacagggcagcgactcctcaggtcccaccaaaggctgtcacttgtgaatgtgcatctaaggtttctgattttgtaacttttcaggaaaggccagaaacctagatgattgtgggtatacaggcttatatgtgtgttttacacacacacacacacacacacacacacacacacacggttctgattttggaaggcaatcaaaatcatgtttaaagaaagtaatgtgggagccaaatgcaatatacaataactgggggaattatgttgcaacttctttgttacattaagaagattaaaacattttgaataaattttaatgaatttattatcagagcagatgtttaaaacttttgtgctaagtaagagtataattcagcctctagcacctaattcatgttttcagataacactttctatgcatcttcctttttctttgttttgtactttttggaccccttaaaagaatatcaccaggactaagacttgtactaggaaatcacttgaggcatcttgtaaacagaaacaaatttgacatccttctctcctggagtgaaagcaactaaacagaagcaaagctgtctagacagaggtagagcaatttttccctctatcccttattaggtgttggttctctcagaggaacgaaactgaagtggcaaaaaggactctttcagttcagttgtggctatgttttaaatacgcgcacttgtaacctgagttatgttttaaaactgattagtaaaagtgactacatgtatgaagatggataataagcgaccgctttccatacagagtacttagttgtactgttttcttatccccgctccgacgcacttggggagcacacacacttcttttcatgacacttcagagtaagttagcaaatgaggctgacaaatgcatagttttttttcccctctgaaattatgcaactctgtgataatttaaagaaaatctggtctgtagatgaaccaactgactaaactctgtctagatatggagatattttttgccacgccttgttagcttcctcttccccaagttttacatttttggatcaaagtgtgcatttgtacttggtgctttttatctcccttcttatctttaaaatttttattcctactttgtgtcttgtttctgtctcatctgtggtatatagaagtctcacagtgaagcatctcttttctcaaatctcttccctttaaaccttctaatgatgtcacaagaaataaaaagataataaaaacagcttaattcttaagttactatgccaaaattaaattgtatctattctagagaaatcatggtggttactggtgagatttaacgtatttctttgtgttggaaaacatttgaaatacaaacttcaaattactaaatggttaaatacaaggaaaaaagaaaatagcaattattaaataaataaaaaaaatttataacagttttagcagaggtttatattaatgtccagctatacagtttggaggaatgaagaatcttttctacctacccaacagaatagtaagaaataatcacacattgcatgtaatcagaattcagctgtcagctataattttctttatcatttagagaggagaaaccaggaagcaatagatattgtttcattaagaactgcatatgtgaaataactcttttagcttctttagctttcttcctttgatctaccattaactccttatgagaaagtaattagacagattttttttttaaatttcactggctctttgtgtttaatataagatttctttacaaattataataaattttgaactttttaatgttaactggagttagcatcttcaaaattatttgtgtattctgaaaacagcaagaaaatgtgattactgaaaatatttctgtaacatacaaagtaatgagttgagatggtaatattaactgcaaagagaattttgaaaaagtgattattgtttttagatggaacaatcatttaagtagtccaaatttgttttctcttattttacttatttttacttacatttcatcgcttttcagtcttcacttaaacatttcaccatataaagttccacagatgaaattaatctcatcctttttaccttgccaacatacctcagtggtactcaatttctttatattttgtctccctatctggttttagctcaaagaaaatttgcatggaattccagatttatgaacttaaaaaactaatagttctgatcatctttttacacagagataaactgggttcaataaggcctacatctcattgaactagggttgcaatatttagcaaataaaaatacaagtgtgaatttcagataattttttaacatatgtatgtctcaatcgctttttagtaaaaatatatcccaaatattgcatgggatatattatgctaaaaagtgatttgctgttcatgtgagattcaaatttaattggtcttgtattcttatctggcaactccaccttgagttgttttgggcattaaatcggataatttagctgacatgactgacaaatggtggatacccaacaatttttcttcttgccctatcctgcgaactcttaaagaaacctgtcttattgacctttaaatcaccagtgcttgattaaaagcctgacatatagtaataactttagttatgcatgtaatatagaataaatgaacgtgtatgcgtgcacatgtacacatgttcagaagctagtgttgaggattagttagtaggaaaaggggtggtttctatattaggaaagtgttacattccacctcccttttatcaagatatttcatcatctttttactgctgaccactactgtctagaattaaagacctagaaataccttgatagatattctttttcatacttctttcctcagagaacattacaaaaaatcattgttagataataataatgtgtaatatcattgaaaaactctaaaactgaatgtttacagtttcccttatcactttcccactatcagaaccacaataacttaaattacttttgagccctgttttgagaatagctgtcatcagcaccagttaaaagttctatatatgtatatgtgtaaaaaaattatatataagtaagcataatacatttataatgtctataaataaaacatgcataatgccatgctgaagcaggagtgagcaaacaatggccactgggccaaatatggcccaccatctggttttgcatgccccacccatgagctaagaatagtttttatattttgggatgtttgggaaaaaaaatcaaaagaagaataacgttttgtgctttatgaaaagtatatgaaattcgaattaagtaacattggaaaacagccatgttcattcatttacatattgcccatggctgcttgacactatgaaataatcagcttcatgtgtccactgtgctacactatagtactcagttatttaatcaaacaccaacctaggtgttgccgtgaaggtgttttgtagatatggttaacatctgcaatgaatttactttaagtaaaggagattatcctcattaatgtgggtggaactcattcaataagtcaaaggccttaataagaaaagctgaggttttctggaaaaaaaaaattctgccttcagactatagcattaactacctgagtttctggcctgctgacttaccctatggattttagacttgccagcccccacagttgtgtgggtcaattctttatacactacaacagtagaatcgaataattgcagcagagaatgcatagcccacaaagctgaaaatatttactttctggtcctttacaaaaaagtttcctgacccctgtgctagatacatactaaattggagctaaatcattttccttcctttgtctatacaattttgtgttcaattaatatttattgattctatgtaattaatatttattgatgcctattgctagctacgtaacaatagcatcaacaagataaactttctattctggtgaatcaaataggatggagtggagacagatcatgaatgtggcgacactgtgaaggtaccgataagtaagcaggtgtgctgagtgagcacgctagagaaccatctagtacaaacaacccctccataggaaagctaaatgaaactgtaccctcagggtgaaacatgtatgtgaactgaacatgctactttgccttatgcactttaagtaagtacatttttggatataagcctgctgtacatgtgttttgagcttcagaaaggaagttcagatactgtctaacagaagtcaccaccactgtttccatggaaggtgggtaattatatcaattaagcagttaggatgtagcacagtatggtgtgagggagactgtgaagtgtcagagcatgcaatctccaggcattgacatttacattggaaacattgagaaaggcatggtgcatgccaaacaaagcatattttcaggtttcaagagatgccaatttaaaatttctgaggtaaaacctagctcttctcacttcataaatgggaattaaaacccaaagatcttatgggatttgactgaaatctttccatttgtgacagcgatgagactggaatccaggtcttttggctcccactgcaattttctctcttccttctgtggagggcgcctgaggatgtgttagggtaggatcataaggtaagaaaatggaagtcaaaattaggctggagaagaatcttaccttcatgaaagagtttatgtccaagtaatgcattaattatatgtttaaacatttttgtaactacctattatgtcgctggctagaactatgcctggtgtcttgacgtttcaagaaagcaggtgaaaaacagtatctcattgtggtttcattttgtatttccctaattaataataaacacattttcatacatttactggccattaatttctacttctgagaaatatctgtgttttgtgtagttttccatagttccttttgtaatattcttactgacttacaggaattaaaaatattctgcatagtaatcctttatctttggtatatatatcttcttccattcttggcttatctttccactttctttatggtgttaaagttcttaatgcatttttgtctcatttatcttttttaaattgttacacatttttggtgccttgttttaagaaatccttctctaccttcacaccatagggaaattttcttatatactcagctaaaatagccttattctttttcatttttaaaatttattattaatattattattatactttaagttttagggtacatgtgcacaatgtgcaggttagttacatatgtatacatgcgacatgctggtgcgctgcacccactaactcgtcatccagcattaggtatatcgtccagtgctatcccttccccccccaccccaaaacagtccccagagtgtgatgttccccttcctgtgtccatgtgttctcattgttcaattcccacctatgggtgagaatatgcggtgtttggctttttgttcttgtgatagtttactgagaatgatgatttccaatttcatccatgtccctacaaaggacacgaactcatcattttttatggctgcataatattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgttatctcattgtggttttgatttgcatttctctgatggccagtgatggtaagcattttttcatgtgttttttggttgcataaatgtcttcttttgagaagtgtctgttcatgtccttcgcccactttttgatggggttgtttgtttttttcttgtaaatttgtttgagatcattgtagattctggatattagccctttgtcagatgagtaggttgcgaaaattttctcccattttgtgggttgcttgttcactctgatggtagtttcttttgctgtgaagaagctctttagtttaattagatcccatttgtcaattttggcttttgttgccattgcttttggtgttttagacatgaagtccttgcctgcatcacgctacctgacttcaagctatactacaaggctacagtaaccaaaacagcatggtactggtatcaaaacagagatatagatcaatggaatagaacagagccctcagaaataacgccgcgtatctacaactatctgatctttgacaaacctgagaaaaacaagcaatggggaaaggattccctatttaataaatggtgctgggaaaactggctagccatatgtagaaagctgaaactggaacccttccttacaccttatacaaaaatcaattcaagatggattaaagacttaaacgttagacctaaaaccataaaaaccctagaagaaaacctaggcattactattctctttcattttttaagtcagacccacttggaattgatttttatatacggcataatggagaggtacaagtttgctttttcccatgtggataactaattgcccttgcataatttgttaaactgttcatccttgtcccattgatctttactgccaactcttcaataaatcatgtttctctctgtgtgtgagtttgtttgtactctaggcagtttgtttcactggcatcatttttcaatccatgtgtcaatgccacattgttttaattcttacagatttaaaataattaatttctggaaacaaaaatcctctcaccttgttttacttatttaagtgtgttttggttttttgtagaaatttctttcttccatataaattttagaatcagcttgtcacattttacaaaataaaattgaagtaattttgattggaattgaattgaagctatagataaattggggcagaattgaaatatttacaagacagtgttccaattcaataacttgactctatctctgcatatttaattatgtgtcttacatagaatgagttactattgttttttcttttttttttggaaacggagtctccctctgtcacccaggctggagtgcagtggcgtgatctcggctcactacaagctctgcctcctgggttcatgtcattctcctgcctcagcctccccagtagctgagactacgggagcctgccaccatgcccggctaatctttttttttcctggttgtttatttatttatttttattatactttaagttctagggtacatgtgcacaacctgcaggtttgttacatatgtatacatgtgccatgttggtgtactgcacccgttaactcatcatttacattaggtatatctcctaatgctatccctcctccctacccccacccaatgacaggccctggtgtgtgatgttccccaccctgtgtccaagtgttctcattgttcagttcccacctgtgaatgagaacatgtggtgtctggttttctgtccttgcgttagtttgctcagaatggtggtttccagcttcatccatgtccctacaaaggacatgaactcatccttttttatggctgcgtagtattccatggtgtatatgtgacacattttctgaatccagtctatcattgatggacatttgggttggttccaagtctttggtattgtgaatagtgctgcaataaacatacgtgtgcatgtgtctttatagcagcatgatttataatcctttgggtagatactcagtaatgggatggctgggtcaaatggtatggtatttttagtagagacggggtttcaccacgtaagccaggatagtctcgaccttctgacctcatgatctgccgcctcagcctcccaaagtgctgggattacagacatgagccaccacgccaggccattactatagtttttaacaaaacttagtacctggaagaacacacccccaccaacccaacacacataccttgttctttatattcaagaagtcttgtctattctgatattaattattaccttttaatttatctgagtttgtcctgctattttctaccttctcaagtggaatgcataggtaagtaactttaaaattttatctttactaatgtaaacattcaagggtgtaagttttcctgtagttactattaataatttatttgcatcaaataagtttttgtgtaaacatcttattattgagttctaaatatattttttgttgtagtttcttccttgatctttcatgacttacatattattgaaagtgaatttcttaattgcatcaatatattttattacaattaccttttggtttttgctttttaatataattgcattttagtcagaaaacatgatctgtatgatattaggtttgctttttagcccagataatgttaattttcagggatatttcttgtgattagcaacaacgtatattctatggtggttggggtcagtgttatatatatattcaaaatatattgcttattaattttactattctaatctatatcctgaggtaatttttctaattgttctgtgaaatactgagaaaggtaagctaaaatttcataatataattgtatttacttgataatagagaccttaagtctgtgcaagagtttggaagttgtacactggattactattctacttgtggtttaaaatttgcatgcctaactcgtgtaacaacacaatgaccttaaaacattgctgcttgcaacactttttttcctattattctattatttttatatattttaattctacattttacttctttttagtcccacaggtttttgttgtctgtatagtcaatatttgtttatatttacttacatatttattttctttaagcatcactgttttttgcatattagattatgcaactgcatccctttcttctagctagaaatttatcatttaagtttttctttagtaaagatctactggtgacaaactgtttttttgagattattttttaatttggttctcgatttaaaaaatgcaattcaatggctttccattgtttcttttgaaaattatttcttatgtatttgaggtatatactgtcacccaggctggtgtgcagaggcacgatctcaggtcactgccacctccacctcccaagttcaagtgattctcctgcctcagcctcccaagtagctgggactacaggcacgtgccaccatgccctgccaatttttgtagttttagtagagacggggtttcaccatattggccaggctggtttcaaactcctgaccttgtgatccgcccctcgacctcccaaagtgctggtgttaaaggcatgagccactatgcccagcttttttattactttttgttgaatttaaggttatttgtctttttcattctataatattactataatgtttctttatgtgtatgtttgtgtgtatgtataaataaatttttatccagaatacctatttattttcaaatttaattgatcatttaaaatagtctcttgcttcttactcattttctcagtgtattaaaatttaaacataataaggcacacctactttatgtgtttgataattgaggacttcatgtctaaaacaccaaaagcaatggcaacaaaagccaaaattgacaaatgggatctcattaaactaaagagcttctgcacagcaaaagaaactaccatcagagtgaacaggcaccctacaaaatgggagaaaattttcgcaacctactcatctgacaaagggctaatatccagaatctacaatgaactcaaacaaatttacaagaaaaaaacaaagaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagacaccatctcacaccagttagaatggcaatcattaaaaagtcaggaaacaacaggtgctagagaggatgtggagaaataggaacgcttttacactgttggtgggactgtaaactagttcaaccattgtggaagtcagtgtggcaattcctcagggatcttgaactagaaataccatttgacccagccatcccattactgggtatacacccaaaggattataaatcatgctgctataaagacacatgcacacgtatgtttattgtggcactattcacaatagcaaagacttggaaccaacccaaatgtccaacaatgatagactggattaagaaaatgtggcacatatacaccacggaatactatgcagccatgaaaaatgatgagttcatgtcctttatagggacatggatgaaattggaaatcatcattctcagtaaactatcacaagaacaaaaaaccaaacaccgcatgttctcactcatagatgggaattgaacaatgagaacacatggacacaggaaggggaacatcacactctggggactgtggtggggtggagggaggggggagggatagcattaggagatatacctaatgctaaatgatgagttaatgggtgcagcacaccagcatggcacatgtatacatatgtaactaacctgcacattgtgcacatgtaccctaaaacttaaagtataataataatttaaaaaaattgtaatatttgaagtcattaagaatattattgtatttttcgtggctcctgtttgtctttactagtggcacttttttttttgcaagttttaagtgtttgctgctgtagttgtcattattctttatttttccttgtaaaagtaatttccaaagataatatatcacctaggtctcagggcgtgaccaacttgcagagattcaataaaagttgttggcttcaaattatttttatactatctaggtagtgttaatttgggctgaaaacctataaagactagaagatagataataatttctatgaaatattttgtttttccatctaccctctgctgttgagagaggcgattttcttagctagtgtttgtgtgtgtgtgtgcattgaaatttccagtttacccttatacttttagccatgggatttcacttttatctgtagatgggtaaatctatttggttctccactggaaatatgtcctaaaatttatctcctgtccttaaacatatttcccaacagtttgagaagctcaagttcactagtgaagcaaattttatcagggtgaaaggcatttttgtgctctgtttatctctttgaattcttaagttcacttagcttttggcttctgtgtatgttgtttcctagttcatcaaaatgtctaacttatcattttgtcagaaatagtttcctcaaatttcaaaagttttatctctacatggcttgctgctatttttttattttttagtgcctagaggttttataatgttcatattaaaatatatatattgtaccccttatcattatatggtatctctttttaatctatttagtggtttttactttaaattttatcttgtttaggattgatttttttttttgccatatttaccaggtatttctttacacctttatttttaacttttatttcttacacatttcaaaaaacatcttacggctgggctttgactcttaatgggaaaattcagtttatatacattgactctaatgacttaaatggtaaattttacttattcaattatcctccattatttattttacactatttctttttaatttttatttatttatttatttatttatttttttgagacggagtctcgctctgttgcccaggctggagtgcagtggcgtgatctcggctcactgcaagctccgcttcccgggttcacgccattctcctgcctcagcctcccaagtagccgggactacaggcgcccgccaccacggccggcccggctaattttttttttttttttgtatttttagtagagacggggtttcatcgtgtttgccaggatggtctagatctcctgacctcgtgatcctcctgcctcggcctcccaaagggctggggttacaggtgtgagccactgcacccggcctataatttttttattattatactttaagttctgggatacatgtgcagaatgtgcaggtttgttacataggtatacatgtgccatggtggtttgctacacccatcaacctgtcatgtaggtcttaagtcccacattaattcggtatttgtcctaatgctagccctcccctggccccccactccccaacaggcccctgggtttgatgttcccctccctgtgtacatgggttctcattgttcaactcccacttatgagtgagaacatgtggtgtttggttttctgttcctgtgttagtttgctgagaatgatggttcccagcttcatccatttccctgcaaaggatgtgaactaaccttttttgttggcttcatagtattccatggtgtatatgtgccagattttctttatccagtctatcactgatgggtatttggattggttccaagtctttgctattgtaaatagtgctgcactaaacatacatgtgcatgtgtctttatagtagaatgatttataatcctttgagcgtatacccagaaatgagattgctgggtcaaagggtatttctggttctagatccttgaggaattggcacactgtcttccacaatggttgaactaatttacactcccaccaacagtgtaaaagcgttcctatttctctacatcctctccagcatctgttgtttcctgactttttaatgatcaccattctaactggcatgagatggttacttcattatgcttttgatttgcatttctctaatgagcagtgactactttaaatttcatatggaaccaaaaaagagcccatatagccaagacaaccctaagcaaaaagaaaagccagaggcatcacgctatctgacttcaaactatactacaaggctacaataacaaaaatagcatggtactggtaccaaaacagatatatagaccaatgtaacagaacagtggcctcagaaataatgccacacatctacaacaatttgattttgacaaacctgataagaacaagcaatggggagaggattccctatttaataaatggtgttgggaaaactggctagccatatgcagaaaactgaaactggacaccttccctacaccttatacaaaaattaaaatggattaaagacttaaatgtaagacctaaaccataaaaaccctagaaggaaacctaggcaatacaattcaggacataggcatgggcaaagacttcatgactaaaacaccaaaagcaatggcgacaaaagccaaaattgacaaatgggatctaattaaactagagagcttctgcacagcaaaagaaaccaccatcagagtgaacaggcaacctacagaatgggagaaaatttttgcaatctatccatctgacaaagggctaatatccagaatctacaaagaacttaaacaaatttacaagaaaaaaaaatcaaaaaatgagcaaaggatatatgaatagacacttctcaaaagaagacatttatgtggccaacaaacatatgaaaaaaatgctcttaggtatttactgataggactttaaaactgtgtccacacaaaattgcacctgaatgtttattgcaggtttttcataattgcccaaaactcaaagcaaccgaagtgtcccttagtaggtgaatgggtaaacaaactgtgatgtactaagacaaggaaaaactatttagggaaaaaataaatgatctacccagccacaaaaagacatggaagaaatgtaaatatatattgttaattgagagaagccagtctgaaaaggctataaactatataatcccaactatatgagagactggaaaaggaaaaactatagaggcagtaaaagagaccagtggttttcaggggcttacagggaaatgggaagatttgaataggtaaagcacaggtgatataacagtggtaaaattattctgcattatattctaatggtggacacgtgacatgatacatttgccaaaagctacagaactttacaacatagagtgaactctaatataaagtatctactttagttaacaatagtatattcatatttattcatcagttataataaatgtgtcacactaatgcaagttgttaataagaaattgtgtatggaagttagggtatatataactctgtagtatgtgctcaataacagttaaaaaatttttataaagtaaaaaattcaagtattgcatactagcctatggtaagtaaagaaaacaccaaaagaaagggtgccagtgtgtcattctgtcctatctcttcctcagatctgttggaaatgagtgtcagactcagagttcattatggctcagaattcctggaggtattttgatgtggaacaggagagaagcagaaaaataagtggatcctgataaaggcaatggctgtgaaggttaagcttcagggctctcaatttgcaagaaacttttttatggctgcgagcttacattagtattgataatttgtattattttttaagaggtccactccctcaaaattatataaacattagtccacacaaaacctggaaagaccatataaaagaaagtctccaaaggctttgggatagtgagtacttagtctatacttcattcatataggtctttttactttgtccactaattgtatttttataataaatgtcttattggactgaaactgtccaaactgatccatcttcttagaaattcaccaaactctggaattttctggggtctgaaacataaaagccaatgtgattcagcttttaatcatattatatgcttcttaaataataatttaaagtattttagtataggttttgccagatgaaggagagttgacatattaatagataacttcacagaattatccattcaagtaaggataggaagttatctgaaatgaaggataggctgttgttttacatcattttttttgtttccttgcttccttttaatcccagtataattagaaacacttcctattgtattatagagacagaaggtctataaatactagttagatatttttatgagcttttctacttcaaatgaatcatatgtggggcaaaatagtgagctattattcaatatgttggggctaatggagctttaaataaaatggagccttagaaatgaaatgtttctaaactcaaatgaatgttttatctttaccaaggaaaatatttccccacacaggattagaattatcagtttgcacttttgctgtctgagagtgccatataacaatgtcttaaccattaaaattaatgacctggaatataagaggcctaaatagccctattacgttgaaaaaaattctatcaattctcaaaaagagtgaaatagatgttacacctatctaaaagatatgcttcatggaacaaaaaattgtgaaactacagagaatccaaaaggtttttaaagtatttttaattgaaaaacttctgcatctcagaagatggcttcacagcaactttaaagtaacagaatgtatttaatttaaggatatacttttgctggtgaatattaatcatgttcacctagataaatggttatcaactaggagtgattttgttccccagggagcatttgacaatgtctggaaatatttttggtcaccacaactaggaagtggtatgactgtcatctaagtgagtgcaggttagtgaacatgctacaatgcacaggacagaccctacaaaacatgtcaacagtgccaagcttgaaaagctctgagtgagacaaactgctgcaaataaatatcaagtttgtactatcaagttttggggtaccccaagaagtagcaatggttatggattccctactcatttcttctgctataaccttaggagtcttcgcagactgctgtcaatgtgagggctgggtctgctccatgtgctttcctttgttggtttctttcataccatgaactgctcagatcaatccctggagagggagaccaaactcaagttggccttcaaaattccattcccagttattttctgagaagcatctctaaaatcatgctgtaggaagatgaagaaagatatgttctctctccttagactctacccatcaccactcaaccaaagactttcatgttgtatgaaatttcttgtttattttttagaaaaaaacgaagcaagaaacaattattttttacttaataataaataaaacttatttcagaaaataagttatgtgctagctggcaatattcttcattcaagtgtgaaattggattaggtctacatgaagaagcatagataatcgaaaacagtatcgacagagtttgtaatgggttgaatttgtggcccatcaaaatgtatatatctacctggaaccagaaaatgtaatcttgtttggcaaaaggaccttgcagatgtaattaacatagaaccttgagacgagatcatcctccatgagagtaggccctaagtccaataagtatcctttgaagaggaaagagaaggggaaaggatatatgaggaagggtgatgtgaagatgaaggcagagattagagttatttagcccaaagtcaaggaatgctttggagacaccaatagctggaaaaggcaaggaaggattctcctctacattcctttggagaaagtgtggccatgccaacacttcaagttcagacttctagtctccacattgtgagaaaacaaatttgttgcttttaagtaactcagttatggtaatttgttacagtagccctcagatactaatacagagtcaaagacctgagagatataaggtggcacgacaagagtttcctctatgtccaggaagccctgaagggagaggagtaatatgtctgataattccaggtcatttgagagattgactataaaggcagaaatgagtgtcaaaatgtgccagatgtctgctgtgaagggtagcaatccatgactggaagccagttcgtgaacagagtagccaatggactcagtgtctgaaagggcctgatttcaacattaaatgaagctaaagagttcccaagtggtgggcaagccttggcagtagtgatgccctctgtttggtggtgggcattactgtaaatctgagaatcagtgccttggatgcaggaacctagtcacgagccagagtgaggacatatagaagagtgtaagggcatctgagtgagccagactgcaggtcaagggaagcttttgttcttggagaattatttgggtcccctaaagtacagcatccactagactaattggaaggcaatgtagctcatgcatgcatggcttctatgggattatgccaaaacttctgcctctgaccacgtttttctgtatgttttaagattgaatgtgttacaatgacagctaataggagatggaaaaagaaaaggagggacattaaaaataaaaagattgtatgttaaaaatacagagtaagaggataaaacaattacagaactataccaataacaatagtaaatatatttgacttgtttcaggtctagagcaatacctgactcatagtaggcactccataaattattactgagttgatgagtaaatttatgtacgaatgaacaagtactttgagggagaacagaaaaaataaaaattgtattcagttatttaatcaacaaattctatattgaagccatagtgccaataattacaactatcatttctttcttaaaatacattagtatccaatataaattttatgccttccaaggttcttatctttctaccttaagaattaaatcacatttgactatatatgaaaataaactatttgaggctaaaatacctggcattaaatatttaggtacattaaataaactacagcatgtaattaaaaggggttaatatggagaataatttatttctgtcttctggaaacatatgtattgatgtgtcagttattctttctaagactttcatgttgacattgcaggtcattgcttcaaagcaatgttcttcaaatatctgattttattttaaaagcaaaagcactcacaatcacttcgaaagaagatctggcagtttctcataaagttaaacgtaaacctaccctatgcaatttcactgttgggaattcacccaagaaaaatgaaaatacatgttccccaaaagacttttccagaaatgtcatagcatctttttttaattgtagcaaaatacaggatactggaagtagtcaaggtgtccatcattaggaatgggaaatatacaatgaaatattactcagaaatacaaagtaatgaactactggtacactaaaaaaatggatgaatctcaaaaacacgctgcaagacttgcatagtagtacatacacactatatagtagtttcatttatatgaagttcaagaacaagttaaactaacatagaaaataatagcaaacagtggatgcttctggaatttctggggaagggattcattatgaacaagcacaagaaaagtttctggaatcatgttttaatatctaatagggatttgtattaagttcatgcatttgttgaaattcatctaatggtacatcaaagaattgaatatttcattcttgtgaattttacctcaaagaaacaatttgcaagcaaatattgagctccataatatgcacactacagtgtttaggagtgtagtggactgaaacttgcagctttgaaatgtatcaaaaaatgcactgatggattgatagagggatgggtagatatgtaatgaaatatttctggtaaattgttaacaatagaatttaagtggtggtaatacagttataaggattctttcagctcttctgtagtttgaaattgtcataaagtgtagagaaaaaattgaaagcccttttcatagctcatgcttccaatttctaattaagattcacagagggattgcttaaaatcatttaaaaatattgtatttccatagaaaccaaaaaaatttgcataattctatttctttacaaacttttattcaatttagtttgtctacttattaagatcagtcgtatttgtactattcctttgtgttttccagtttttaaattataattgggtgatgcactttgatctttataatcatggttaattttatacatgcacacaacattacaatttcttggtatagttgattcattagcctgacgataatgacctgatggatttcaatttgagcactttcttgaggccactgaaggcagtttatgtagaagcagaatgaaatggtaaatttgcagctagttgaagttttatgctttaaaatttcactaaccagaacacataatctagatttgcaaattaattcttcttttttataatgaaagtaattatgtgcagacatacagttttgttcaggatattttctgaagtaatttagcgttgacccaatctctaaataaaccaggtgccaggatatcctgctatttcttaggatgatttacaggcaccccttgatggtgaaacgctgaagatcaccatgtcaaaatgccatgttgtcatcaacactttgtggtatttgtgaaaggctttcaaagggaataggcattcatacacacacacacacacacacacacacacacatatatatatatagagagagagagagagagaaagaaattcactgttagtcaatacagacctgcaagtggccttaccagttgcttactcaaagtatactctattttttagagaaagtatctcattagtaggcattttacttgttatttgttcagaaattttagtgaatgcatcaggtttttaatttgaaggagtaattggtatatgcatcttcccctgcccaaaataatctacctggtaagactcacttttaaaaaggaacacacatgaaaaataatttgattaagaatttatcttcttgaaagaaactaaaaattataaaaataagtttattctattttatatttaatgtgtagattttataaattagaacactatactagttattggtataattcttcttaaaattagtctaatagcacaatatagcagtatttataccacatttgactcttcacgttttgttccagagacatttttgtgaaaaaatattagaggacttcactggttttcccaagggcctctcttattattttgttattcaaataactttttgaaacatcttttctgtcatacaacttatttttgattctctaatttcaactcattgttatgtggtttaaagttgctagatcagtggcttttaaagtaatgattggctttatgaaattctgtgacttttgtcatatttgcaacctgagaattgattttcttgtcatgaattttatgatatgtgaaaatcataaagattacaacatcgaaagatgggacctggattgatcatgatagccatatgctaagcaaggaagaatgagagggctgttgtgttactgatgcatgtttcacaccgtgacaggcttaaccgtcttacactatattgattgtggcaactcagattatagagcatttgaacaatgaagacttagaagaaagattttttgatatgtatttgctatagtttgaatgtttcctccaaaaaacatgttaattttttttaagttcaggggtatatgtataggtttgttacatacatatatttgcgtcatgggagtttgttgtacagattatttcatcacccaggtattaagcctaatacccattagttatttttcctgatcctctccttcctcccaccttccaccccgtaataggccccagtgcgtgttgttctcctctatgtgtccatgtgtcctcatcatttagctcccaattataagtgatgacatgcagtatttgattttctgtgtgtgtgttagtgatcatgttgaaatttaattgccaatgtatggtactggacgatggggcctttaagagggtgttagccctcatgagtagattaatgctattatcctgggagtgggttaattattatgggagtgagcttctgataattaacccactcccaagttcggtccccattttgtctctatcttgtgtgctgctcttccaccatgggataacgtaacacaaaggccctcaacagacatggtccctcaatcttggccttccaaggctccagaacgaggagcccaataaatctcttttctttataaattacccagtctgcagtattctgttatagcagcagaaaacagactaagagagtagtactattaaatataaagaacttcactgatgatagcttgttataatagggaaagtttacatactagctaatgcattacctcagtcttaattatctgaaggatactgcatgaagtttgggggagtgaaaaagatgtgagaaggtaagggaagaaaatgggctctttttacaaaatagggagaattcatcaaggttttcttcatatgtgaggtttatgccaactttatttttttgagggagtctgtgtcacccaggccggagtgcagtggtgcgacctcggatcactgcaacctccgcctcccaagttcaagcaattttcctacctcagcctcccaagtacctgggattacaggcatgtgccaccacacccggctaatttttgtattttttagtagagacagggtttcaccatattggccaggctggtctcgaactcctgacctcatgtgatctgcttgccttgacctcccaaattgctgggatcacaggcttgagccaccgtgcccagtcaggtttatgccaactttcagatattgtttatatagctgatgcaagcatgtacagatctcaaaatttttctgtcattcttctgatctaaatatatgtgaatagtggagtgctatggggtaaagacccattattaaaataatttattctcacctagcttatcttgtgatgtgaaggatggcgatttcactgcagcattatcgttcatgtgttccacaaaatcatctctgtgagaattctgtgtcattcctgtgtgtggggattatataaccggtatttatagtaggaagcttttctgtctgatttcctccaatattggttgtaatattatgcagccttttaaagccatttatgtatttttggattatcctaaagccatttgtagaatattaaatatgtattttattacattgttacacagctaaaagagcacattatactttagaggcagtaaatattagtacatgaaatcaaactgtctttagtatctcttctcttattaaaatatcagacttttctggctattctctgggagggttagccacagaaaagaaacaaaataacggtatattacagtaaatttacatggctattcaaataaaggtttagaacctagattacctgaggtaaattttaaggccaaaattacaaaaatgtataaaatgtaaatattttagaaatccaaaatgaatgattatggtgtgtgatagtattttgggttacaagtatatttatgcttagtttctcttaatgagctattttaataaagttttgaatgtaagtatattattaatttaagatattatatttgtgaccataattatgaggaaaaaagcaaggacagtagaagtaactgcaaatattaaatcaaaactggagaaagattctgtttctatgtgcatattccactgtaattgctcatgttaaaccttcaataaatgtttttgaataaataaaagcatgactaaattgattaatagatactaatgttctcttgcaatgaaatgactaggcctcttcagagtttaatttttttctactatgttatttcttcttcattttactatatatattttgcattgacatttcagcattaagggaatatttttactatctaaaaataatgagctagtaagccaagcaaataccaaggaaatgaaattgtgcttaacaactgccatatcaattttcactttaaaagccactccataaggtgatatttcttaaatttttaaaattataaatccaagtgatagatacagtagcttgagtaaatctatcactctataatacatatttttcctagtaataattatgctatatgaatagcacaaggttaatatttcaaagagagcataattcatatgatatcatactggtcatttcttgagactttctctcttttcagtcttattaattcctcctctcatggatcctgaaaactgattaagctgaaatattttgtcatagttgcatctaaacatggactcagtttctcatatcataactgaatatacaattctgagttctttagatactgtatattcatatatctgcataatggccatgcaatcttaaataccatttatgctttccctccatttgattatcttccagcaggctttctgttctattcttgattatattctttctgcagtaacttttcaggatctcacttctacaaggctgttttttaaatcaaatatttgtccttattagtcccctccctctgcttttagaacagctcttgttcttaaatttgaaaatctttactagtttctctttctgcctttagctgctgcccttgttctttcttttctgcttaaccactctctcagcttattttcaaatcacctcctgacagtctggttgtggctctgttttttaatggaaagtccagtatcatttctatacttttatttttctggatctttgtattttacacaatgacgtgtcatgagccctgaacctctctctctttgacttcctttatggtatttctactctagtttattgcctgcctgtttaataactccttaatcttctgtctctttatttgtccttttccgcatgtaacgctaaattttggtgttccctatgtgtaggttacaacttactttctacatatcataaactttaagaatttgattaatgctgctctgatttattttctttcttcctttctgaataagctaatttatttttaaaagacagcttcatatcactatggaaaatcgatcattagcattttccaaaaatggatggtagctatattagtttgctaggggctgccatagcgagttatgttacatagactgagtagcttaaaaaatatttattttctcacagttttggaggctagaagtccaagatcaaggtgttggcagccctggttctttctgaaggctctctccttggcttccagacagctgccttctctctgtgtcctctcatggttttctctgtgagcctgtatccgtggtgtctccttttgtgtccaaattctcctttttataaggactatagtcagattgaattaaggcccatactaatagcatcattttgacttcatcacctctttaatgccctatctccaaatatagtcacattctgaagtactgggattgagtatttctacacatagattgtgagaggaaacgactcaaaccacaacagaaactttaaaaataatggcaatgattaaattcaagattgatatttcatattctcaatggcgtcaatttgactagattaagaaatacctagagagctggtaaagtgttatttctgggtgtgtctgtgagggtgttacagaggagattggtgtgtgaatcagtagactgggtggggaaaatgtaccgtcagtgtggctaggcaacatccaactggctgagggcctgcgtataacaaaaaagcagaagaagggtgaattctctctccctactggagctgatacacccttctttgcctgcccttggacatcagaacttcaaggctctctagcctttggactctgagccttgcaccaatggccttccaggttttcaggccttcaaccaatgactgagagttacaccatcaacttccctggttctgaggcttttggacttggatttgaactgagtgtcttggggtcgtgaatggcctgttatgaaacttctcagcctccataagtgcatgaacccatgcctctaattaatctcctctaatctatctatccgtctatcttccattggtcatgtctttctggagaaccctgcctaatgacattactccaagattctaaatctgagatctgcatttatttttaattggcaaatgtagacaatttagagatacaacaacaaatggagactttaggtaatctgaaggatcaaaagacagttgatagaaaaataactttttattgggtattaaaatgtcaataatattggttcaagcagtgcttaaaatcatttctcataccatcaatgggtaaaattaaatttgctctcagattttgacgtgtcagtcactcaatctcatggagtctgttttcacccttatgtgaatgatatctaccctctcttttccttggctgaaattttgctaaattaatctaattcatatatatatatattttttttcatatattaatctaatttaattcatttatatgcatatatatgaattaaatttagcaaaatttaattttgctaaaatttagcaaaatttaattcatacataattatatatgaattaatagattaatatttaaattatatatgtttatatatataaaatgtatccatagatgtttacagccttttgtaatttataatatttataatataaaacagacatgatactgtttaaccttctcaaaaagaatatagtttggccaggtacggtggctcacacctgtaatcccagcactttcagaggcggaggcaggcaggtcacttgcgatcaggagtttgagaccagcttggccaacatggtaaaaacccatctctactaaaaatataaaaattagccgggcgtggtggcatgtgcctgtaatcccagctactcaggaggctgaggcaggagaaccgcttgaacccaggaggcagaggttgcagtgagccaaggtcgcaccactgcactctagcctgggtaacagattgggactctgtctcaaataataataataattaataatttaaaaaatatagcttaagagaagtaaaatattgagttaaattgtcactgtgtaatttctaataatctcatctagagagaaaatctggaagtatataattacaaaagtaggactactcaaataatttaccgattaggtcagatttttaaaaagtcatgaataaaagatagatgacaagctatataattaacataaatacaaataaattaatacaaagaaaacaataagtcccaaaaggcaaaacaccaagataaatgacaaaatgctaattttataatgggaagaatttaaatctgattatatataaaatacatatattaaaaatacacttgtattttggtacatatatatacactcatacatatatgatttggcttccacaccaaatctagctcacaacctgctcgtgtacaatttgtgagatggagtactttttttttttttaacacctttattatttaaaagtcaaaaacagatgctggcgaggttgtagagaaaaaggaacacttatacactgttggtgggagtgtaaattagttcaagcattgtggaagacagtgtgactatttttcaaagacctaaagacagaaataccattcaacccagcaatccattactgggtatatacccaaaagaatataaatgattctattataaagactcatgcatgcgtatgttcattgcaacactattcacaatagcaaagacatagaatcaacctaaatgcccatgagtgatggactggataaagaaaatttggtacctagacatcatgaaatactatgtagccataaaaaagaatgagatcatgtcctttgcaggaacatgggtggagctggaggtcattatctctagcaaactaacacaggaacagaaaaccaaatattccatgttttcccttataagtggggatacatagaggggaaaaacacacactggggcctattggagggtgcagagtgggaagagggagaggatcaggaaaactaactaatgggtattagccttaatacctgtacaacaaaccctcatgacgcaagtttacctatgtaacaaacctgcacatgtacccctgaacttaaaagttaaaaaaaatttcaacataagttttgaaggggacattaaaaccatagcaaatacatataaaaaaacctttctaaatcttcattgttcaagtgctctataatctgagtcatgagctcaactgaaaaagtctctgctttagtgatagatgaaaatgtatttactagcaaagcctctgagaagcccctgaaaatgcatagtatttcaaaacacaatgaatagtttgagttggaaccgatcagaatagaaaatgcatcagcatgatatgtataagactgtataagtgttatatttgtcaattaatgtaaaaattattacatttattaaatgtgatgaaaacctctatatatacaaaatgaataaacttgcatgagggtcacaattccgttaaagtttctggctttgaattaaatgtagataacagtctaatccagagacttatgaagcattaatgtgacatgttaatgccttaaaatatattaacagtgaaacattagagggcattttagaagacagcatttcaaatgatctaaatgtaaattaacctgatatatgtggattacaccttttttataatgcgaatgggtttaaaatgaaggaaacattgctttacaatagtgaacaattctatacacataacggtttgggctttcaaacatatgttcaaacatctgaacaatggtatggttgatttcacaaactctaattgtgtccagagtcatacattcatcattttgagcaattctcaatgttggctattttcaagtgattacacagaaatctttttggatagtcatacataatgcctttttatcacctctacaaaaagtgaattataaatcaacttaacgtgaaaatgtgtacagatcttaagttttaacctagaaagggaactgaaatgcaatataaactccttgtgtaagaagaaaaattcaccttggcttttgccttctttttccttttgttttattcttctcgttgtacaaaatgttaactgtgtacaggttctttccagaactcagctttggcactgcacatgctaatttgaatatgagaactaatcttaagtggctcttttgcattttctgccaatatatgacagatgtgctgcactttggaatccacaacagatatgacttttagattcttccttaaaccaggtgctaaaaatgtgtgaaaaagcaaaagacattgttactgaaaagtttaagccatagaacatttcattaatggttttgtggattaattaaagtgcatcttgttatagtcattttccatctttcttttatagcagtaggaagaaatatatgcaattattcatgacaatgcacattccacaggatatacttccacatatcccagagtatgtacacactaaatacatattaatgtctacacagattaaagatgtatttaagtaaataaaataccataggaagtcataatcatagaaatataaaaaggtgtgactaaatattatatataataaaggccctctaaacctaattgtcaatgagtatatgtggctagaacatatttatggaattcacatttatgttatggaatttattatttgattaatggaagggaattacaacaaggttaactagtaagtccttgtaatgtgccatttgatatgcatataatatgtgtgtaatgttccatttgatatgtatgtaatatatatgtaaaattatgcaaatctgattgagataataagtaaaatttgtcaaaggagtcctagaaaatttacaaaataggttttaaatttccactctagttaaaatgattgcaagtcatttcattgtctttattctgatttctattatctaaagatctagaggataatgttcagtggtttatgatactaaaattgagatcaaaatttggttgagttgcttgaatttcttgagagtaataagtatttatgaatatatgaaatatgaaaatgaaggattgttttcaatttattcaggacaagaaattctagcaaagtttcagtgatataccaaaaatattttatctagctgttgagttgtcatgttttaaatgctatgataaccatgaggaagcttcctggggaatttttaaagttttttttcaagtgtatttgtaaatatcgtagtccaaatattttatacttgatttacaaaagaagcgaagggtaaatgtaagtgttataaagggctcttcagtgaattaaagttaggagagttgcctgaatattcagggcacagattgaaatgaatataaaattttaaaatatgttcaaattcagaactagtttgagtggaggaaaagtcagagatagtgcctctaatttgctataaatggaagtaatttctatattttttcattttttccctaaataccaaggtatttgccaaatatacccaaatagctaaatgattacttacctatttacaaaaaaatccagttattttaaaatgtaataaaaatgtttaattttttttctatatcccagatgctatgctacatgccagggaaagaaaaaatataaaagcaatgtggtcactttctttaatattttgccatctaggagagagactaagttaatatactgtgaaaagtgaagatgttaaatacaatagagaaaggcataggatactatagaagtgtagatgataaaaaatgacttccaagcaaaactgataattgatttgagcctctaaagaagaaaaataggtaaccaggttaagaaatactgttccacatgaaaagaacattggcgggcatgggacatgacacaagaagacatgaaatgttggagaattaaaatgcacttagtataattagattctaggtttggatggcaggaggttgaaggaaaacaaagctggacaagttagcaggcattggattgtgaaggacacatgtcagataaataaatgtattttgaaaaagaattaagcacagatccattggaaaagaagtcagtaatggatctagatcagtgaaacagctaggagtccaagagaagaccccaggtaatcatgtgcaagaacaaatcatattttcaaactctaagagacaaacaaagtctctaaattagaaataaaaaattaagaagtgataatatggactttaaggtattctctacaattccaaacagcatcttttatccccaaatcctttgtttctcagaagttgttttgattgtgagtgatgtcagagaatgtgcctaagagaagcccatggtagaattcccattctgataaacacaaggatactctactgttgaattcaagtggtcatagggggatatattggtgtggtggatgctgtgaagctctgccttcacaatcctgctacctcccattccccacatattgctgatcttgagagtgcttcctttatacaattcctgcataacaatccccgtcttggattctgcttctcagagaacacattctgcaaacaatgggtagcaaagtaagagaagaggctgactgacaagcttttctgccaaggtaaagggacatccttgctggtgaagcatgctttcagaggctgctccttagtccgaagaagtccagagcaatggctgaacagaacccaagagatttcatgttagacctgagcatcaataaattttgagctaaaaggggctctcaaagacagagaaactgaaggtcaaaaaagtcaagattcccccaaagttacataactaattgagaattgggctgagactaaattccctatcttcccactcccagtctttttcaataaacctgtgcttttcaaatagatgtgcctgcaggataacagatttgcttgtagtcatagaagaaacataaaatgaatggagaatgattttacttactgtttatatcaaaatatatgtgttgtagaatgtaaacaccatgtgacttttatgattaaaaagtaagagactaaagatcttcagaattcagctatgtcttcggaactgttttgggtatagttgaatctcctctgacactaggtataagtcagtgtaaatatttgaaatgaactgcagaaagagccgagaatggtggctcacacctgtaatcccagaactttgggaggccaagacaggcggatcacctgaggtcaggagtttgagaccagccgggtcaacatggcaaaaccccatctctactaaaaatacaaaaattagcagggcatggtggtgggttcctgtaatcccagctacttgggaagctgagacaggagaatcccttgaacccaggagacagagtttgcagtgagctgagatcaggcccctgcactgcagcccgagtgacagagcaagactccgtccccctgccacccccaagaaaaggaactgcagaaagaaataccattaatcctcaagagtggattcatttacatcttgataataatgtgttctatctttatgttaatataataacatctataagaggccttttcctattttctctaaattcttattaaattttccaaactgcaaacaatgggtgataactacctccccttctaaagatgggtattaaacatatctaggtggtacatgttcattggcctagctaccatctccccaaatcttatgaaagttagagtttatcaaagaagatgattcttcagaggaatttaagagtagaaagcactgaggcatatcctacccccaccacaaaccaagtgaggaaatccccaaaagcatcattcagaaatagttgatagtgggacacatgctagcagagctgaagcagtttgtaggaatctctgttgttgtaggaatctctctgttgctgtctgtgtagagagacttcttgggaggactagacacatgatctatgagaactgcagaaatctcagcacataatgactctatctaagcctctgcattaagagaggaccacagtctagcatgatctctagcagcatgaggccctgtccctaggatgaccccagttcccctgcccctccattgaaatgcctacctgagaaagctcaatactgccaggtgaatttatttgcttcagccatgcctgaagacaggcctctgacctccctttcttggaggatttactaaaaagccttacaatcatgactccttcttgtgtccctttgagatttattgtatctcttacaactcagaagtttctttcttaaagacagacagagacattcctttgaaatgtaatcatcaagaaggacagaacctctgttctatcctatctctgtgggaggatagaatcttgacttgggagaattgccagctagcagacacagttggcctaatcacatttacactgaccaacccttagtaatttttcatttctctggctctacttgagtccctacttgtccccctcacttaaaaagactcgatcacacaaatcagaatggagctcagctcttcgcctactgtcagtagttactgaataaaatctgttttcactgctttaagtaatgtctagccttgtttgcctttgacattctacaattaggaagcaggaaatggaaactggggcctgcttcttgctgggagaatcttgaaagcagttggacagctggagtagccggcaaagttattgaagaaagtgagaattcacccatgggtttatttacacttctcttagttggcagaaccgtgatgcctgagattttctgggatccaattgatgatgaggaaggtaacacggctcaagtcatctagaaataaccttgtctaataacatgtcaaccttgtcatgtgcaccagccaaaaacagcaggcatgtacttccctgagagctgctaaagagagtttgcaggatattagctgagagggcaaaacctacaacagggaaaggtgttgtggggaatcaccaacaaaccactgatgcagccgcaatgacagaatgcatttgctgcccatgcggaattataatgagcacctgctaaggaatatgacttttgatgcttttcctgatttctactatcctgatctgaccttgaagactctagctttgaggaggaagtggatcaaagggaagggcagaagggtgtggacagtttcaaattgaatataagagggaagttttaaattggattagatttttcaatacctacaagtgacctgagagctatgggatattcccaggttgtcacaaactaagagggtagagaaatctgatagaacatttcaatagtcagtgttagaagaaatgaaattattcttgagtacaatctaccaagtcaggtcatttaataactgaatgcattactatctcaatatagatgacattatttttgtttttgtttgttaagaaagaatttttatagcagcatgatttataatcctttgggtatatacccagtaaagggatagctgggtcaaatggtatttctagttctagatccctgaggaatcgccacactgacttccacaatggttgaactagtttacagtcccaccaacagtgtaaaagtgttcctatttctccatatcctctccagcacctgttgtttcctgacttttgaatgatcgccattgcgcatgtatgtttactgtgccactattcacaatagcaaagacttggaaccaacccaaatgtccaacaatgatagactggattaagaaaatgtagcacatatacaccatggaacactatgcagccataaaaaatgatgagttcaagtcctttatagggacatggatgaagctggaaaccatcattctcagcaaactactgcaagcacaaaaaaacaaatagcgcatgttctcactcatgggtgggaattgaacaatgagaacacatggacacaggaaggggaacatcacacaccagggcctattgtggggtgagggggagggagagggatagcattaggagatatacctaatgttaaatgacaaattggtgggtacagcacaccaacatggcacatgtatacatatgtaacaaacctgcacattgtgcacatgtaccctaaaacttaaagtaaaaaattttaatagaaatgtatagcagtttgagataacaatttttggcattaaatacaccttggttggagttcttgctttggtaatcacaaattactgagttctggtttgttgaccccacaaattattttctctgtgctcagttttttcaccaggagaatgggaatatgaatagttatagtttacatattttgtggtatattcccagcccactgtaattcttccttcttgggcagctgctttctaatctgcaggtagatcaatgagctgactttcagcagactggctggcatggcatactttgggctagagccattggatgaggggtagttcccttagctaaactggacagccagtatctcttccccaggttcaatctaagaatggttcagcccttccttgggagaaggactctacaatgttcattcaaaatccgttgtcaatcaggacatggtaggaaaaatgaaacatgactcgaacagagaaaatactgagagtgcctttgttcctagttgtagttcccttctgcaaacatctttgcatgctcattctagggttctatgagattccatctttatattcatataataagtttgaatctaacgttgtttattttaacttggattagataggtagaatagttcaaaaagcttggattccaatctcaattccagaatttactggctgagtaaccatggacaaaacacttaaactctctcctccattttttctcttgaattacggggataggataatatttacttcaaaatcacactatcacactgattcatgaggattaaatgagtcactgcaagttacttattattgagttggtttctataacttggagacagaaaaaaccttcaactaataaattatcacttgattcacagaattggtgtgtggaatgaaagagaaaatgcatgaaaagagtttaggacagtgtgtatgtaccaattgtacaatggtaaatattagctgttattatctattgctttcctatttcttagttactacatttgtactatggtttgaatgtgcacccccaaaacatgtgttggaaacttactcctcagtgcaacaatgttggcatgttcggtgtaatgagaggtgattaggtcacgaggacaaagtgaatggatttatgccagtatcacaggagggaattcattataaaaggggtagttgggctccctttttctttttctctttcattgtttttctgcccttttgtctattatcatgggatgatacagcaagaaggccctcaccagatgtgacctcctcaatcttggactttctagtctccaggactatgaaccattaaatttctgtttattataaattacctagtctgtggtattctgttatagcaacagaaaatgggctaagacaatctgatattacagtagtttttccttattttctgttttgctttcctcagtttcagttactccatgggcaaatgccatccaaaaatattaaatagaaaattccagaaataattcacacattttaaattgcacacctttctgagtaccgtgatgaaatctcacaccatccccatccatcccacctgggatgtgaaaaattcctttgtccattttatataagaaacttgattgtttatggtatctgagaggagtcctggagccaatctcccgtaaatacaaaggatgactggatatagggcttggtattatttgaggtttcaggcatccactgcgggacggtcttagaattctatcccctgtggagtagtggggactactgtaatcttcagaaacattgagattacacaaagtttccatttcctacttttaaaccacaggcagtcaagagaactgcaggcaaaaggtggcatatttgtgtgaagattaatttccatattgcctcatatctcttcatatttattcaggtccatatctatgatcctaggacagagaatagagacattcacagagaaaacttaccaaaatagattaaagcaattgaaattgatttaatattcccaggacagttaaataataaattcttctactcagatagttttcaatttcattaataagattgtatttacaagtaagggcatgatgttgtcttttacatataaattcttaaattaagtttttcctatcaaaggcacatcgcatgttgacaacaatgtctgaaaatgaatttcccagagaccacacgttttgttcttaattatctctgctcattatagtttttccttgttgttttgccattgtgtaataacattttaggtcaggttcacattagcccttgtttttactgttggtctgttttcatatcatccaaatttatactcttcaatccttttccctgatttattcccattaactagagaatagtattttcttacacatccttactattttattgtaaatagtataatacaaaaatattaatgtagttcctctaccattatttaaaatgttaatatgttaaatgacattgagattctcaactaaaccctattaatttagttatctgaaaatgtgttctcctatggaaaagcatagtgttttctttgaaagactatgagttgcagtatcagaaaaaatagccatatttagcatttggccataaaactttattgaaattcatgagatgagggacaataggctgattacaaatttaaaatacatcagtgaatgaaattagaggcattgatttttcttcagtaatttgttttagtcttatattaagtccaagaaaattatcggtacttacagttttccttttaaaaaaaactcataaaaatcattcttatatactcatgttcatgacagcatactattctctttggaactttctttcctctgcttttcaaagttctggtgactttctattttttaagttttggcttaaatggcatttcctcattgtagatttttaaaaaggcctttctccactcccagtgcaccccgtcctggaaccattaaaaattaagttgcatgatcactgaataccaatttttttctcattcttcccactgtttaaccattgtcacttaaaagtgatttctctggcagtatataagaaattataatgatattttctactttccatttttgttagcaaatttattttagaaaaaaatgcttttaaacatgtctgtcaattaaaaggacaattagtaaattcatcaaatgttaagtttctatacctagagtaaaatgcgtatcctctagagataatttggtacaattgaggtcattagtatcttatctgtttatgcaattgtttattacaagtatatacaactcaatatatttttcttgcaattcaacttggaatatacccctgaaaaactctgggggacacatgctgtggtacattttctgtatggaccttgtattctagttctacacttgtctttaactagtagtttacttaagttactaaactttttttgaacattgtttctgcacctctaaaatgttagtttcaatagtgaatgattttaataattctacaaaaactttaaacatgtactttatttatcttttatgtgtcaaattatctttatgtgtgggtatacacgtaatgtatataataattgtattaaaaacaaataggaatgcatgcaatgaagtcatggctgttaagaaatttagccctgaattagaaatataagataaatcatacttcccagtgtgcatgcatacatgtacttgcaaatgtttagctagttgatcattcatgctttgactgtaaccttttgtagaataggcctatatcattttctttattatccatatcttttgtgccatggtcaagttttactgcatataattcagtttttctgtgaataggtggggcagaagatagtgccaaaaagaaagaatggaacctttactgtgacttgttttctataatcacattttataccacatatttttgttcacaaaataatacatgaaaggacataagccttatccagtctggtaaattttgggttaaaaaaatctatactgtattctgcacaagagaacacaaagatcttctatgcttccaaattattagaaagcattagggttaaaagagttttcatcctattttttggcctgttgtaattatttctcaatttttctccccatctcatcttcttccccaccataatcctttctatattctactctcagatctatcattctgaagtccaattctggtcattatgtcttttgattgattgaaaaccattctaatgttttatattttaatctgtcatttagggttctctgccatatgaatcacacctgaatttccagctttatttctcagtcgattccatatgtgccctgctcccaaactaaactagacagctctcttctccttcaagtatttgttcattctggtttcttttaagtatcatttaaactgatccttttaagtaccatttaagataatattttctccataaaatatttttctcgatgacctaaattgaaagtaaagggaaaaatctttgtttatggaaatgttttggtgatgtatttacattgtgtttgcacagatgaaaggcaacaaaaagttttgctaaactattctgcaaaataaatggacataaaagacagaaatccagggagaaaaaaaatgtgcacacatgctatgaatgccttttgtgaatgattttttttttgtgttgaaataaagaagaggcctgttttgtgatatcttggtggattgtattgtctagttactatttcacaagcccaaggaaaaatggcccctcttgttcctctccttctcttgcacaggcagtgggttagcatatggttgaggttttgccaattagtcaatttcagactgtctcctgggactctgaatcttgagcaagtggctcagaacatggcacatgtccagtgctgggggcggatagaccagtctgctcctagatcagcctcattatagctcttgttccctggctttccagaacattgaacatcctttgatacattttctaagctgatttcatttacttccctcaatttgatgaacactagatatccactcaataggtttcctttttcgtgtaatcatgtaagtctcctgaaagatgaccagaggtcctgtggtaggcagaataatggcctcctgaagatgtccaaagcccaattcctggaaactgtgcctattcccctttacatgacaaaggggaattggggatgcagatggaattaagattgctaaccagctgactctgagatacagagattatcctggattatctcagtgggccctatataatcacaagcatccttaagtgtagtaaagggtggtgtaagagtatgtctgagagatacaatatgagaaaaattagacttcccattgctttctttgaaaatagatgggatcatgagccaaaagatgcagacatcttctagaagatggaaaaaacaaggaaatgcattctcccttagatactccagtaaggaacacatccctgtcaaaaccttgatttaagctcactgaggattgtgtcatagttataagtatgagaatagggagcaggctgtctttgtctccagctgagcccagtgttccctgctggagaatgtagtagttcatagtgaagagcagagcaggttataaacctccagtctacctctgacttcaaaaatgaaatcccctgtctttgataataggtaatcttgtctccttttagtcactgttcttgacttcaattcccatttattttcaatttaacatctcagtatttcagccattgtcatttactaataaatatgcagcattgctctctgatttcatacagattttcagacatggatattaacatttgaaaaggcaaacacctgtttcttggtccttttctgatgatgtagaccatcagttctctggaagagataaatctctgttgtaagaactttactaatgctctgtttcccttgccttcttagctatggaatacctgacactcagacatctgatttaaagttaataaataaattcggactactcttgtacacttttaatatattccagttatggcaaagcaaagatatcaaggcagtctatttttttaacaagacaaaacacctagtaaagcctctcacttttatttctacttttgtaatttcctcagtacagttaacctttaaatatatatgtaatatatgtagatagaatatcaattaaaacaaaatatttcttgctgttaatgtacggcatttaaatactcctttattttactatttataaaactgttttatagaacactaaaaggtatgggcctgtttaaaaatgttaatcttataattaatagtcagaggcatacgcttttccccaacacaaggcactgatattctaaatctgtcattctgaactttacagtaggagacagccatctgcctgcatgcagccatataaaacaaagcaagaatatatgctcttatgtttcccttggtgagatgtaggatcattatgataaagtaggcaacaaggtttagctaatatgaattaagatagcatgtgttgaagaaaaaaagagcatattaaatcaaactaattctataagtcaacgttattagctgattggatgtggatgatttgataaagtagagcagcatatgatgtaatgtcaagtagatgggaaatatgtctgtgggtgacccattccttagtctcatagctccagaaaccctttctctgtgttactggatctagtgctattttagttaaggcctatactttaattgacaactctattttgctgtgtaacatgaaagttgttaaaataaaatattttaacattctttcacaggttaagaatattaactagaagtaaaaaggaatgaggcttgggaagaaaaatcagtttccaacatatctttatatctagatgtctacgcaattatatattttttcagtcatgttctttcatcagttatgtctagatttttctgaaatttaaatactctaaaatctgctttttatattttagtttaagtgaaatcattatgaaaagatatgaccactcagacacaattttttgggctcacccaatgtgtttttcagtttaattttatggggattatgatatcttcttcattaaaaacttactagatcaacattaacttctttggtttgacgatttttgaaatcttattttttaaagaaaactctcttttcttcctaaagcaaagtttttttttcataaacagatgacagagtggaagaatttaaaaattttgttatgccatcacattaaatttgattttccagctagtacagtaatatagcatggtggttaaatgtgaaatctggattcagccaagattacttctaatcccatttctaccatgtacagactgtgtgaccttgacaaagtaatttaacaactcaaggctttagatctctcatttgtaaatgggggtaatttagagagcctacttcagcagggttattctgagggttaagtgaaataagatgtatgaagcactcagtgtagcatctggtaaatcaggactcttcacaataatattatgcaaatttcattcctgaagcagaagttcatatattttaggtgttgattgtactcaataagggattcatttaaacattattttcatggcactctgtctgtaaattctgatttatctgtaaatcgtaagcatttaatactaagaacatttctaagaagttatataaatataagtataataaatataaatagagaagatttagggactgtttatccaaagcaaggtttttaccaggcaattgaaacaatttgaaaatggcatataataattattgaaatttacacttaaatttcatcatctatagcatgattcaggtttcatctggccaacctgagtcatgctataaaaaatgacatcctaggaccagattcctgaattacagaccttaggcagtagcagtagtcgacatgtgtcagtatggattctaaggcacacaacatcacagattacatttagagcaataggttgaaaacacaatcctgcccttggctttctttatgacagaaagaggcaagatactctattcaaatgtaaagagtaaatggttaaaaataaatattcatcactttaatatttacgaataaaatttcagttctgaacatgcatatcatatggcactctatgtactatactgaaacattttccaaaagaggcaacaacaaaaaaattacggataatattatgataatctaaaaatagtcctattacattaattttgtttagtatatcatgtgcctcagtattaatgaattaaagttattcttcaaatgcaattttgtaattactaattattgataaaaatattagtcatagtgtctgattatcatgtacttttaaaaaagaaatactctatagattacttaatggttagcaaaacattatccaatttattagtttttaaaatattataaattcagcaagaaaaatagttaaaaacttaagaagtataaaatgattaataatatgaaaacataatttctacagcaaaaataggatagatttccaattcttttcctgaggtcactttcctatattctgccaccaaaacatcaaatacaattaaacctccgtgaaaccttgcttaactccaaaaatcctccattgtttttttctggaagaaaatacagttactctatgaagtgttaaagatactaggtaaagagttaaaggagagagaattggagattcagtgggacagagagaaatgatggcttagagggtcattgctagtgtaatacgtgtgtatgaccaggagatacactaacattaaaaaattaaaataggccagtcacagtgactcacatctgtaatcccaacactttgggaggctgaggcgggtggatcacctaaggttttaggagtttgagaccatcctggctaacgtggtgaaatcctgtctctactaaaaatacaaaagttagctgggtgtggtggctaatgtctgtaatcccagctactctggaagctgaagtaggagaatcacttgaacctgggaggtggaggttgcagtgagccaagatcatgccattgcactccagcctgggcggcagagcgagactccatctcaagataaattaataaataagagtattttttaagactccacctagcacaaaattaaaaagataaaaagccctctcagaattttaaatagttaaatgtagatctaaaacagctttacaacccaaattatctccctagatctctctactcaaagaatataatataaatggccttaaattatagcagaaagcaaacatcatgatattttgcaaacacatgaaatacttttctcaaaatcaagccatagtgatgtatcttcagagcattttatagataaaatcaattttgaagaacacttatatgatgtcttaagagaaacatgaaaatagactgtgtttccatttctgtgccttttactatatttgcttgcttacttagctaaatattaaacattcacagtcacacaaagtcattgtggaagaagggtggaataacacacatgcacacacatccacatccacacacatgcacatacatacacatacacaaacacacccctttgaattaacattaggatgtcccacattttagcgcttaaatgggaatttattaaatacagtcttggataagtaataaaattatctgctatctgaatcataattcagtagtaatccccatcccttcctccctaatttagaactggagattagttgtatagacacaatgacacttcagctatcagtgcaaggacaacaagtcagctgcagcatgacttaatgcctttgtaatctgtccagggtgtttctggctttagttgtctagcatttccctaattaactgaaaacatcttaggaggctattagatgttgacaataggagaatatatttttttcattcattaacagcttcattaatgttaaaaccatattcttaagcatcaaaagttaatgtactattcttaaacactaaattcaaatatgaggatttgcatatgaagtatataagtgtggctatttggcaattaagcaataaaatagtattaattagaacctaattgtctctgtggaaacaaaggaaagattcaccataattttagaagtaactacataaaaaacactatgtttgaattttaacttctattttatatggcaattggaaatatatgttgaatggcattcctaatgcagaaaacatcttaggtttgcttctacaatactaaactgaaagtattcgatcagaattcatttttaaataaaattatacagctgtttcttgtttgtgctagtacccatcactaagtttacaatacatttcaactcctgtccattctctggagaggtttttaaaaagaaatacaaaagggtaatgaagattgattacctttttcacagaagcggccagtgaaatgtagtggacagtcacattggaatgacactatgccactggagaggaagatggcatggcatgtgcctccattgtggcatacatcctgctggcacacagagggtgctgcaacagaggggctgacagaagtccacatggtatcaaccccttgtgtcacatcagaagcatcaacaaaggaggctgttggagacagcataaatccctgggatctgtgatttataaacagacaagaaaacaaaatataagtaaaagcactaggaacataaatagaaataatagaaaatttgatttaatataagagaaaatgaaaccaatactgatcaaggtttaactgaggacaaataaaattatcatgtttgtttcacaattatgagatttgtaaatgttaaaaatttctgagccacataacatgaccctgtagtagtaagaaacgtggaagaaataaccttcataaacttgtcagttgttttatggaaaaaacatagtcctcctttagctgttacaaatcttatgagcctaagatcaagaattaggtcatgttacatcttcatgctaagattgtttgaacttgaaggatttctgagttaactgctagaaatgtgcattcattagtctgacttagcattaatttctgggagctatccaagaggtaccttagaaatacccataaatattccctaattttttttttacaaattttaataccagtttaattttttctttacaataaataatgaacaacaacaaaagtctctctgaattatgtgaaatttcctacttttacattcaaaaccccttgacaatctgattcatccctgctcttccagcctactttatcatgattcctaataagtaccttaaattctctcaaaccaaataagattgctattccttaaagatgctgaaatttcctaatattggaagtttgtttaatatactttttatgccttgttattcctcaattcctgtctaaatttcacctacagtgctaagcccacgcctgcattattttttgtccctggcccaacaagatgaaactgtagtatagttattttgtgtgtagcctctactatttagatgtatatattcattgttttttctttctccctccacacaaaagtttctcattttatcagaaatctttattcataatacttaagaaaatttgttgaattaatgtgttcagcatactcatgagtttcatatactgtctgggaaggtttttagaatttcacttaatataataatgagataattatctttttaatgtaaaaaaccttgtgcaataaaaatcaacaattaaacataataaatttttattttataccttgtcataaagataaaaccttagcaaaagaagtcacttcaaacattccccaactgatcttagagacttaaaaagctatttttatatctactacgcacgttaatgtcaacttattggaacaaaagatttaaagaagatgaaatagataatttatattttactgatacattaatgtgcaggtcagttctttcgcaacctgaaattcttctttatggtgttcatcacagattgtaccaatatatttattttcatgattgagcctgacctgcttttctttcctctggattgcaatctacatgaaggatggtgggatgacttctgtgcttttcttcattttattcctaacgatgcttgatctctagtaggctctccagtaaatattgtataaataattttgaatctttttttttgtaaatatgcaatgtatcacactactttctgttattgttgttgtttgtttgtttgggatgaagttttactcttattgccgaggctggagtgcaatggtgcgatctcagctcactgcagcctccacctcccgggttcaagcagttctcctgtctcagcttcccgagtagctgggattacaggcacccgccaccatgcctggttaattttttgtattttcagtatagacggggtttccccatgttggacaggctggtctcgaactcctggcctcaggtgatccaccagcctcggcccccccagagcattgggattacaggtgtgagtcactgcacctggcctgtaccacactactaaagaagaacaatagcagtgaaataattttgtcaccccaggttaattttatagctccattatgtaactctttagttttataaataatataagttctaacacttttgatataattttgtaatcaactttctctgatattgctctatcagaaaattagcatacatcttcctattagtccttgcgatataagtttgtctctttaaggcaactttcatcaagttaaatggcaatgctaatatgaatgacatgggatttattactcagtattctgaattctaatttaatttttagttttaatgtttctgaataatttcaccatttctaacatttgccatggacttcatgaactgcagtctgtcaccactttctcaggaataaattagaattaaatgccactacttctttctcctgctgtagctgctcagggagcctatgtctcacctgaaaaaaatcaatattttgcacatttcagttaagtgattgcacaaaaataattgctatcaattgatccgaaaacatcaggatcacaaatcaatttttgaaagaaacattaatcatttgatctttgttataaagatcaaatttcatatctgatatatgataattaatagtctttggctttcagttttatttttggaagttatagatgatgtcacaaatttacttgttttaaaatttagaatgaaataaaatgtattcaatttgttatatatttaaaaaggaaaattagttcacactgctaaaattttaccttatttttacatacagtttaaaaatatcaagtgactgtggaggtttattaaacataactagatgttggacttagtaatataattagcaatgtaaaaaaggaacagtaaaattaccatttttaaaattctagaaatcataaatgtatgagagtttagaaaatagtaagtgtgaaaatctgtctgatcgtttcttaggtaactttgtataaggatacagtgacaaaccagccattattataacaagaaattagtcttcaataactttttcttaatgaattagtgtctgaataacatatgctcaatggattcaaaaccaaacttgatcactggagaaagacaccttgataggacagcaatttccagtcgtgttggggaactctagttggaacaggaaaggaacacacactacttatttcaatcccacagcaagcagcctgtgaaaaccatggggctaaacacttcacattgcttcagcctgaaggattttgctcattgccagctgactttaccactgctcaacagacatttgtctggcacaaatgtttagaaggaagagtgggctcacacagatatgtgcctacgaacctggcttctcaagtacagaagtaggatcatttttagaatgatgatgaaatattaaaaagaaacaaacgctgccagaagacccttgagtttagagctttaatagtgtaaggggaagaaaggattcaaaaatcactgtgtttgattgtaaagagtagtaaaataaatgaattataatctggataacaaaatgcatatatctcatgtaaagaaaactcacttttttttttacaaaaatgagaatatactctaaacacatacttcattccactttgtctttccatttattagatatgctattctactctttgttttttcacctaaatgtagtttttggtgggctgctccattcataagaatagttcttcactttccttttaaaatctgcagagtgtttttattgtttggatatatcatcatggattctatcagtttgtaactgatatatttaagttgttttaagtttttttcttgttatctgaatcataactttattttcaatagttacattgagatataatttgcatacatagtgtacccatttaaacagcattatttaatatttttaatagatacagaattgtacagccatcaccacaatctagctttatattttgtcattctcaaaagaaatgtcatttcccttaacagccactctccaccatatatcctcagtctagtcttagtaaacgtttaatctacattctgtctgtagatttgcctattttagacctttcatataaataaaatcagataacatatatagttttggactggctttttcatttagtgtaatgttttcaaggttcacccatgttgttgcacgtatcagaactttattctttttttttttcttttgagacagagtctcgctctgtcacccaggctggagtgtaatggccaatcttggctcactgcaacccccgcctcccgggttcaagcgattctcctgccacagcctcccgagtagctgggattacaggcatctgccaccacacccggctaatttttattttttgtatttttattttttatttttttatttttattttttttaattattatcatactttaagttttagggtacatgtgcacaatgtgtaggttagttacatatgtatacatgtgccatgctggtgtgccgcacccattaactcgtcatttagcattaggtatatctcctaatgctatccctcccccctccccctaccccacaacagtccccagagtgtgatgttcccctgcctgtgtccatgtgtcctcattgttcaattcccacctatgagtgagaatatgcggtgtttggttttttgttcttgtgatagtttactgagaatgatgatttccaatttcatccatgtccctacaaaggacatgaactcatcattttttatggctgcatagtatgccatggtgtatatgtgccacattttcttaatccagtctatcatttgtggacatttgggttggttccaagtctttgctattgtgaatagtgctgcaaaaaatatatgtgtgcatgtgtctttatagcagcatgatttatagtcctttgggtatatacccagtaatgggatggctgggtcaaatggtatttctggttctagatccctgaggaatcgccacactgacttccacaatggttgaactagtttacagtcccaccaacagtgtaaaagtgttccaatttctccatatcctctccagcacctgttgtttcctgactttttaatgattgccattctaactctgaatagaccaataacaggctctgaaattgtggcaataatcaatagcttaccaaccaaaaagagtccaggaccagatggactcacagccgaattctaccagaggtacaaggaggaactggtaccattccttctgaaactattcccatcaataggaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaatcgaatccagcagcacatcaaaaagcttatccaccatgatcaagtgggcttttttctgtatttttaatagagacggggtttcaccatgttagccaggatggtctctatctcctgaccttgtgctccatccgccttggcctcccaaagggctgggattacgggcgtgagcaaccgtacctggcccctttattcatttttagtactgatatggatctatcatattttatttatctattcattagttgaaagatgtgggacttttctactttttggctattgtaaataatactatgaacattcatgttcagatttttgtctggatgtatgtttccatttctcttggatatgtaattaggagtggaattgctggattatatattctacgttgaacattttgagcaactgccaaactattttccaaagaggcttcaccgttttacatttctgccagcaaaatataagagttcaagttctccatatccttgttggatcaaacattcgtttttctttttttgacttttaaaacactatttaatgaccatcttatcaattccattgaatttaatctttttgaactgaaacctgtatgcttttcgttacaaataatttcatatgtattctttttcttccttttttttcaatttgctttctatttctttcaggtttttttaattttttaattttttatcttttatttttatatatgtatatatttattatactttaagttctagggtacatgttcacaatgtgccgggatagatacctaatgtaaatgacgagttaatgggtgcagcacaccaacatggcacatttatatgtatgtaacaaacattcttttttctttgtatctttgacaaaaatctccccatttcttctatcccccagatcctggcatcataaactcttataagtagtatgtacatttaattttttatgaattttgacaaattcccctcaggagtggttgccacaatttacatagtaacaacttttactctacttataccaataatttctttatcaaattttttgctgtttaacagccacttacataaaaactagaaacttgctgttgtttcaaattatatttctttattaataagtgtcatatgcagaataattcccacctccacttaaattaaaagtagttttctgaacttgcctaactaatatctgtttcattcacctggagtcacacagggcagaccaactgagtaaaaccccttttgcaggtaatgtatagtaaaggctgtgatggcttaccactctttctaagccccctatttctctaattatgcattatcaaatgttatagctataaacacatacacatgtatttaatatacctatgtctatatctacatctacacctacattaataacttgtatcatctcttgtactatttcagtggagttttttagttgccaggtgttcagttttcacacagggtaacttaaaacaactagtgatgtcttagtggtgtggctaacaggaataaatccagaaaataattcaattgctgttttaactttcaaaatcataagaacatcataacatctaataaagctttaaacaaatggaaaaatgacttcaaaagtttgaattgccagcattctcagctagttccaaaattttatgttgtttttagtttgattaataactttgaaaataattaatcattgcaaattttatgagagcaaagcaatacagaaaaatgtttttgctatttaaaaaacatatataattgtcattatattaaaggaggaaatatgcaaaattactgttagtacatgaaaaattctcatttgccattcaaaataaatgttagatagtaaaacaaatcatacaaggaaaaattaatctgaagaaacaaccccaagtgttactcctcttttttgaatataacatttatgtaataggataagaatcataccttaataagtttagtaagattatcattttaaaatgcaaataaattaattcactccacataatagtgtaattttaatggatcttgttttcatattttcctaatttttctcacgggacaaatgcatttctttctcaccatcttctattctttagctattacacagtcacaaataggattccttagattacaagctttgtcatatgattcatgttccctgcatccttgggtgttaggcaggactggcacctcagggcattgcagaccgctgtttcacagtatgaagggtggatatttttgaaacattctctcccccttgatagattctgattttactttctcatgccagagtacagagggttattattattgtttttatttcaatggctttaggcatacaagtggtttttggttatatggatgaattatatagcggtgaagtctgggattttaatgtacccctcaccctgtattgtacattttactctaataggtagtttttcatccctcatctccctcccactctccccacttctgagtctccaatgtccattataccactctgtatgccttgcatacccatagctaagctcccacttacaagtgagaacatgcaaaaatcatgatttttaatggctgtttatgttccatcctaaaactacaccatcaattatttagtagtttctctcttgtaaaatggttaaattatttccaattcttgtattccttttatgtttttaaattatactttcaagttctagggtatatgtgcagaatgtgcaggtttgttacataggtatatacgtgccatggtggcttgctgcaagcatcaacccatcatctacattaggcatttctcctaatgctatccctccactagctccccatcccctgacaagccctggtttgtgatgttcccctccctgtgtccatgtgttctcattgttcaactcccacttatgagtgagaatatgtggtgtttggttttctgtttttgtgttagtttgccgagaatgatggtttccagtgtcatccatgtccctgcaaaggacgtgaactcatccttttttatggctgcattgtattccatttttgtacatgtgccacattttctttatccagtccatcattgatgggcatttgggttggttccaagtctttgctattgtaaacagtgctgcaataaacatacatgtgcatgtgtctttatagtagaatgatttataatactttgggtatatacccagtaatgggattgctgggtcaaatggtatttctagttttagatcattgaggaatcaccacactgtcttccacaatggttgaactaatttacactcctaccaacagtgtaaaagcattcctatttctccacatcctctccagcatctgttgtttcctgactttttaaagattgccattctaactggagtgagatggtatctcattgtggtttgatttgcatttctctaatgacaagtgatcatgagctttttttcatatgtttgttggctgcataaatgtcttcttttgagaagtgtctgttcatatcctttgcccactttttgatggggttgttttttttttttcttctaaatttgtttaagttatttgtagattctggatattagccctttgtcagatggatagattgtaaacattttctcccattctgttggttgcctgttcactctgatgagagtttcttttgctgtgctgaagctctttagtttaatcaaatcctgtttgtctattttagcttttgttgctgttgcttttggtgttttagtcatgaagcctttgcccatggctatgtcctgaatggtattgtctaggttttcttctagggtttttatgattttaggtcttacatttacgtctttaatccatcttaacttaattttgtataaggcgtaaggaagggatccagtttaagctttttgcatatggctagccagttttcccaacaccgtttattaaataggaaatcctttccccattgcttgtttttctcaggtttttcaaaggtcagatggttgtagatgtgtggtgttatttctgaggcctctgttctgttccattggtctatatctctgttttggtaccagtaccatgctgtttttgttactgtagccttgtagtatagtttgaagtcaggtagtgtgatgcctccaggcttgttctttttgcttcggattgtcttggctatgcgtgctcttttttggttccatatgaaatttaaagcagtttttttccaattctctgaaggaagtcaatgatagcttgatagggatagcatgaatttataaattactttgggcaataggccattttcatgatattgctacttcctatccatgaacatggaatgtttttccatttgcttgtgtcctctattatttccttgagcagtggtttgtagttctccttgaagaggtccttcacatcccttgtaagttggattcctaggtattttattctctttgtagcaattgtgaatgggagttcactcatgatttggctctctatttgtctgttattggtgtataggaatgcttgtgatttttgcacattgattttgtattgagactttgctgaagttgcttatcagcttaaggaaatttggggctgagacgatggggttttctaaatatacaatcacgtcatctgcaaacagagacaatttggcttcctcttttcctgattgaataccccttgtttctttctcttgcctgattgccctggccagaacttccaatactacgttgaataggggtggtgagagagggcagccttgtcttgtgcctgctttcagaaggaatggttccatgttttgcccattcagtatgatattggttataggtttgtcataaatagctcttattattttgagatacattccatcactgcctagtttattgagagtttttagcctgaaggcctgctgaattttgtcgaaggccttttctgcatctattgagataattatggtttttgtcattgtttctgtttgtgtgatggagtaggtttattgatttgtgtatttgaaccacccttgcatcccagggatgaagccgacttggttggataagctttttgatgtgctgctggattaggtttgccagtattttatttaggattttcacatcgatgtttatcagggatattggcctgaaattttctttttttgtgtgtttctttgccaggttttggtatcaggataatgctggcctcataaacgagttggggagaattccctctttttctattgtttcaaatagtttcagaaggaatggtaccagcacctctttatacctctggtagaattcagccatgaacccatctggttttggactttttttggttggtagctattaatttctgtctcaatttccaatattcgactattcagggatttgacttcttcctagtttagtcttgggagggtgtatgtgtccaggaatttatcagtttcttctagattttctagtttgcgtagtattctctgatggtagtttgtatttctgtggggtcagtgttgttgtctcctttatcattttttattgtatctatctattttgttgatcttttcaaaaaaaacagctcctggattcattgattttttgaaggtttttgtgtgtgtgtgtgtgtgtgtgtgtctctttctccttcagttctgctctgatcttggttatttcttgtcttctgctagcttttgaatttgtttgctcttgcttctctagttcttttaattgtgatattagggtgtcaattttagatctttcctgctttctcttgtaggcatttagtgctataaattttcctctgcacactgctttaaatgtgttccagagattctagtacattttgtcttaggacatctttatttctgccttcatttcgttatttattcaggagcagtttgtcggtttctatgtagttgtgtggttttgagtgagtttcttaatcttgagttctaatttgattgcactgtggtctgagagactgtttgttatgaattctgttcttttgcgtttgctgaggagtgttttacttccaattacgtggtcaatttgagaataagtgcgatgtggtgctgagaagaatgtatgttctgttgacttggagtggagagttctgtagatgtctattaggtctgcttggtccacagctgagttcaagtcctggatatccttgttaattttctgtcttgttgatctgtctaatattgacagtggggtgttaaaatctcacactattattgtgatcatagagaagaggcaaactctctgccttttgataccagaacccaaagctggatgggaattagattgatactttctgcatttaaaccaaatcagaaagtatcagaaatgggatttttctttcttccctccacacctcaaattctaagttttttttgttgttgttgttgtaaaataccctctacatgtttcaacagttttatgttcatatttcctttttgacatccgtgactttagctcctgtcatcctctaatccatccttctcactgtgttcatttttcttgttgtattactctcagccccaattttttccaattcaaagtattcattttctattatttgtatcatcccactttttggtttcatcggcctggaatgtcttcctctatatcccatgtgtgttctagctacatctaaggataatattttcaatattctatgccttatgattttcatatgctgaggttcctctgagattaactttaaccttaaaatctcacatttttcatccttcaaaatgcagttcaagtttttaatatatataatataaatatataaaaattataacatgaattatataaatatataatcatattaataaatataatatattcaaatatagtattcatatatcatactcattgatatatattttatatattatatatacaatatataaattaaatacataaatattgatataaactaattataatttatatatatttattaagtataataaatataaaatataattatataaatatatgtaaatatatgaaattatatatttacatatatgtaatatttttatttgtatatataaaatctccaactaaataaaagcacataaagtgagtatttttattcatatcctcctccaaacccaatacactttcattgccaaggggcaatcactctctgtgttacatttcatacaaatacatatcatacccagattataactataacttagttttctttctttattagcttttaagtggaattgtgttagtcaagagtaatgtcagctcccaaatctcagtggcttaacaccaccaaaactcattttttgtccacataaagttctatcagcatagacaggaggatttctgctctgtatagtcattcagccactttcgtggactcaggtgacatagaatatatcaacttcagcacatagctcctgaggtccccttgggtgtcacactcaaatattcaaataccagacagggtaaagaaggtaggggaaaaaggaagcatcgaaaatcttcatacatctcattccattggttagaacttggacacatggccaaactcactgcaagggagcacaggacagtagtgtccttgtgcctagaaaagtagaaaaaagagttggtggatccagccagcttctgtgatacaaatcatgttataaaaattgctattaaacaaaactaaaatacaacaacatattttttcacattcaattgcaaaacatcttggggatcttttattttcattatacatgatgtaactcaggaattttaatgagagaagtttttactgaagatgaatcacaatgtattgtatcatttccctattgataaacatcatggttgtttcaagtttttcaagttataaatactgcagtgaatatcatcatacaaatatcttgtgaccattgtgagttcatctgaagaataaatatctagagatgtaacttattgggtcaaaaaaatgtccccagttttcattttaatatatactccataaaaactattagaaaattcagttccccaaatatttttgagtactgatttccccaatccctcactaaaattaattgtaatcttcatttaattggttatatatctggtatagaattttttacttacattttatctattttgaattgctagaatatatgcttcctcacttcttcaattgttttcatctgtcaacttataggagataatcctatataatggatgttggtccattttacatcttttcaaataagatttgttggtctttttgagcattttgtaatgttttcattgttttccctcttccattgattctgttgaaaattcacttgttaagtccagttatcagttctgtaggaaacttgtatttcctctctggatgcttttaagaagttccctttgtctttgttgaacagaacgttttcagtgtgatgtgttgagataaagaatcgtttttattcatctaggttaggttgttttacagggggcttttctatttagagaatttatggtttttatctattctgcaaatatagccctctcacattcactttatagtctcctgttaaaatatgtattatatgaaattgaattttctcattttattctccatatcctcagctccttttgcaacacctttttcaattcatagcatgttttaagatatactatcttgctcattaattctcttcacagctttgtctaacttctgtttagtatgtcgatttcaaaaatttatatatacttttactttttgaagttctatttgctaatattttattttctatctttttttaaaaattatactttaagttctagggtatatgtgcacaacgtgcaggtttattacatatgtatacatgtgccatgttggtgtgctgcacccattaacttgtcatttacattaggtatatctcctaatgctatccctcctccctccccccaccccacgacaggcccgggtgtgtgatgttacccaccctgtgtccaagtgttctcattgttcagttcctacctttgagtgagaacatgcagtgttgggttttctgtccttgtgatagtttgctcagaacgatggtttccagcttcacaatagcaaagacttggaaccaacccaaatgtccatcaatgatagactggattaagaaaatatggcacatatacaccatggaatactatgcagtcataaaaaaggatgagttcatgtctatttggtattatttttaaaactctttactcaggttgttttgtttgttttgtttttgttttttgtgggtgttttgttttgttttgttttgttttttggcagcatcttagttgcctaggtggcagtgcagtgacacaattgcagcctcaacatcctggctgggctcaagcgatcctcttacctaagcctcccaaagtactggtattacagttgtgagccactgcacctggcttatactccgtttttatggcatcctttttcttatatctactttaatcttcctctttcatttcttaaaaaataagcataactttaaaaaaattctgtatctgataatggcaacctctgatctttgcagatttaagccacttccttctttgttcagctggttcctgtctcatggtgctttttatttctcttcaaatgctttatcatttttcactgtagcctcatattctttggaactttatctgtgagaaaacttagaggcctgaggataagccattactccaaagaggatttgtgtttgctttgtccatctcttgaggaaaattccaaataggaaacattataaaataaaatcttatttaagaattttgggtctctactaaaaatacaaaaattagccgggcatggtggcgcacgcctgtagtcccagctacacgggaggctgaggcaggagaatggcgtgaacccgggaggcggagcttgcagtgagtcgagatcgcgccactgcagtccagcctgggcgacagagcgaaactccgtctcaaaaaaaaaaaaaaaaaaaaaaaaaaaagaattttgggtaaatcataataggttttgtccattaacctccatatccagctagtttattgttataaataattggggaagattttcctcctcctacatataggtgaggtatgaaagtttccttaggcatcctttttttttttccctctcttttctttcttaatttccttctttctgttttatcggctgtaagaatttttatcttggcttatagtaatttatttagagcttttttctctttgttagcatgaacgttatatatgtcttatagctggatatttttttagttgccatactacctgaaatggaagtcacagttatttttaaatcttccgtaaatttctcagaatgcatatctcctaaaggaatcttactgctttcaacactgatatatatgaatgtagcttttgaaggggtgtgtgtgtgatgtctttatgcttttgtgttttctatagattctagataaaagtaggcttagacatgtgtgtacagtttgcatagctcaatattttgtatgttgtatttgtaccatagaacacttaattgttttactataatcatctccctttctaggatttaaaaccttaaagcaacttcatttatttacttaagtaatgaacacttaccatagttctgacatctagtagttgctagagaagtattttttgactttacctttgttctaatccatagatacattctgagataaggcatttaaaaacaaaccatttttagatataaaagcaatgaacccctatgggcagtgaactctatagtatgggtccttaaatcacaaattcatattcaaatgcaaaaagtatgtagatttttgagggaatgcaggaaattaaattgaaaattatataaaaactttatttttgactaatgctatatttttacttaatggcttcattttgatttggaagtcattgaagtttgaatgccttgccattatggttagtaagaaatatataaatatgcgatattttaggactaagtgtttcatgtcaaatggaaacatttattatattaattaaatttaatttattcatttcaatatggagagataatactctggaatacttccaaattaacataaaacttacaggaaagaaaaatattctaaaatacaagccaccattaaaaatgtgtgattacttattacctggaaagtgaatccaaattagtgaaagacaagtcagtaatcaaggtgacataattaaaaatcacacaattagctctagccataagaacatatgtgctggcaaagacaaatgcaactctgtcttctgagcctcacaaggaggaaggaacttcctgaagctcataggagtctcaaagagtatctatttcgtggaaaggactcctttaaaaaatctagacctagacattaccagccaggatttgaaaaacaaaatagaccaaacgaaaagccaagtaaatcgatctaggattaattacacacaaatcattcatttacttaaccaaaaaggacttctaaattaccctctatgcaacaaaaactcacccatcaatattataaggtgaccagtaaaaccgggaccctttgaaggagaattcagttttgtagagtcgaggaaaaaaggcaattgtaatattgcataatgcattgagggtgactctatacccgtactgctctaaatgctgcatatgtactaatataatttaattctcacaagaattaaaaaaaaactaattttattttcctaaatgtacaatgagaaaacagaaaacacttaataaacagactcagggtctcaaggtaaatatttgtatggtggaaatgagtttgaactctcatagtttgagctttgaactaaaacttcctaaaatttctacactcttggtaggagacaaaagagggcctgctgatgacaggtttgaggttaagaagatatttgacattagcagagtaagaactatcaataagaacatcctcaagaggccgagtcctaaaagaccagaaggacttggctaggagaagaaggagaggcaaagaagtctgtgatgttaggaagggtactcagaaacctgccagattaagttatgtgtttaaaacctagaggaatgagacagcatgcatggagaattgcaagtgatttggtacagaagaagcttgtgtgtgtgtgtgtgtgtgtgtgtgtgtgtgtgtgtataggtgcgtcttgagagagagggctggaatatggggaggcttgtcagccatcatttaaggcaaagtgaagtcatcaatgtctcttaagcaggaaattagtaattcatgtttattttcgaaactacactctggttttagcatggaggatggcttggaaaggagctggaggcagttgaaggaggaggagaattggactgatacttgaactaagagaatgttatgggaatgtaaaaaagtaaagagatttaggagaaatacggtttgtttccaaaaggactttgtggttggttttaagtatgaggtgtgtaccagtcaggggctgtcaggaaacagacggtacattcagaaaaagtagaaatagcagatgttggcaaggatacagggaaaaggtaacttttatacactgttggtaggaaggtaaattgtacagcttctatggaaaacagtatagagatttctcaaagagctaaaaatagaattactatccaattcaacaatcctactactgggtatatgtccaaagaaaaataaatcaacatatcaaaaagatcggccgggtgcagtggctcacacctataatcccagcactttgggggaccaaggcaggcgaattgtgttgagctcaggagttcgagaccagcctgggcaacatggtgaaaccctgtctctactaaaaatacaaaaattagccaggcatggtggtgcatggctgtagtcccagctactccagaggctgagacatgagaatagcttgaatcttggaggcttggaggcagtggttgcaaccagcagagatcacgccactgcactccagcctgggctacagagtgacaccctgtctcaaaaaaaaaaaaaaaaaaaaaagatacctgcactcatatgtttatcatagcactattcacaatatcaaaaatatagaatcaacataaaggtccattaatagattattggacaaagaaaatacagtatatatagccataaagaagaataaaatcatgtcttttgcagcaacatgaaaggaactggaagccgttatcttatttgaaataagtcagacacagaaagacaaatagaacttgctctgactcataagtaagagctaaataatgtgtccacatggttgtacagagtggaatgatagacaatggagtcttggaagagtgaggaagttggaggggggtggatgatgagaaattactaaatgggtacaatgtatcttttcaagtgatggatattccaaaagccctgacttgaccactgtgcaatctatgcatataacaaaattgtgcttgtactccatacatttataataataaaaaaggaagggtaattaaaatgagtttaaggaacagactacttcaagttggaaaagtttaagagaatcaacaagagagaaatttttccagggctagaattggatagtaatcaatggacttgaagaagcaagcagatggaataatttctgcaatgtggacaaagatgtaggtataggagaagaatcacctgataagagctgtggtcctggagagaggaatgcatctaccgcaaacttgtacttaacggatagagaataaggaataaatcctctgatctttttttcttgctaccccttcaatgtccttccatcacattgcccaaacacaattggaagtcagaggcaatggggagtttgttagttgcaaccaataaaagtcagcctctcaggtacgaggcagagtagagaaaaatggagaacagacctggaagtgaggcagaaaatacctagcctggggagaaagaaaaatgtaagtgaatctcaggttttgaatttaagtaactgtgtgaacaatacaatttactgaaatggaagatacaaatttcatgctgagaaaaaattcagtccatctggttctaatagtgtatcttatagaaattcctaatattacctatccttttctccagatctgatttattattttgaccttttaaaaatatttctcaagcaatttagaaaagtggaaacttgagcacatgaacttatgtcaccacattgcctgataagtcggtaaactatactttttacaaataaacagtgatccatttaataacattcctgctcagttgggtcataaaatcacaaccctcaataccatttttcacctgggggcagctagcagaattgcacgcaaccgtggccaggggaaaataatcatttctctaaagagaaaaccttacagctattacaaatgcctactgcatcaggggaatgatttaaaagatttattttaacatattaggcttaataaaatagagccacaaatagctaaagcaatgatggaaaaattttcctttcaaaattcaaaagcatttttaaaagttagacacaatcattttacattcaaaatccaatagcttacattgaagggtaatcattggtttctgattactgtgaggaatcacaaatttaccgataaattcgtgctggatattagagaagtatgcacctaaaaaactagaatccaaatgggaaatcattacttaaaattctgttgtattagaaagaacaagcccaatcacatagggccctctattaatttccatgtgagttctaaggaaagaaccaaataatgatatatcttccattatttttagacgtgttggcatactatttttcttttatgcaaatcctggaataaaaaagaacattaaattatttgtatagtttagtcttttctacaaatacactagataatatgaggaaacacgtaagtagatcaaaaggctctgagggaaaggacagttcatagattaaagcaacactctttatctcaccttgttcattacacccaatattatactactgaagcaatggattttgccttgtctgatatgaacgtttattaatggcttgtctgtgaaaagctgggtaattggctttaaccagcagtatcctcaggacaatagagatagtctatttaccattactttttatgcagtcaaacgtgaaaccttaaaatagtctttacagtccttcagcttatctcaagacaggtagatttgtttaataagctttaaagcaactcaattgcataatctttatgtactgaacatcatatttcagagaactactagaactatttcaggtgagaatatgtggacctcagagaattatggtatagcagcattgaatagctagggttgcttctgatgtctatataagcaatcttgttttactgagtgtattaaagtaccttcaggaatgccaagggggattcacttcaaagaagaagagtgtgactctagtatactgaggcacagtacaagggagataattataaactaattattcttagttgttacttctcttctattaaataaaagcaagcagctatgtggttctcccaacgtaaaatgccatttctttttcattttctcttatttgttttactataaaaccagtattatgaccatgttttgctgaaatagtttagtgtgtttatccatttcttccctaaatattcatcgtgtgcctagtatgtgctaggtagtgagtatgcaaagattatctggtcacacaccattaagaagctcttgaagaggttaatgagacccacagacaaagtaagtgaagagaagttctaaaatgccaaaaggaagaaattaagtctgtatcaagaatttaagaaggcttcaaagagaggtcaactgatttaaatcctgaagaatagaaaggagatttcaaggtggaaaaggttattctaggctgaaaaaacagtatgtgaaaaagtgtaaaaaattctcagtactggcaactggaaaatgtaatacattttagaggatggatttagaagtcagtataaattatgatggaattgtcatttgaatatttttcaatgctagctttggaatattttgtcttacaggtgttgaaaagtcccaatttctctttagtgcttcagatgggattcatttgtacaactctgcaactccctttaaatgtaatatgggcccctgagctctcaccctctgcactctccatgccccatcctctttcattgatgccttcctatatagcccaaattcaaattagaaacctgagcgtaatcctttttcctctttctatctccacatattcattctatcaccaagatatcttcaatcattggtatatgtctgacagtccactgttgactatcaccacttcatgcctaagtgcttgtgaaaacaatccaattggcttccttgactccagtcttaatcatcctgtcaatcatcatagtcagggtgatcatgttaaaatgtaacctgttcacacaactccccttcttagaacattcagagactccctatcattcttactattaagtttaatcttcttaccatggctttcaaagccattcacaagctggttctgcctcttgaggagtctcatgtctaatctctcggccttcaaacaacttgctcttctctgctttgtcctactttccctgatggatgcttatttgtactttaattcttaacttagaagatagttgtttaagaagctttgcctgacactcctctagtacaagttagacaagtcgtatatatttaggcccctgtacttctactagaaatcttatcaccctatactgcaatagcttatttatttatatactcctcctagaatctaaactgtaacttcagtgattttatctatttcttcactcctcattgtattctgtgtgcccaatatattccctttaacagtgatggcattcaatagttgcagagtagttaaataatgtgttagagcctttaacataaaggccactgcatattacatatcatgttgagaagtttggaccttattctttatgtcaatgcttttaactatatgtgaggaagtactaaaacccataggatacacatggtttagcttctggaaatatcaatattccttgaagctaattaatatatcagttaaatagtttaaattaaaatttaatatttgtatggcttaaaataaacaacattttaataaaatattctgtgtactctgttgctagagtaaggcacaaaatactgtatttctttactcttctaagcctttaattgcacacatcagaaactcttgagaaatattgttgtagatatcagtgggttttatgtgaagtagaataataggcccagatttaaatgtaagtgtttgaaagtcacatcttctcattgtaagtgataaattggcatcatagtttacacatcagtgctttcttgtgagagcaacaaacacttgcacaattttacactactatagttatcgtcgtgggtcactgtcagcgctacaaattatttcctggtcttaagagtttctttgctgtgtccagagaccatggcaagcaccagagtttttttagctgtcacatcactaaagaagtatcaggtctgtactgacacctggccctcacatgccatcatctatgggagggatcactgcacctgtaccctgaaccagcaggacccttgcttcctctaagttaactggactgatcactgaggtgacttagtgcaggggggtttattctcaaggggacaggctttagccgttatgaatcaagggctagaactgggccataaattcatcttttcttccccccaaaagactgttctgatgtgatgggtatagggctatcttaacatgtcctgtgtggtgaagccatcagttgtgactgttatgaagttgtgatctgcttagtaatacaccccttcttatttgtcctctgtatgcactttaacccccaacttcccctcattctgggaactgtaatcaacctaagcttttaattcacattctattttctaggaaatctggtacaagaaagccagatttgggaaattggtggcagattgttgttctgctctagggaggccttaattaaacaattatttggcctttctcgtgtaataccctcttgcctcactgtacccatgtcttccccatattttctagctacaataccactctcaagaaaattttaaaacatttctcaggaggacatgttcgtttggaaaacagtctgaatgtgcatgtttggtgtcatctgtgtagttaaaaagtagcaatataacaaaaaggtgcatgctgttttcaatgtatgccactatgacagattatttcagtttgctcttccagagtcaatttctagcttgctcctgcatgaaatatgccaggaaagctgacctatcttactacatcaatggggcccctctgcgctctgtattttagactatttggcccaaagggaagtcctagcaggagctgggagggaggcaagaaaatgtgatcagaataatattcattcttgtcagtccccgtctctgaggtcacatcaagatggctgcattccttgatagaagtcacttctcctacatatccttcctcttgctttgttccctgggcccagggatggtaatagcttgtcagctgctcacctggggtttctgtactatttctgggtttccactacacctcatccactcccgtattcttgccacgtagtaaataaatcctgtttgcattattgtaacatgatgtgcatctgtttcctgtttggatcctgactaatacatctgtcaatacacttgcctttgaggaaatgaccttgcagaagcaatcaaagatttggaaatgtatgaaattacatatagaagcaaagtgaaaagaggggaaggacgaagttttgaagactattagatttaaaggaaatttgatgttaaagatgacttgacctacccagaaaacaaattttgtaatgtaagtgtaaaacttggagattactttgtgaaaaattaagcacaaaatattttgaggataaaagaatactaattgctatagaaagatggaaggaagtgaggtttgaaacacgttcacttatttttagcatttaagccatcattgttgaccatgataattgcaatttcagtagaagctgaggcaaaaaacagccagccatgaactacattatgagtaacaggtgtgaaagttcagagaaaaactgagacccagtcttgcaaaaaacttaaacatccaggggaagggtttctgaaatgattaggatactcagatcctcactagaaacttcctcaactaaaatgatgcttatccactttgtctatgagcatcatctttcttttcttcctaggtctagttttctctttgtaatggattttttaatatttctactaaaaagttatataaaatttattgtaaatatcatgagctactggcagaacaatatttagtattgtaaaattaaagttgtacaatattatttttgacaaactgtgcctttaaaaaagttcaagacattttgatttgtttctaattggattaaacagattaccatttgtatactagagaggtgttattgctgttttaattcaaatttcactttaaaaatcattactatattataagaattcaatcatatgacttaaataaccaagtgcatgtatgcaagtatatatgtgtaagtgtgtgtatgtttgtgtttgaacacacacgtattaaaacgatatattcacatgatatatgtatttgtgtgtatacataatttccttatgtacagagatagcatgtaggccactttggtagtctatttgtccattattcacatttattatgaaaaattttatgtttcctgacctcattttcttttctacaagtatctagactatgatcacatagttaaaaaaaagttcattggtcttccaaataattaaaattcatattttgtatatttccatgtgcgactgtaagagctactgattcagcaatgaatatccttttaattcttatataaaaatctgagaatcatttactataaatgacattgtctaaaatacttctctaagtatcatgaatataatcataatactcttaattttgacaaaatttacatactttagaatttaaattgagtatctgtcaatatgttaaatctactaagtttttacaaatagattcatcttgataaattttcactacatagctcttttttccttcatacatgtagaatgtatgtgatttaaatcttacatggtagtcaaatgcaaacaatggaaaagtgaacatctgctcatgcttcattgtggttgctttcaggaccttcttcatatgactgattttagatgtaggagtaagcatactaattcattagacactttgcttcagcctactaggggttcacaatggatggctatgtggaaaccacttatactgaagaggtagtgcttgatatttcatttaagcagctcctgtggatttggctactattgtctttcaacactaccagttttctttttattgctaagctgcagtgaaaaaaagacaaaggagcagaagaaaagcctctacttaatcatactgagaagttgttgacgttcatctgtcctgtggcaaagttattaaggggcctgcctgtatgatgcctatctacagaggagcacacatggccatcaatagcaaaagtagtaattagatttgtcattatgtactaccagctatgaaggagtgaaaggcagctagggaacatgacctaccatttatgagcttaacaataaatgtttcttttgatgtatatgcccacgagaggcagagagatcaagataatgagagctatgcaaatagttacatcacggataacaagaaaaaaataaatccatatctctccactggtaattcccaatgctatttctccttcattggttctccagaacttcagcacaattatttgtttcttgcaggtcatttcctttcttatatgtagtcaacacctcaaaatctattatgtctttcaataaaacacatttcttccttcaaagctaactcctgattctcattcattcagactgaaaaactttgatatatctttggctcatctttcatttctttctctactctttattctctctgccatttagaactaaatctcctgtttggactaatgaaacatttcctaactgttctcaccatctttagttttccctccaacttatacaataaagcttcgtaaatttaatttttaaaacaggcctagagttcatgatccgtctattctctgaggacttttaaatgtcactgtccacagaatttctccctttttctatttagtagttgatagttgcttgctttctttaagccatcaccctttttaccattttaatctatttatccttacttcctcttcaaaagttagtttggcctcaatatccaagctgacccaaatcccctcatctgtgtcccaaagtgcatatcatatattattagaattatctatttgtatctgtttctctttcttaactataaatataaaggcagggcctatgacttttgtatctttttatctccagtataaagtgatacacaatatcaagcaaaggtacacaattcattttagttcattggatgaaattatgtatactatgtcctttccccaacaccaaatcaagaagtgacatgtaatttaacacctggtctaacaagtatccaggaatgctcacaccgctgctctgcaatgaatggtgtggatgatgatgatgatgatgatgatgatgatgatgatgatgttggccatgacagcaaccgtgatcattattccaattttacactgtgacaacagaaaacactacaggtacattcccaagaccttacttaattgttgacaactaaaaagatcctgattacatcacatagaaaggattcagggcaaattttgagattcagtgcaagttttcacactctcacgccaccatcttcaaactggtatcaaatcttaatatggctcttgcaccacagaaaagcccattggtgttcttaggctatagaatgccatgtgatcctaagaagctatgcgtattcattccttcctccaatcaatctgctttaccttttcctacacagcagaaattaaattcaaatgttatatgtgaaagtaagcaaaaattaacttaatggtacagtatgaaataggctgcttatttcaaatttctaattttcaggagttacaagtcaattcattgtaaaaggagcttttcagacaccccaatgcaaataaacctcctgcagtagcaaagtacagagcactaaagaagctggagagtgaacccccaaggctggcctaatgagaatggcactaaaataaatcggttgctaatcagagatgaaataaataactttccatactgtttaatacaaatgcaggaaggactttgtgctatagcatgttagctcagaggataaagtgggtaaatgacaacaaacaaaagaaaaaagtgtgacccttgaatcttgggttacataaagacaaaacagattctaacagcaacagtatgccagatggaatatgacagctatcctgtttcaaagtcagcatagttatcacacaaaataaaaataatctaatagcatttacctcaagatattaagtcactgcattaaagtataaagaagaaaatgtctcagtacttctaggctgctcacattctgaacttttttaaacgtaaagttcattatcgttcctatttacgagtgtgagatcctagagcccttcctttacagttttttttccatgttatacccccatagacacctaattcaacacccaaaatgctgacacagtgacatatcaaatcagtacttttgtcagccaaatatctagatggaattcaggtagatcaatactgtgagtcatttggacttagaatttctctgtgcttaagataatactgtattacataatacataaaagtaatccttcagggcacttgccttctgagaacagaggccccatgtttgttctagctacatgaagttatctgaggcttaaccctgctttcagaagaaccacctactatggattcctctttattcaaagacctgctcttccaggtatatctagggagcaaatattgtaaccagaacttacaaaagctggggtctgggatggcgattttactattctagaattgattggtcaaccagttaccccactggctactcttgctcccagccctgttatatttgaaataaagttaggaccaaaacagctgtaatgttcccctcaacttgtctaaacatttagataggcttctttctgaatgtaggtctctgacctcccttttcttagagcatttactttataaaccttttaattggaaattatttctctgcctcttgagatgtaaatgttctcccagcctcttgccagattcacaacccaagaatatctttttcaaggatttaagagccatccctttgatatgtaatcttggaaggagatcctgcccctccgtcccagtctctgagagggcaggagcctaactttgatatgtgtgccaattagcaaacacagatggcctaatcacattgaccaacctaccccctactctctcccagtacttttacacacgcgcacacacacacacacacacacacacaatctgagttctgtgtgtgcatgttgtctcagcagaactgagttcaatttctctatcctattgcaatcgtcttgaattaaggttttcttgtatatctctggtgaaatttttctttgacagtcccctcttttgcagatatagagttatatttctaacttttattattgttttatcaaaaacaaaacttatttgccttatgtattccataattatttcaatattttatctgcctaaggtgcctgtggaagaaactgcatgcttcccttcaatattctctgattttttttccttctaaataacaggaattcctatatttattgggacatttagccatctgaagtaaagacttaatgttttacttctcttagcgttaagtatgtaaatgtgacttaagttctggccaatgaaatatgtgaagtaatatgtgaaatgctgagaagtgttctttaatggggcggggcagggggtattttttccttcatttcttttaccctgctatttgctgcaatgcagctaggattgctggagtttcgctatcttaaacacagtgagaatggcaggacatgcagttagaagcctgggttactgaccaccatgaggctgccatactagtcaggactgcttatatttacgggtgaaacaatgctattttgttttaaccgcctggttgtatttgcttgtttgttttatgtctcccacaggtggatttcatcctaactaatattggtacacccactagttttccagccttcttatcaagtagttcttatacctctttgataatggcaatgggattttagtaggaagaaagagatgcatacctttgcttagttttaaattttgtaatggaggtactgttagaattttgacaggactgatgtaaacatctatactgatgatttgaatatttattatatttaatctgccctctctattaagatttttctccatttattaaagtctttatagcaatattgtagttttcttcagacaggttttgcattatacttgtggaggttattcctaggactgttatgcttttattctatagtttaatgaattatcttttccataacatcctttatttcattactgataatatataaaataattcctttattggtatatctccattagtttaatttttaatttttaaaaaattttaacttctcttaactttccaatttgtatatctttttttagtttttagtttttaattgctgtggatacataataggtatatatatttatggggtacatgtgatgtttttatacaagtatacaatgcgtaatgatgaaatcagagtaactagagtatcactttcagcacttatcatttttttgtgttcggaatattccaattctactcttttagttattttaaaatacacaataaattattgttaactatagtcatcctattgtacaccaaatactagatcatactcattttaactgcatttttgttcccattaagcattcctatttttcccggcccgccccgaccaacccttcccaattgggaaaacactccaggacattggtctgggcaaagatttcttgagtaagacctgaaaagcacagacaaccaaagcaatgatggacaaatgagataacaccaagctaaaaagcttctgcatatcaaaggaaacaatcacaaagtgagattgagaatgttaggttgattttttaatactgttagagttttggttgatatatttaatctaagatatagacacgtaaataaaaactttactttgtatttattttaccattaacatcttatttatgtttttgtcttattttattgtccagaacttgcacataaatggtaaatagtaacgaaaagttttctccttatgtctcagtagcacttatttcatgttttattaacatgtaatcaatgaccatgatgttctcttctctgttaacttaaaatgagatcttaatcatttattattattcaagtactgtttttctaggacatttaactcaaaggagttttcatggtatgaactacattgttttggcatatattgagatgttgctatctgttatacttttcttattgggcctactaatgggatatatacctaatattaggttattttgttttttttttttctttttctggagtgtagttgcatcttggctaaccacaaccaccacttcccagggtcaagggctcctcccacctcttcctcctgagtagctgggactacaggtgtgcaccacacgcatggctaattttcatatattttgtagagaaggttttttgccatgctgcctgggcttgtctcaacctctgagctcaagcaatttgctcgccttggactccaaaagtgctgggattacaggcaggagccactgtgccaggctactgtattcttgattacttgtataagtcccatttagatgagataaaattgtaaatgtaattatgatctaagtttcctaacaatgtgcccatgacatgtgcatttatttcagaagtgattttgtcatataacacttcttcctttataatataagcaattttagtgctttctaccaccctatcccaacacaaacacagaggagactaatttcatttgctagttttggtaaacattatctgagttttagaatcctaaatattattcaatatttttatattgtatatatttaatttcagattattttttgtaatttgcaaaaaatacaaattgcataatttgtatttttataattatatatgtactgtattttatgttaaaatggttcattattagcactactcctttaaaaatcacaagttcttcattcttagttgatggcacacgttccctacgttatatgaatagtatgctttttaagactctatttctatatcatcaatatctaagtaaaaatttgacagatattttttaaacattccctcccactcaaccccctggtgagcttcctttttgctttgctggcttttctttggctgtttaatgttggagagaaacatcttaaggcatatactatttttgttatcttaaaggtaagctcttttagtttcgttttcttttattttgtttcctgcttgagttcttacagccatctaaaacttatttttcaataggaacaatttttccaagacttacccagtatgtctctcttttcattaactttgcaagaatctggtgaattcttttgttaggtttacacaagccttcatttcaacaccagaaagttttctttttaatgtctttattcttcaggaaaaagggagcaacattattacactggtgctaaaagcatgatttttggagtcagactattttgtttaaattctagcttaattatttataattctgcaggctatggaagctttcatgacctctccttgcctcagttttctgtgtgtaaggtgatgatagtaaacgctagtgcaaatgacataagattgttacaaggataaagaagtaatctgtattattaaaaaagaatctggcacaggataattgctcaataaatgttaactgttataatctcctcactgtcatctctcttatttctttttcctctttattctggggacgcttctgaaagtttttctcttctgatttgattttctcaagtcactagctttcttcagtaaatccaatgtgtattttactcaaacttctgcgatattagttttattgaaatcttttcttatcttacctagatcccttttcatctaagcttgttggttttatatctcatcttcttattcttttaagccagactgttctttccttatgacagcattgtcctatttaataactttttgaatttgatttaatatggaattttcccgcggatctacagtaaactacattttagaggtgctctttctctttcaagatgatgtgttttctcttctgccttagtattgtttcatgaaagccatattgtcactgttgtttttaatttatcaatattcatttcccaataaaggaagtcatggctataataagtattcctaaccaacaggatatggcgatttctcttggctctgacgattggctgaaacccatatggatgtataggtttgtaaaacagacccttattaaatgtagatccagaaggtagtgtgatacctaaagttatcgacccaaaaattaggatctaaaaactgttctgtttttgtggctccatgaaaaacaaagcaacatcttctctcaataaaagaacaagataaagcctgcagcttcaaatatgcaaagttatgcaataatctttctgtctttgccattagcaagtgctttaatatgtaggactatatttacaaaggcagattttatccttatattccacacccatgtatttacatgttgcatagctaaagcttaatcttctctattggtatagatattttagatggaatattcaatactctagtgagctaaaagaaaaacaacaacaaaacaatgaatgcctgtatggtaatgggaaggctgcttagttttcaggttcaaatagaaacttaggaccatgtactagctaatagtgatttattagttagctaatgccatgtcaaacccctccaaaacaccacacttttacttaactcacaattcggcaggttgctaatctggactaggcttaggcgggcagttcttctttgttcacctaggcttaatcaggtttcctctgacaactgctgcttctgttgggatccaaatgatctaacttggtctcagttaggactactgatttctgttccacaagttatctctgtcctgcaggctagccagtgcttgtttacagaatagtcacaggggattcaggagagcagtagaagtgtgtaatacctcttgagattcgagcttggaagtggcaccatgtcatttctgctgaataatggcaaaagtaaatcacaaagccccagagtcaaggtgtgagataatagacttcacttcttaatgaaaagagtgactggctgggcgtggtggctcatgcctgtaatcccagcactttgggaggctgaagcaggtatatcacttgagtttaggagtttgagaccagcctggacaacaaggtgaaaccccatctctactaaaaatacaaaaattttccgggtgtgggctcctctattctcgtctattcaagaggctgaggcagaagaatctcttgaacctcggaagctgaggttgcaatgagccaaggtcgtgccactgtactacagcttgggtgaaagagtgagactgtctcaaaaaacaaaaaagaaaagagctgctaagtcacattgtcaacggcatggatataggaagaggttacggattgaggatattttacacccaatctgtcagtggagaagccataaaatgttttctaacattttattggaataaaacaaaattatctatttttctcattcagttttgtcattctgagagttatgtttacccccaaaatttaaggcacagattattgatgttactttttcttattttttattacctccgaaaatgtaaatggtttatgtcaaagattgataacagtatgcaatttaaagtcacaaaaaatgccaatatgcattttgtagaagaattatttctttccattgtattgatagtttgctgtaaaagttacagtttttgacaataaattgaaagcttgaaagaaaagactaataatatgttgacacaactgctaggtataggctggtccaacattggatctgtaggaattgatcacaataaactctgattggtgaaagctgtatgaaatgtcttagcctgatgctaaattatcttgactttgaatgaagtttcttgaactcctcctggtcctgaactggaaattttcatgatgtctaacgtctagagaagaattgctagaatatgttgtggtctcatcatcttttaacaaaccagttttgaacaggtagtgatcagaaattgagaatagaaaagtaaaattgaccaaagaatatatctcagaaactcaaagtagaaaggacaagtatgttgaccttagtcacatctgagtacttctcattaccaattgtgacttttggcaagttaattgacaaccaattccagatttgaaaatgctgtcctgagtattaatgagatttttatatcaggtgcttagtacaatgtctggatcatagtatgtattttccaaaaaataactcttcttatttagagcattgccttgattaggacttcctggagttagcacagtgaattataaaattatgaccatatctttgctctaggttttttgcctccatattccgtgttagttgttttaatcattcagtccaacagttaagagtggcaatacttttcagattcaggtactcacagaagttttttcaaataaaaattgacatgaaaatttacattttcacaagaactgaaaatgtctaattttttaagtgtttatatattaagaagagaatcaagagggagttgctattacaaagagttaataaaactctaagacaatcagcttgcattatgtatttcagtttctaattttacttcacaaaattataagtgtacaacacccagacactaaatactcaattaatttattagtgattgggtgttttaattaagatgattaagttttagtttggtattaatacatgggtaatacctaagcaataatgattaaagtttgagtgagaggttagtgaaattcctgtgggaaagcaaaacaatagagtgcttagcttaaaaaaaaatccccaaaactaaaaaaacccgagtgagtaatgtttaccagtcagcaaaagtgtaacaaaaattatattcctcagggtgaaactgtcttcagttcagtgagtttacagttccattattacaaaccacttttaaaatgagtgttattgaactgatgctgatttaagaccttatataccaattttggtttaacaacaacaacaaaaaagacaagtcagttaaggacaaaatttgaggcaatgtcacagtgacacttcactttcatggaggttagatttatggcaacctcactcatccagaacacagctctaatgaaggcttggtgaagcaagcctctgtatggccacgtgtctctgaggagtcaccagcattactctctaggggacatgggctaaccctaagttcttaaccaggcactggggtgtttggtaagactccaccaaattagacacagtgcaataggctgacagtagcaaaagaagttagaagggttagaaacataaagccactgcaaatagtgagcactaaagctatcataaaaatacctgatgttttgaagaaagcacttgcttatgggctatgtattctatttaaaaaagcaagaaaatatgaaaacagtcacattgtgcatgctttaaatattcaactttcaaaataatgatttagaatatacttttggggtaactgaaaaaatgttgttttacatatgtaggacttttaatttttgaagaatctaaagatatttagtcaagcaaactttttgtatgcttccatgaaatttatttatcctaacttttttggaggggaaatgttgcatgaaattaacaccacaacccaatgctcaaagagatctgagaggctcgaatgggactgctattcagtggagccagtgtcataaagaaaagtagttaaagacttcttcctcaaacaccaagtcctgacatgggctctgtgcctcttctatttgctctgttatctctttcccttcttactaactctcccacccatacttcacctctcttcctagccatgtgttctgtctgctgtgggcaatttcttttccattatccgtgatagctccctgtaatgaagcttcattcttcctgctagcatccccactaaatgcaccctaacagcaaaatgaattccactggctttaaagacctaaatataagaaatacaataaaatcataatggcacagaaagaccatatagacattaaaaatcttgaaacagaagaaaacttgaaactagtaacaaaatcagaagctaaagaactaataaatttgactaaataaaaactttaatttctgttttgaacatttatgacagagggaatcaatataaattaaccaaaaagccaatgaaaaaataaccaaaggtcagaacacagaaaaggaatatggatatgttacaaacaaaagattgctcatccctactccaaatttaaatattttcatgttttacgtatctggcaaaattttaaaaaatgattatggtgaggttttaggtttttgctctcttatgttgtagatggtgataggaattgaactgacaccctttttttgaaatttggttaattgccaatattgattttgtgtttaaaagcatatatctttccacttttgaaagtttatcctgcagatacacttgcatatatattcaaatatatagtgggtgatattttaatcacagcatttttttttcctagcacacaactgcaaccaacaaatccatcatcataggaatgtaaacaaattatgtcacatccataaaattaaatatcatgtagctgttaaaaagagagaagtagatttttgtgtactgatatgaaaagtctccagtaattattgttaaaaaagaacatcaaagaacacactgttcatggcatcttctgatttaggaaaacaagaggctatatatataaataagtgtatatatgaatagacaacattaggaagggtatataagaaataattttggggaatagagatagagttctgaggtgggagagagaatcacttctaatgtgtagtcttttgggtaattaaaatgatttacatatatgatttacataataatgaaagaacaatataaagactatcctgattgctatgtagacaacacatttgaggaggtgtaatagaagggagaccagttggggggccattgcagtatcccaagtactgatgatgttatagcagctagggagataatggaagtgaagaagatgaatatgctggaagtatatattaatgttacaatacatagcacttgctgatagatagaattttggtgactaggatgcaaggaattaagaattgtttggggattctgacctgagcaattgaatacataatggtgctatttacaaaaatgagatgagtatgggagggggcagtgttataggagaagcttagacaatcccacctgaggaggttgtatttggagatttgccatggtttagctcttctttctctttggaagagagaattgataaatgctgttcattgccctagcaggggataccgcaggcattgacaacactttgcaaaagataatttatatctgaattaacaaaacaagaaaatgagagcattctacagtactaatatatcttccactggctgaaaaaatgtatgcttcctcatgtgtgatgtttctattagagaatcagtaatttttctcagtgctttcaaagagagcaaaaggttctaattgattcatcattgtctaccaactaggctatgacagggcaatggcatcagggtcaggaatagtttctctttgaagcaggtaccagcttattacagagcttggccaaggaaaccacactatactttgcccatctaagatggaatagattaatcttataagggacaattaaaatgaaacaaaataccataagaatttggggctgaaaaatcagtgcgactaacatagaataatttcatagaatgaaataaaaatggaaaataaaaataatttgttgaaaaatcctggagtgattaatgctacatcacttcattgctttaaagtaatcaatcttttttttaatctctagaagggaaaagatagttatccctctaggtaatctttgaaagatacctaaaaccaaccaaccgactatttcacaaacaaaccaaaaaaatagaaagtgttctaattgtaattatatttctgttaataataagcatcctagtgaaggtgtcaggttagcaaattgatacattagatgtatacatatacttgatatacatatattgtcagtcaaatgatttttaggataccacattattttccttaatttttgacactactatatttcttgctatttgaaattctgaaattgcattgtttttaatctttaaattatatggttacctctaaaaggtctctgtgatatttttatatttttaatactgctaactctttaatacattcaaaagtatatatatgcaagatatgagcaaggtattatctttaggacatattacaacaaacatattttgactttgtagtaaaaaaaaggacaattcctattttttaaaaagctctgttataattctttacaaaggtccaaaagaaaacatactttactgaatatcaacatactttaagtaaattttttcttagacaattaatttaacattctatttatgtagttggttggataattggataatggctgaaaaacacaaaatgcagccttagtatttatcgtaattctggcgtagacatatttttacaattttattttcaattcaaccatttttaaaatgaataatggtgctatttatatgcactactctgtttttggttcactgcagcaaagtatctacttctcattttagtgtagttgtgaattttcttcaagatgactttcacatgtgtcatcacatgtgtcatggtgtatatacttatatactcaactttttctgaaatacagtaccaatcagtactaggtaagaagataatgatgaagattgccgggggtggggggaatgggcaatttctccttctgcagacctagcagttaaagatttatttggggtattgagaggtgaacgaaagcacctacgtctaatctaactacacattattaaaaattaaaagtggagaaatcaacacaatgaaattcacataattgctgatacttaatgaaaatgaaagatttatatgcgctgatatataaagctaagatattgaaaaaccaagtgacagattgatatgtgagggattatagaacttgtaatagctgataaagaatatatttgttaagcatatgcaacatttgtttaacttttaaagcataataataaaacaatgagtctaatgacttaataaacagaacatcagtagcactggtttagtctcttcagccccagtcctctgcctcacactcctcaacaaagcattccctatttttgaatttcagtttgctttcctttatatcttttgttttgatccccaactgaaacagcatagttgttaattttatttgtgtttataacttataaaaaatggtgtatgtacactgtattattcatttatgacttccttattttcaattaacaacattcctaagatttaaccatgttgatatgtttatctctaggtcgctcagttgaattactctataatattgtgttaacatactacttttctttaccagtgtgaacagaaaatagagttgtttcagtttttagcagttatgaacaattactttataaacattcttctgcatatttcctggtggctaagtacaagagcaagaagtaaaatttccaggtatataagatactgttactctttattcttatcaacacttcttattgttaagtttcaacatttttgcccatctagtatttaacaggctttattgtggcttcagtttgtgtttttcatacacagccaatttttctattgagttgtcctacacatttgtatctgatttttgtattatctgggaaataatcatttgtcatttttgtatgttacaaatatgtcctaccaattgtggcttgtttttcaatatgctttaaaaggtttttttgggaaacagacattctcatttgtagcataattaaatttactgattttaaaaatttatgttaaagatttagggtttcttttattatgaagttatagagagagcctcttatatgttctttggaaaatttaaatgtttccttttctttttgtgaagtcagagaaagagtgtcatatgtattctctaaactttaaaactttacctttttaaattgctaacttaattcaattgaaattgatttttgtttggtgggatcaaattttgtattttgtgggttttttttgcattaaactaaacactttatccacctcattttgtaaatcatgtatgtccgtctgttgttccattgttctgtttctattcctgtgctgatactaaatattccctattcttattttattttatttatttatttttttgagacagagtctcactgcaactcccacgctggagtgcaatggcgtgatctcagctcactgcaacctctgtgtcctggtttcaagcgattctcctgcctcagcctcccgagtagctgggattacaggcatgcgccatcatgcctggataataggccctcacacctggcctatatattccctattactttaagttttgtaatatattttattatctaggaaggcaattcactctactagttttgttttgctttgttttgttttttcttctccaaaagatatagaaacccatagggattttgagcctacgtgtgtctttgcacatgaggtgggtctcctgaatacagcataccaatgggtcttgactctatacaatttgccagtctgtgtcttttaattggggcatttagcctgtttacatttaaggttattttgttatgtgtgaatttggtcctgtcattatgatgctagctggttattttgcctgttagttgatgtagtttcttcatagtgttgatggtctttacaatttggtatgtttttgcagtggctggtactagtttttcctttccaaatttagtgcttccttcaggagctcttgtaagtcagcctggtggtgacaaaatctctcagcatttgcttgtctgtaatggattttatttctccttcacttatgaagcttagtttggctggatatgtaattctgggttgaaaattcttttctttaagaatgtcgaatattggcccccactctcttctgacttgtagggtttctgcagagagatccactgttagtctgatgtgcttcctttagggattttgactggaattgtattaaatatatatgtaatcatatgtgtattaatattatgtacaagtaaagtagggtagaataaacagcttaatagtataaatctccttattcaagatatcaatttaagtcttttaaatatatttcaataaggttttataatcttacacatgttgtatttttatactcatttataggtatcttgcatatttataaattatattttctaaaactttggtattaatatgtagaaatgcaatttgttttcacatattgattttcaccagactaaaatatcttattcattcccttaatgtttttgtattttcttttcggttttctatgagggtaatctatgaattttgtttttcttctaagcaaatctacaaaacttccattaatttattttatcttactgcactaactagaaagttcattaccatgatgaatggaagtggtaaaaagcttaacatttctcagttgcttactatgtgtctctttattctgctttttgcacatcaggtcccttctgctcctagtttgctaaatctttgtatcatgattagatgttaaattttattgaatgtctttagtatttattgagacggtcacacatgttaagttttaatttaagtttaatttctattttctgatcgacttctttattttgcataaagtccatttttcctttaacgtcattgttggttaaagtaatcatctgcaatctaatctttcttgggataaatctgtcctcagtgtttttttccccacctttttttctaaaattctttttaactaactatatagtctctatgtttttccctttatggagtgtttgtataggctcatgtatttttttaattcatcaattttgtaagctcataattcttttgaggactactatcctaagttaagtggacatactttccttacagctccttcttcctcttgttcatgggcacctttcatttctttccttaaatactaatagtctcacagatactagattatatttcagtgcattaccagtcctcttaatctagctgggtaggctgagctgtggtcatggttatttgcagcttggaaactctacttgcatgctttctatttttgtgcagtttgagaagtcccttttcctcatggcaaagtgactttattttcttccttccaactacaaccatgtttgcatgttaagttattaaaccttcaagtctttctggctttttggttaagtgtatttccttgtatgtagacacttgttgccatttggtaggatttcaggtactggctgcctccagactcctttctgttctcacaactaactcttgctcccagacttatccctccggatcacgtttctgcttatgacccagtgatttagagtaaatgtgcatcaagaaattgtttcccagatcccagcgtataacctttaagtgacggtccacaggtattcactttcaggtctatacgctatggccctgcttacttaatctgctctactccctccattcatttattcattcattcatagacagggtttcactccccttgacctgcctgagtgcagtagtgtgatctcagctcactgcaacctgtgtctcctgggtcaagccattcttctgcatcagcttccggagtaggtgggaatacaggcccgcgccaccacgccgggctaatttttctgtttagtagagacgggtttcgtcattttgcccaggctggtctcaaactcctgggcccaagcaatctgtctgctgtctgcctctcagcctcccacagtgctgggattacaggcgcgagccaccacgcctggccgttttttttttttttttttttttacaaatcagctacattgatcttagtgaccttcgaatttgccaagtatgatcacattaagaattttgtacaaatttttctttcatcctggagtggggtaactatccttcttttcttcagtcagatgtcagcccagaattccagtttaaagaaaaactttgctgaccattctatttaaagccttaatccctgtcactcctacttatattgtgacattagtacggtgtctttgttatgtttgagttgtctacaagtaccgaacttagactcattgagaatgacagcctgatcatgttcattgttgtatccatggagctaagcacagtgcctggccatcgtaagtgttcaatccctatttgttgactgaataaatgaaaaaaaaaaagtttgaatgcctagtggcgactatctggcagctggaagctggaacaacaatgccacaaagagctctgaacgtgatttcagctgttttcttcaagttctgtatctctagcctgctattgatcttccagaacatcccataaagcatgcacctggcaacctggtcacacctacaaccttcagccctccaaattggtgactggtaatgggatttttcacaactctctgttgatttcactcaaatctatattgctctgggggaaaagcagaaatatctgtaaacaggaagcgtcctcttttggtttagtccaaattaaatctgcatatattctttgaaataagtttgcgattggtgctaacccgtctttcaagttctgatagggttgtctttttaatattgtgcttatttgcatttaatctgaaatggctgggtggtggagtatgcataagtctgtacttaaagacatatataatataattgggagaaactttcaacctctattctagattatctgtattttgatagaatcagaaccaattacaaatgcacacttatcatgttctatttctttttttttttttcttgagacggagtctcgctctgtcacccaggcagtggtgtgatccgggttcacgccattctcctgcctcagcttcccaagtagttgggactatgtgcgcctgccaccacgcccggctaattttttgtattttcagtagagacatggtttcaccgtgttagccaggatggtctctatctcctgaactcgtgatctgtgtgccttattacctggccaggcgcggtggctcacccctgtaatcccatcactttgggaggccgaggcgggcggatcacgaggtcagagattgagaccatcctgactaacacggtgaaaccctgtgtctactaaaaaaataaaataaaataaaaaaatagctgggcgtggtggcgggcacctatagtcccagctacttgggaggttgaggcaggagaattgcttgactccagggggcagaggtagcagtgagctgagatcgcacctttgcacttcagcctggatgacagagcgagactccatctcaaaaaaaaaaaaagcttattgccttaagagatacattccaatcacactactgttatagcttcttatctctctaatacagcattgccctgaaaatgcctatacatccctgagataatcaggatataggtattttctttccttctgaatattttaaggtttggtctttagataccccttgaacttgttttgtgttgacttcgagattgacagtttgattactaggctgaagatctgttattggctaagtgctaagtttctagaaataactaagcactcaaccaatataattttgtacccttgaaagataccttctataattaggtataagtcaactgtattcttcaaaagtcatccttcctctttgctatcttccaaaataaatgggttaaaattagaaaatctgtttacattttcttcatctctgtccatcaattccaatgagttccatcatagttcaaatttaatctatgcataaacacttaatctaaatcatgtaataattctaattatcaaatctagaatcaatgagggatactgctactctgaacttaaattggagtcatgaggaagaagaatttactgaacaggaaattgtagaatattcagagactgaacaagccacactattgttctaatatcaataaaaggaaagacggtaatgctagacatgtaacaaggctttcaaaaagtcagtaatggtgaaagcatatgtgtgattatatgcagtattcaaggtcctgaaatactgaaataaaattggttcatgaaaaataatacttccttgccatagaaaataggaagtcagatacactcctctatgataatgtaattttattgtcaaaacctagacatggcctcattagtctaggttcatttctattattgtcacaagagtggattaacatcagctagtctcaaaatagaattaatttggaatatattctgcaaaatgtcaaaaagttatataaatcaagccaaaaaatttagtgctcatgaaaatatatgacagctaatttattgatgcagtttttctcaggatctgtgtaaatcaaaacaatatattctatggtagcatttttgaaatcattctatgaccatggctgtcacctattaatacatagaatacatagaaattctccaaattcatcttgtccacagatagagcattgagaacttgttaaaatcattcacgtattgaacaaaacacaaactctctcctaatgcttgtcccccaaataaaaataatgtgatttttacagatagctttgtgaaacacagttgcaatttccacaggtgtattgaacacatcatcctcaacaaatttgtagcattatatatatgaacatatagtggtatccaaagacagtctgataacccagtttcaaataattccaatgagaaaattaatttggctttacaaagaagtactcattatcaaggccacccatgctaatgttacctaaacctgtaagataaacctaaacctgtaagataaaagcacagaaagaactgagatttataaaactatccatagcgcaggagactttattttctacatttagtgaaagaagaaagaagtaaaaggactggccctagtcattgggcagataagataatgtccatagaatccagaaagaaagtataattatacaactcttacctttcaaggagaacgagttgcaaaatggaaagtttatcttgtacaccataaagtagaattgaagtatcaaatatatctcaaggaactgaaacaacatgcagatgtaaataactaaaaatttgaataatcaaggaggatggagaaacaaagtgtttggataggctcaaaaattctaatgcaatcctaggctaaaattctgagcaaatagcatctagtctaatccatacttttaagatcacatttgaaaaagtttggttctgggctaaaactaaatactaaatgatgaaatatatcaagtctagagaaagagtatgaaacattcagaaatcatataatttaaaatagaaactattgaaatttgacttgaaaatatttagtaaaggcctaattatcttttagaaatcttaagaggggcatgtagaaggtaattatactatgtcaaagaagctgtagtgggagagttcagcattatagctcttacagcagttgaaaatgtaattggatgccttatgagatagtaaattccactatctcaagtctttaaacagaacctgaatgaccacctgtcaaagatatcttaaagaacatttctgaattaagcagaaagtttatgtaactgctaaatgttcctttaattaatgaatatcatttgcagcatctttattatctttggaataaaatatcaagatcatatattaataatatgttttctaatcacatttttagaagctttttaataatgaaattattcattcttattaagaaaaatgtactttataatgtctgacatatatgacaatgatcattctgcctttttatttcatgtaacagaattttggagttgtaaattcttgagatattcttattttaataagaaacttctttgggtccaatccaaggaaaaaattaaactgtttactgtaattaggaaccctaaaaacacactactaaaatatttcactgcctaaaagttcaaatttttcttgataatttgggataccaaaaggtcatgccctggttgcttaaaaacatagaaataatgcccagtttttaacattgttagaaggattagtctagtttggtcagccaaaaactctctctctctctctctctctttctctctttctctctgtctctcctccctctcctctctttctgagatagggtctcgctctgtcattcaggctggagtgctgtgaaatgatcatagcttactgtaacctcgaactcctgggctccagcaaatctcctgccttagactcctgctacaggcacatgccaccatgcctggctaatttttttcattttctgtagaggtgaggacttgttatgttgcccaggttggtctcaaattcctgggctcttgcaatcctcccaactcaaccaaaatctttactaatacattttcactactacaaaaacatgctgccatcttccaaccctttttgtttgccttttaattttcctgttaacttacacataaaacttcatatttgtttttgcttttggtagaataaaaaattaaaaagtacttatgatttcttatacattgaatagcttttgctttaaataaatacagtaaaagaaacattaataacttgagatgattttatgaaaaagcctgctgtttttactcagcaaaaagaatatttgtaatatatacattgtggattcccaaagggacaggtagcattttaacacaagaatgaagcttacatcagcctgaagccaaaacaaatggatctccttttttatttttattttttgtaacagaaaatttatagtcagggttgaggaataaaggccatgaccacattcctgtttactgtagctacttcccatacctctctagagacctttctatccacttgtaagggtaaggtgaaaatgatggctgttgccttaggaaagacagcagggacatggctctcagcttcatttcctacgtcttggaagtatctgacttccagatatgcattactgtattaacacgcaggtcttggaggaatggatagtttatttttccagctaaattttatccttaggcggaggaatactaacgagaagtatttatgtcctgtagtatattcaaattactgtctcccaccacacagagaagcagcctgttgttcctttttctcttttgtccttttgtctcttttctttcttctcttcattcttgatttctctacaatctaagcagcttgtactcctataccaaggcctgcagaatcacatattttagattacagttcacgtttcaacaactgtatcaaattaaataattaagactgacttggcctggatttaatcccttccttgctttggttctttatttctttggtgctccagaaactagggcatgattcactggacacggcagtatgcagagaaagaaaagattgtcaattgttgcccattatgtcatgtttttagtctagaagttatacaaatcacactgttgctctctcacgtataaattacagttattctaaatgacataactgttggtagaaatgtaagcatgtattcttaaataaaaatatcaagtaaataaattaggaatgtatatgtcattatagataaaaataaatgtattatctagtgtaaccctggcatttgcatttttagttatcgatcatcctgtgaacaaatacactgctttggtttcatcatgaaaaagattgtgtgactgcaggcaggtgacttaacctcacctagataagaaaagagtatgttagtagatgatctctgaggtattttccagctcaaaaattctattattcttatgatttctagactatgcaaatactatacatgtgcttaaggccgtttgagtcaaacttgtagatgtgtgacttcattcataactgcaaatgaagaaaaatctaaatcacgtgctaaagaaaaactccaccataaatttatacagatggttctatttgtgtacaacaccgtataaaataggtctagggaaaggcatttaaagtaaaataaaaccctgtgaatatgaatctctagttatcattgcattattctctagattgcaagaaatggagcctgtgaactttaatcactccttttgtaattctaatcaaataaaacagctagaaaatgccaattggtaaagtcatctagctccagggggcactgctgtactgtgcatcaggtttggtttattgatgaaggcttaagcaagatttcattaaggagttctgcaggtttcagatgcagaaaaagcacataaactatttataatcaatttaaactttgagaaaattaggtaactatgtaaaatatttatatgcagttttttggaaatgaatgtttcctttgttggtaaaagtatctgtctttctgcagcaactaactatggttgtggataggaatatttttattaacttttccagtcaagggctcatgaaggacaatgtatgtttctgctatggaattatttaaagcattctgccctaatattcaaaatataaacaaaaattgatatacttaatgcctggacactgcaatcctttaattggctttaccattgttatagtcagttaatctctgatcagaagggttttgtataattatgtaaattctatctatgacttaatgcatctttcaaaaaaatctcaaatatagcagctcaaaataatctcaaaagtgagtgaccacttgtatcttattaaactgtgagaaatgagtagtgctaaggtgagagtcaagtatggaagtcaaaatcagcactctcatatgttttaaaagcatagtaaaagaaatactttcgaaatgaattgcatcatttaaactattatatgtggattatgaatacctaacaaatctgtaaatttaattaaagaccaaatcaggataggcaagtatttatagtaaagactgacagaattttttaaatttatgttcaagtttagctcaattatccctcactattaaagcactgataaacattgacttgacattttcaaaccaaacacaggtgactttcaatggctgaaaatcttttaagcaaagaattgaaattctatttagattagggtaatgtctggtcatttctagtccacacatcataaaaggcataatgaaccaccataaaaatcatctggatttttcatattaattattgtgcatatatggcatgattttcaatgtaaatgacttgttttagcagcaatgtattaatagaagaaggaagagattcaggggagcaaatatagaaagtaagaagattggagggttttttgcaataatcctgaactaaggcactggccttgaatatggagtagaggggaaatttttgagatatttttaggagataaaattgatgtaacttactgactgcataaagggcagagtggtgagagaatgcattgactgtgattatatgtgatggtggaggctctaactgaaagtgtctattctgatgtctgggcagacacacaaacaagcacttctgaaaagcaacagcaagcaatatgaaataaaaacatggaatcatcatataaattggcttatcaatttattttaattagccagtagaaggacaacttgagattggatttgttcaactatatatcttgattctggggataataaactaataatcattcttagttgcaaagattttgggacagggtctaacatagatatccatgcaacaattctacaataagttctcttttctttgtctgatgcttccaaattagagtcaaccttttgcgtattcttacagaagtccaacacttgaaggaaagtgaaaacaaagccctatcaggagtgaaatataatccaatcatttaattctcagaattggtattagttctaatctaacaaagcaacttagaatcaacttagaatcaatctctggatatgtcagtgaatgtgtctttagatgactccagctgccaggctttaagtcttccagctgaggtttttcctaaacattctgggagagaaacaagctattcttgtgtcctcttggaatttctgatccacagatttcttaagcataattattgtttcacaccagtcccattttagggcaattttttggtaaaccataataactggaatagcaccctaggtcaagacactgctatcttatgcctgaactactgagagaaaatgttctttcaacttactccactagcattcaatcctctgaaagtctattgcttctgcattcaaaagatactatgaatctgatgaattctcattgtttcatgtttatgaaaactatttcctgaacttcagttctgtctcttatagtttaccagatggcagacagaatcacatatatttaacatatatattacatcatgtcttgtcactgctcaaaactctgtttcccagtcatactgaaattgaaatttaaaatctttaatgtggctataaatttcctaggaagctttctgatctaatattctactacatcttccatgtccacttcagctccagtgatagtgttacaggaatatacaatcttcattttcacgtgaatacttttatgttatctggtttctttgcctgaaatattcccccaaatattgtcctggtcaagtcctcatatgattcatatttttttaaagcaccacttcttcagagatgcctttcttgttctgcctaactaacatagttaattaggcaggtcagaatcaatatgctctgattccttactttgcctttcatgtatcccttaactctagaagttagactatataattattaatttattagtttgtagcctgtcttctatactaacatattagctctgtgatggcaaagattttagttagttcacactgtattctcaaagcttagaacatgactgaacacatatggggtactctgaagtattctagaataaatgattagatgactgactgaataaataaatgataaacatgcctagtgagaggtgaacacacgcttttcatctctagtctattagaagtaactcacaagctggagggaaatcctagttctatcttataacaggggtatgcttttggatatgcttctgtattagtccgttttcatgctgctgataaagacatatctgagactgggaagagaaggaggttttattggatttacagttccacatggctggggaggcctcagaatcatggtgggaagtgaaaggcacttcttacatggtggtggcaagagaaaataaggaagatgcacaagcagaaacccctgataaacccatcagatctcatgagacttattcactaccacaagaacagcatggggggaaccgcctccacgattcaaattatccccaccaagtccctcccacaataggtgggaatgatgggagtacaattcaagatcagatttggatgaggacacagagccaaaccatatcattccacccctggcccctccaaatatcatgtctttacatttcaaaaccaatcatgccttcccaacagtcccccaaagtgttaactcatttcaacattaacccaaaagtccacagtcgaaagtctcatctgagataaggcaattcccttccacttatgagcctgtaaaatcaaaagcaagtaagttacttcctaggttcaatgggggtacaggtactgggtaaatacagccattccaaacaggataaattggctaaaacaaatgggttacagggcctatgcaagtccaaagtccagcaggacagtcaaattttaaagctcccaaatgatctctttgactccaggtctcacatccaggtcatgctgatataagaggtgggttcacagtcttgggcagctctgcccttgtggctttgcaaggtacagcctccctcccagttgctttcatgggctggtgttgaatgtctgtggctgtaagctgtggtaggtggatctaccattctggggtctggaggatgacggccctctttccacagctctactaggttgtgccccagtagggactctgtgtgggggctccaaccccacatttcccttcttcattgccctagcagaggttctcgatgagagccccacctctgcagcaaacttctgcctgggcatccaggcatttccatacatcttctgaaatctaggcagaggttcccaaaccccaattcttgacttttctgcacccgcatgctcaacacaacctggaagctgccaagacttgaggcttgcaccctctgaaaccatggcccaagctctgtgttggcctctttcagccatggctgaagcagaagggatgcagggcaacaagtccctagactgcacacagcatggctaccctgggacctgcccacaaaaccattttttcctattagacctctgggcctgtgatgggagaggctgctgcaaagatctctgacatgtcctggagataccttccccattgtcttggagattaacattcagctccttgtcacttatgcaaatacctgcagccagcttgaatttctcctctgaaaatgggattttattttctatcccattgtcatggtgcaaagtttgtgaacttttatgctctgcttcccttttaaaactgaattcctttaacaacaccaaaatcacctcttgaatgctttatcacttagaaatttcttccaaatcacctcttgaatgctttaccacttagaaatttcttccaaatcacctcttgaatgctttaccacttagaaatttcttccaccagataccctaaatcatctctctcaagttcaaagttccacaaatctctagggcaggggcaaaatgccgccagtctctttgataaaacataacaagagttacctttgcttcagttcccaacaagttcctcatctccatctgagaccacctcagccttgatttcactgtccatatcattatcagtatttttgtcaaagccattcaagtgtctaggaagttccaaactttcccacattttcctatgttcttctgagccctccaaagttgcttccacatttgggtatcttttcagcagcaccctactctactggtaccaatttactgtattagtccattttcacactattaataaaaacatacctgatactgggaagaaaaagaggtttaattggacttacacttccacatggctggggaggcttcacaatcataatgggaggtgaaagcccattacatggtggtgacaatagaaaatgaggaagatgcagaagtggaaacccctgataaacccatcagatctcgtgagacttattcactaccatgagaacagtatgggggaaaccgccccatgattcaaattatctcccactgggtcctttccacaacatgtgggaattatgggagtacaattcaagatgagatttgggtggggacacagagccaaaccatatcagcttctaatccttttctgtccatctttctcatctgtaaaatggacaaataggatatgccacatatgttatattagcaagaaataaagtatttagcatagtgctggcaatatagtgggttttaagcatatgtgagtttcttttctcaaattcagattcatagctcatatacccaggaaaccccgacagcatttcacatgtcctacctctacaactaccctaaatgaagacctggagtagtgagggatgaccaagaagaaacttacaggctttgacaaagaacctgagttttatcctgaggccaatataaagttgaaagagtttaaactttaaatgctgagggattttaacacattcctctaaccaataggcagtatgacacaattaatacaatggtacctggttttaatttcctatcaattgtctgcactttaaatctttcttacagagtcaattgagagttagttaaatataaatatactatacatcagaaaggtaaaccaatagagatatttatgtagtaatatttaaatgtgccaaaggcagtgatatccttaaaacaagatcacttttagctgccctgctttgcacagatattgcagaatcttcaaaatagaaaaaggtattatgtatgaataggagtcatttgaattggaaaatagaaacttaaatcatcttgtccatcacactgtcaaggtagatttcctttaacatgctctatgacttaagatataaaagtgtaaaagaaaaagaaaagcttaaaatttctgaatattatcactttacttttttagggaataagccttaatatgtatctaatttgacattgttaatattttcatacttatataggcttgactttgattaaatcaagcaaactatcagtttgtctttagtgaatgaagtcttcttttatatatgtgtagcatataccttttgtttaattttctgtactttatttaatagtaatatatctggtacaataatcttaacaaaattgaagttttcagtaccgaatctagaaatgttggatgcctggtgagatgtgaataatttatatgtaaaaacaaaaactccaacctttattttccttttaagataactgaaataacaggttagttctaaagctcaattgttcattagaagttaaaactatgtacatgaaaagtaaccttaaaaagccagatgtttttcactctggtttgccttaattaagtcactgcctttagctactctccaataacagccaaaaaagacagtatgtaattgttttccagcatcagtcacaaaataattcacatatgattcagaaaacagccattatgtttatgttctatgattctgtattttcacacatataaagtttttataaaatattaaaatgatgctatttttaatgcttgggattttatctacaattttataaaaatttaatataaaaatgagtacaaaatatacatatggtatactgaaaaggattgaataccacatattcttgctaaccaatgcagtgaatgaaatcaattcatatctcagtagactcatgataatatctagcaagtggctatctaacacacaaattgccttgaaaagttctaccctttgcaaatgtcaacaatagagcaacatggaagaacgggttcttctcagatgtaatgaggcggtatggccaccagcagtgagtataattcttcaaaatcccaccctctgttagagttcatgttgtgacaccattttatttaaaagaagcaatatatcttcactgtcctccagatcttgacaaaatacatctcatggttaacaatagaccggaaagattatcatattatcacggctttgctcgtagagaacttttggagtctccatggctgatatgaagtaaccctatggagacaacaacaaagcctgagaagctcagccttgagccccaaacacttagcaggaattctgatacaaatttttgagtgattgtatgaatgagtgaactaatgtgttcctaagtgagagagatgaattacaaaacactacaagtaaatgaaacccctgtgaagaacattactgtcactgatatatgaaactcatttgcaaaaggggtttgggaacacagtaaatcacacttcgaaaagccagttctttcatgcatttcatggattgacaactgtaaaaagaagtagatggtgttgggtctttgtatttgaccactgctcttttcactctgcacagtttccttgggtgtctttttactcattttaatgtttttttcctgctacctttatatttaatattctcaaacttctatttttaatgcatatcatatactgggtgacagactctttaatataaatcagcctgctggacatatatacctggatgcttattcccacaaaagttcaaattctgcatttccaaagtggaatgtaccactcatatatatgaatcaagttcctctttgcctcaccgttttctagagactcagaccactccttccagtcttcgctgctgctgagcaaattctttttctttctttgctttgagcaactgttacaagaggaagtcatttatacggccttcaacaagagagttcagtgagactgaatcattggtccaacttattaccagacagcatctggcctgataacacatcctcatatagctctctgtcctctctactttattttccttttctctcttgtgctccacatgattgcatttttaaataaagtaagtagtagcacaggaagaatccaggctgaaacatcataaaaatttgctcctcttttggtggtatctgctgatgttatccacttttaccctgaaactgaagtaaaaattctaggagtcattcatgcctccttttcttcctcaatctgctagaaacatagtcgctaaatctagccatatttccttctaaagagcagatgcatcattcctctctatttttgccaacactgacttgcttcaggcactcatttttttcttattcaaaaaacctcctatctggttttcctaattccagtctcatttcttcatttttggctccacatctacaataaagtgattcgggtgcttcatctaaaatgcatatcttaaccctgattctcagcagctccaagctctttaacccatcacgccttcattatctgttctgagcttatgttttcaggcttatcaatcatgacttcccaccttaatttgtgtgtttccacaacaccaaacatggcaatattaaaaaatctctggctccttatctagagtgctttcctctttcctcttctggtaaactcccactttagaacaaagttcaggcattccttcttttataaagcatgcccacacattaccaggctgagaaaggtgactgtcttttgggcaacataaaatctcttatatatccactagaagagtgacccttgcttttgcttcgttttgttgtatcccatatcccagcatactcaatggatacgatattcattcaccaatttccctctatggcaggagttctcatcctatgagaaggctctacctctcccaaatacttgaacggtatttcagattctaacggaggaagaccaggtatagtggtacagtttctgattctgttatgcctgctttgtgctgggtttgggtatttttcctctcgtaaacccactccctgaaaataactacacaaatatatgctttacgaggagcagagtggaactgttttgtctttatatctcagtacctagacgataatctgaccatcagtagtagtaaaaggtcaatatatatttactgtgaataaatgaatgaatgaatgaatgaatactccaggaataaacctcaggcaaactgaggtcatttcttgctggggctgaatagtatggtactcttagaaatttgaattttgatttatatagtgccttagcgcacagaattctttgaggtgtaacaagtacatatacctggtaagtaggcagtcaaattggcaatgtctgtagaaaaggtgagaaggctggataataataatcaacaattatctgatagacttaaaggcactatctactgtaccaagcagtgtctgttgtatagctgaatgcctttgggaattaaaggccaaggaggttttctctctgacaggatgagctcagcatagatgactttgcactacgcagccatatagcactaaatgacttctgctctgtttattggtatctatccatcaatcacaggcattgttatggcaaccaaggaagtatttttatcatttgtaactccctcttttattataattatctgtgtatgtgttctccccccaatatactgtgagttccttaatgacagggactttatttatcttcacagcatagcaggagttaaaatattataaagtagaagaaaaaacaggtcagaatggaacagtagtgagatggaagctggaggaatatgatggaaccagatcagtaagtgtgttcaaggctaaacagaaatatcctgacaccttaggtaggttaaaattttagcagcctacattagtttgtataatcttcactgatgtaacaaatatatcaccaaattttagtagcctaacttaattattcattttagctcgcttagcagtctaatgctggtggttatattcaatgggactgagagaatagaggatcttaggaaacctccatcctttgatgccattcttggtggggggcttagagtcctcttcttccagaacgaaggtgaggggagaaagaatagatgacaaagtccaaagaatcatgtatcatatgttcgagtcgtaagtggcaataatttatttctcttcatacttcattggtgagaactaggtctatgttctacgttcttacacaagatattgacaaactttttccataaagagccaaatggtaaatattttaggctttgtgggtcatgcatttctgttacaactactcaactgtggttgtaacctgaaagcaaccacagataatatgtaaatgactcgatatggctatgttccagtagatgcaagagggatagaggagactgagcaaagtatcaatggctggcaactacttctaggggaagtagtttatattacggagcgggtatataagctcttctgttgcaaagctagtagaaaacttaacttttattctgaaggccataataagcatttgaaagactgccatctgtaaataccaaaagcagatattgaaaatatagatgcctgaggggactagaggatatgactcttatcagtgtcaccacagttttaaatatatgcaatagttttaacagagctgtcattaatcatgaacattatcatgaatgctattattccaaaatgaacaatctttttattgtttatagtaataaaatatgtaacctcaaatagtaacatctgaaaatgattcatttcaaattatatcatataggattatatttgtataagtaaaacaactatattcattttattgcaaaactgaaaatagtttcattttcctgaatgtttcatttcccaagtattaaaatagattttaaaacataaatattgatagctttcaattgtcaagtaaagcagacaatgcacaaaaatttgaaaaagacaggaatagaacattggaaacttttacagtgcagggaagtgaaactatatttcagttaaaaacttatgcaaaattaaaaagtcaaattggaatagaaataaatccaacatataacaaaagtctatgaattttgtatttgtactctgctcttaagtgtctttgtctctattttcttttattttagtgtattattctcatttattttttactggaataaaaataaagtagatactttaaaaaatgaaggtaggacatttggatttcttacgaaaagtgttattcttcttagaagattattcttgtaaatttattgggaatattgtcaaatatatatgaagatggctgattataacagttaacaaaattgaaataattcttgtgtccagacattgtgctaagtgcatggcttatacacaatatcatttattccttatatcagtcgtattattaccaatattattgtctccactttattggtaaggaaactgaagtacagagaggttaagtaattttcctaagattatgtcagtagtaagcaacacagctgaactttgaaacttggtgtgtctgacttttaaatcctctccacagaaatacaacagcttaactcaaacccacttccacaaaaccagcagttaagctctctagttcccatctgtgtaacacggcagaggcactctttctggagttgcagcatattaaccatgtgttgtaattaaatctctgtaacaaggagaaacaccttaaattacttttgggaatagcctttagattgtgaaatacatttgatagcaaaaatattagtcctggggcatggtccaaaagtttaaaaaataatattatgaaagttaattgttcttcatatgataaaagaaaataaattgagttgctagagagctaggggttaagggtttccggaataatgagttgagaacagattatagggagggcacagaagttagaataaggttgggactgaatccaagagcagatctttaagatttgaggtaagagtagtcaaggtatttctaagatcgaggatagctaatatatatttatatttacatctttgtttttttgtgctgttttctgaaatatctgacctcttctttgtgacccctccccaaccaaattttgtgttagttgctttttggaaaaattcaggaaaagggactacgttgacttttaggttgaggagaaacaaatgacaaacaacaagtacaataacaataactagaaatgataacatatatgctatgtatttggccccattctgaggatttaaaaaatatacatcaaatcatgcaatactctgtggtcagtattattgttatcatcaccatttatagatgaggaaactatgaagtcacataggaaataagtaatacaaccactattcaatgtatggttccagtgtcgttgttcttctttacagttctatatgatcgtttctaagctttagaatcagactgttaatgatatcaatatgtcactttactttaaaaatgtaagcagagactataacaaaaactatgcatttaatcttaaattcccttgtgaaatgggaaggacagaatttgcacatggaataaaggctcgattcattttgggaaattatgatttcacaaaactggtcactttattgctattatttaaagagtagccaaatacatgtatgtgtacaaacatttaaaatgaatgtttgcttaaaagtagggtttctagatagttaccacaaatgtataaaaacatgttatatgctttataacttactcccttttgaaaagcaaatcatgtccaatttagtgacattaatgatattttgagatgatatgtgggggtggataaaagtggaaaatgatctctggtgctttctatctttggtttctgtatcatttccttctattaaaatacttctgcctattatcacaacacattccttcaggaatagtaattatttaaaagaggatggcagggtaacataacatttagtcctgagtcattatccttatatggaaaaatttgagaatgtgtaataaagggtaagatggtgtttggatataaggtagctttaaaggtgtatgtaaatgctatgtttcttgtagttaattttttttaacaaagtattttttaaaattatccatattgatgcatagagatgtattttattcttttctctgacttataagtattactattccattttatttattacatttttaaacgtccatttctctgctttgcaatgttcctactatttctaataaggctattcagagagtcattagattacatgtgagtgcttctgtagggaagaaactagaggtagaataactgatttagctgttcttaatatcgtacctgtctactctgcctgaatgagaaatcaatctttcatattttaggcataagacataagcaaatatgtgataataaaatttttgtgcctgaggtatacgctacctaattattaagaacacaggtgaaacaaatgtaggtgactataaaatagagatagaaaatgctataagagttaatccaaagtttgtcatatacacagatataattagtatcaactttactgttggaaaaaaccttggtaaaatgattcaagcaaacataaaaccaaataacaatccccatcaccaaataaaaaccaaaataccaaactggtgaatcagtttctctgtcaatgctatgttaagaactattgctagattttcttatatcagcataaagctgactgcaaagaagaggtgaggaaatagatcatgctattctaaaaatttaaatattttgataaatttaaaaaatgtgtcactgagcatcaggcaagagatttataatttgtggtgatagtcaccttacttccttcatgtgagtaggacttttagcttctcaataacagaacctcagtgatataattaatataaaatagtaaggtaagactacattccctgtaataaaatcctgcatcacatgtcgtcttccaaggaccatctgtccagatgagccttgctgtaataatcaagtaaacggagccaccagacaaattagtggagagcttcaattctcatagtgtcatctgggggttatttaaatgttatttgactttttcactgtggttatacttgcactgatagtcaaagataatagtggataaaactactgatggcttagtatgatacaaatagtggcaccacctgtactagataagagtattatcactttaatttaaaaaattaagattatacttgaaacagtggtaacactaactttattcaaatataagttatgaattacatgcctttttaataaagtgtatgatgaaaaggggggtatgcataatgtatttctgctgtatgctggagtaagatgattgcctcaaggagaagcatgagtcatttttgatgtgtaagaccaactagctgctaatttttgtggaacacagttttacatgaaagaataactaatattcagctatggttatgcattcttgggttattgggtagacattttctcaaaaagaaaatgggtctggccgggcacggtggctcacgcctgtaaccccagcactttaggaggccgaagcggggggatcacgaggtcaggagatcaagaccatcctggctaacatggtgaaaccccgtctctactaaaaatatttaaaaaattagccgtttttttagttaatgggtgcagcacaccaacatgcacatgtatacatatgtaacaaacctgcacattgtgcacatgtaccctaaaacgaagaagaaggaagaaaggaagaaaggaagaaaggaagaagaagaagaaggaagaagaagaagaagaaggaagaagaagaggaaggagaggaaagaagaagaagaagaagaagaggaagaagaggaagaagaagaagaagaagaagaagaagaagaagaagaagaagaagaagaagaaagaagaaagaagaaagaagaaagaagaaagaagaagaaagaagaagaaagaagaagaaagaagaagaaaagaagaagaaaattagccgggtgcagtggcgggcgtctgtagtcccagctactcaggaggctgaggcaggagaatggcgtgaaccgagaaggcggagcttgcagtgagctgagatcgcgccgctgcactccagcctggctgactgagccagactccgtctccaaaaaaaaaaaaagaaaatgggtctgccactccaaagaaaacagctaacagcatttgttgccaatgttacaattcgaactttcaagcatatttcagaattttgggtaagtcatccaccatggtcagaatgacagctatacaatacttaaaaacttttctgatgagactggaggggatattaacaaatattatttttaaatattttataaagatatatgttgacatttggtagagctgaataactcaagagaccaatattttggcagcaaaaaattgtgcatgagtaaaagatccattcaaaatgcagatagagcaatgaatgttaatttaattgagtataaaatgcccattgattgggttttacattccactttttaactcacctttaacaatttattagttatcaagttttggcataatatcaaagaggggtactctaaattatttgaaaagtctattaaaactcttctatcttttcaaaatatgtatgtgttgggaggccagaatttctccaactacttcagcaaaataattacaggacagattgaatgcagaagcacatatgagaatccagctgtatttattaaagcaggtattaaatatgtttgctgatacatataacagcgccattcttatcattacttttatttgttttggaaaagtaaaactgtttttcataaaacatgctatgctatattattcatgttaacttatgagtttatcattttataagaattaataaaggaaataaggcagagtagagagcactagtaaacctatctccccacctagacaacaattgtactggcagaatatatatatatatatatatatatatatatatatatatatatacatatatatatatattttttttttttttttttttttttttgagacggaatctcactctgttgtccaggctggagtgcaatggtgtgatcttggctcactgcaccctctgcctcttgggttcaagcaattctcctgcctcagcctcccgagtagctgggactacaggtgtgtgcaaccaagccaggctaacttttgtatttttagtagagacggggtttcaccacattggccagactggtattgaactcctgacctcgtgatccaactgcctgggcctcccaaagtgctgggattacaggcatgagccaccacgtctggcctagaatatttttgatgtaactattttgaaatagtgaagtctattgaaggtttacaaccttccaggtgaaggcttctaaattaaattgtgattaattttggtcagtttcagctcttaaaacagtagcatgcacacacgtcccacttcttagtcatgtggcaggcagttgtgtgcatgtttctggtgtagtctgcacacagcttgtgacggccatggtggacagaaaggatcctcttcttcacatattagacatctgtgctttgatcactgattactgcttctgataatagagctgatgatcagtgaactagatggtggtcattgtcacacttcccccccattgttgttactccccaccaccttgaactatttttctcctcattgtttgtctcttttcacacttttggaagctagccattaaagattggaacattcaaaaataactgcatatatgaggaaaatttaaaaatggccatccatgcccaggaaagggtttataaaagaagacttgagaagtctttaagaaactccatgtaaaacaacaacctcagagctacatggatacatattaaaaccagacttttgaaaactaaagacgaagtgaaaatcttaaaagcagcaaaagaaaatgacttttcacatacaaggatcccaataaaattatagatttctcatcagtaattttacaggctagaagacaaaagtttaaaatattcaaaacactgaaagaaaacaactctgtaaaccaataattctatatttgacaaaacagtcctttcagaagttagatagagctgggtgtgatggctcacacctgtaattccagcactctgagaggccgaggcaggtgtatcacctgaggtcaggtgcttgagactagcctggccaacattgtgaaacaccatctctactaaaaatacaaaaattagccaagtgtggttgtgtgtgcctgtaatcccagctactcaggaggctgaggcagtggaatcacttgaacccaggaggcagaggttgcagtgagccaagatagtgccactgcactccagccttggcaacagagcaagattctgtctcaaaaaaaaaaaaaaaaaaaaaattaggtagaaattaagacattcccagataaacaaaagctaagaaagattgttaacactggaccttccttgctagaaatgctcaaggggaatcctgcagtgtgaaatgaaagaccatagacagtaactgtatgttgaatgaagaaataagagtaaattaataggcaattattaaagttaaatggcttataatgcactttttgttttataataatttctaataattgttttctaaataattaaacagattaatacattaaaattgttctaatagtgttataactttggtttataactttatattttgttttctaaataatttaaaagactaatgcatttcaaaaattactagttggggggggcacacaatgtataaagatgttatgtataaagatgtaattttgtgccatcaacaatcaaaaggagtgggaacagagctgttaaaggagtagagtttttcttgttataaactcaacttagagtgttaatgactttaggctgttaatcgcatggtaactacaaagaaaatagctatatacaaaataaaattagaaaaaattttaaatacttcactataaaagataaactaaacacaaaaagatggtaatgtaaaaaatgagagacaaaaactatcaagaataaggaacacatcacaaaatagcagaagtaaatagcttcttagcaattattttaattataaatgattgtactcttgaatcaaaaaacagaaacctgcagaatggataaaaacacttttttcaactatatcctctctaacaaagatttactttagatctaaaaccacaaatattaaatagattaaaactgaaaggatggaaaaaaataaatattatatgcaaatagtaaccaaaagagattaggggttgctagcttaatatcagacaaaatagactttaaattaaaaaatgttaaaaccaaagaaggacattatatgttaataaaagactcaatacagcaagaagatataacaacatatataaatgtaggagttcagtcagggtggtgggaaaaattgtaaaatagacacaaaccttcttggaaggccggaaggttttgcaaaagcctaaggatagggttatgggtgaaggcagcctaatcctcttaccctgagttaatagcttaaagtaggtacaaaggaatgtaagggagtttatctacatagcttgtttactcatgtggtcctaagaccaacctttgatcattcacagaactgatctctctgggagagggtgaccagattaattacccaaaggcgtgttaactcaaagcctttgtcattaaatctgtactgaataaatgcctgcagagccagctagtcagagtgtgcatgcggctgctacaactctgtgattggcacagccccctggcctactctttcactgaatatcagtgtctgagtacattattcatccattgtgcagcctaggtctgtgggtcagaccccagcaggtggtgcctcgtgtgaggaacgctgcaacggactggtgattgtgacggaacccttgaaaacgaaggtgaaaaggactgtgcagtcagtaagtcattggtgcctgcttgggatttccaagttcacagggattgttcaggctaggatttcatcatgggacaacagttatcagctcaacagaaacagtacataaaattattgaaacagctgcttaaagctggtgaagcctcagttttgcaggctcaattaagggacttaatgcaaactgttgtattccataaccaatggttttcagaagaaggtatgctaaacatagagctctgggaacaagtgtggagaaatcttaacatcatcagcagtgggtcccagtatcatctctaacactatgggctttggtgaggttggctctggtcccattatacacagaagagcctaaaaaggagaaggaggaagaactgttacctaccttaccacctccttgtccctcagacacgctatcaccaggccaaaataacaaagaggaaatggaggtttgcctgagtcccctcctctaataaattgggaaaaagacaagggataccctagttatgggaccctatcttaggcaagtggcattagaaggggagttcttagcctacctggtaatgcaagatcaacaaggcaatcaggtatataaacccatttattttaatgcttataaaaaaataagaaaaggcattagaggctggagccacgtggccaagtttgtgatgggtggaagaaaaagcttggtagtggggaagctcatgacaccccaggccgacaggggccgcggcagggggcagaagcaacacagacaaaaagcagcacctaggcaagtgcaacactgctgccgtctagctccgtgggcagcccatggcaaaatttcttgtgtttcttgtatacaagcgacatcccagagtataattctctgctaagatataagtaaaattgaagaatttaaaagacctctttctgataatggccactgttgttatttctcccttactcctaaaacgactccaaatcccatttaagtaaaacagtaactgctggagggagagaaattaaaaagagcccatgaattagttgaggagcaattaaaagccagccatatggaacaatcaaacagcccctggaattcgcccatttttgtcattcccaaaaagtctggtaaatgaaggttttgcatgacctacgtgctattaatgctaatttgcaacctatagggccccttcaacagggccttccctccaccgcagtgattcctcaagattggcctacaatctttattgactgcttctataccattccattagcagaacaggacagagaaagatttgcatttacaatactggctatcaataatgaaaagccaggttgctgatttcattaaaaagggtgtcctcaagggatgctaaacagtcctaccatgtgtcagtatcatgtaaatcaagctttgctctctagtagaaaagaattttctgattgcaaggttattcattttatggatgatgttttactagcagccccaacagagccagtactttcaaagttagatacctctgtcataaagaatacacagttaagagatttaatgattgcgcctgaaaaattacagatgtctcctccttggaaatatcttgggtacatactaacttcctggtcagtaagacctcaaaagcttaaattaaatactaaaaacttacgtaccttaaatgattatcagaatttactaggcgatattaactggctttggcccaccttgggcctacctactgataggttgcaaaatctcttttctatcttaaagggcaattgagccctggattctcccaggtatttaactcctgtggcaaaaaggaaaatcaaggaaacagaacagaccatttctcacaggcaacaagattgcatagacccagtctattcaattcaattgtttatttttcccactaaacactaccctacagggttaataggacagatggccccagtactatgctttctagaatgggttttttgctcacataccggaactaaaacactttccctataatcagtaaagtcatatattcaggcttcagacaatgcaatcagttgctaggttatgatcctgatatcatcaggattcctttaagtaaaaagcaatttgaagcagtattgccattatctatagatctgcaaatagccatctctgattacgcaggccatgtagaccttgcccttcctgctgataaaccccttcagttcttatctggtacttctgtgatgttacctacaaaaatagttcactcccccatacctaacgctttaacactgtttactgacggttctggtaaacatgggaaagtggccatttggtggagaccacataatttcctccattgttctgggtttactagcactcaaaaagctgaggttggggccttaatattggctttggagactttttccgctcagcccatcaatattgttagcgactctgcttactctgtttatttactgcagaaccttgagacagcgctaattaagtccactctaaagcacaccctgtgtgcacttttcctctgacttcaccaattgctaaatcaacgtacacatcctatttttattacacacattcgagcccacagctcactgcccggtttattggcttatggcaatgatcaaccagaccttcaggttgtgacgtcactgcttgaccaagccacccaatcacatcaattcttccaccaaaactggagaaacttacctaaacaatttcaacttacccagagactagctaaacaaagtatcctgcaatgcccagattgccagctcacaggcacatcccctctttcaacaggtgttaaccctagagggttctagtcctctaatcagttatggcaaacagatgttacacacatccctaaatttggaaacttagatatgtacatggatcaattgataccaacacttatctaattagtgcacatgctcttcctggagagtccacctgatatgtcattaaacatctcctttcaacttttgcatttatggggcagcccacaaaaattgaaactgataatggtccagcttatgccagctcacaatttcaacaattttgtcacacgtggaatatccaacattccataagcatctcaaataacccccaaggacaggccatagaacgtgcccactccatccttaaaaatatgctcaaaaaagggggagtatgagtaaggaccctgcaacactagtagcacaagccttatttacccttaatttttaaaatttagataaatttcaatcagcaatggaaaagcactttgctaaaacctctcaagacataaaacctgcacttttatggaaagatgtaaacaataatgaatggtgtggtacaaatgaattgctaacatgaaaaagaggatatgcttgttttcacaccccctcaggtcctctttgaattccagcacgatgcatcaaaccataccatggcatggctaggacccaacccagtaccagaaatgaagaaaaggaccctacaggacccgcatccccatgctgaaaaagacaactcaagaggctgaacaaatcctgctccagacacacacatcattcactccaggtaatgtgttacttgctatgctttattaacctttttaaaattctctcactctgcctgcatgtggtacctgctacacttaagcaccgacttccggcttctaacattgcaactgcttggccaagagagattatcatacccccagtggggttccttagtaacagcacacatggaactaaagtgccaagtaacactacaggtcactccttgattggaaaagaatgttgctaataatactcatgtttgtcttatgttatttactaattctaggattcaaagctggaatacgagcagtgaccagcatgcctgacaggcctgttgctacacacatctgtactcttcaatcaacaaagcctgatgcaaaataacagaaaagggggagatacaagagttcagtcagggtggtgggaaaaattgtaaaataaacacaaaccttattagaaggtcagtaggttttgtaaaagccttaggatagccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagcctcagggtagggttacggctgaagtcagcctaatcctcttaccttgagttaatagcttaaagtacatacaaaggaatgtaagggagtttatctaaatagcttgtttacccatgtggtcctaagaccaacttttgatcatcgtgggtgaatgattgctctctactcaggggtttggcaatgtggcaatgttaattaccctctagtggtgtttactggagacttttgtcatttaatctgcactaaataaacgtgaacttcaccagcttttgaggccgatgctgcagactctgacagcagagccccttagccacactgacaggcaaaatatctgtgtccctgtacatctttcatctgtcactgggtcagcttctgtgggacagacctggcatataaacacttagctgattacagattatcaaaatatatgaagcaaaaaagacagaatttaagggagaaatagacaattgtacaataatagtggagaattaaatagccactctcaataattaatagagcaacgatgtaaaagataagtaaggaaatagaggacttaacacaacaaaccaactagatctaacagacatacacagaacatactacacaacaacaacagcatacacattcttaaaagcatgtggaacattttccaggatagactatatgttaggccacaaattaaatctcaatagatggaaggacatatgtcatataaattatcttttctgatcacaatggtttccaggatagactatatgttaggccacaaattaaatctcaatagatggaaggacatatgtcatataaattatcttttctgatcacaatggttaaagttgaaaatcaaaaacagaagtaaaaccagaaaatttataaatttgtggaaactgaacaacattctgtttaacaaccaaaggatcaagaaataaattataatggaaagtagaaaatagagacaaataaaaatgaaaatacaacacacaccaaaatgtacgagatgcagtgaaagcagtggtaagggggaaattcatagccattaatgcttgtgttaaaaaataagaaagatctcaaattcaacaagttaactaaaacttaataagctaaaaaagaagaaagaacaatctaaacccaaagtagagatgacattgatgataacaaagttggttgtttgaaaaactcaacaaaattgacaaatctttagttagatggattaaggaaaataaaaagaagactcaattaactgaacttagttgatgatattgtaaataaaattgattttgtaattactttttcagattgctcatgcttagtgggtagaaatgcagtttacttttggttgacttaaccaaagcagtgaatgtcttctacaatagaaactactaaacattgctgaaagaaatagagacataaataaatggaatcacatctcatgtttatgaattggaaaaaagtgatatacagatttggtgcaatccccaacaaaatcccagtgatttttttttttcagaaataaaaaaataatccacttaaaattcctgtagaatctcaatgtactctgaacatacaaaacaatcttgaaaaataacaagactggtggtctcacacttactgtttcaaaacttaattacaatgctacctttgtaattaaaacctttttgtattggcataaagaccaacatattgactaatggagtagaatgagaagcccagaaataaacccttatgtatatgatttttgacaagggtgccacatacattcaatgggggaagaatggtctggtcttgtgaacatatggtgttggagaaactggatatccacatacaacagaatgacccaaatagttggacccttacctaacaccatatacaataattaactaaaaatggattaaaaagctgaaactttaaagcttttagtagaaaacatagggaaaaaggctcacaacatagaatttggcagttatttcttggatatggatatgacaccaaatgcacaggcaatgaaagaaaaaacagacattagacttcatgaaaactaaaaagaaattgtgcatcaaaatatattaacagagtataaagacaactcagaatggaagaaaagacttgcaaatcatatatctgataagggattaatattcagaatatatagagaactcctaagactaaacaacaaagaaacaatccaattcgaaaatggacaaaaaatcaaatagaaatgtctcaagagaagatatacaaacatccaatatatacatgaaaagatgctcaataacaataattagggaaatgcaaatcaaaactgtgaggctcaagtcatcccacagggcttctaaaggaaaagagggtccaaaaatccagatggctagagcttctctgggcttgcatgaggagcaacctcacattgattaagatgtgagcttttatgctgtcctgtgatcaaataacccacctcaccatgctatcttacttctgcgtttccaatttaccataatactcccaaaataaccccttttataaggggtcattttaattgtctgagttccctcttaataacagggaagaaacaaaattttaaccacttcttaccaatgcatgaatgactaatattgtctcaaatgtgttatctctttagttcacccaattcaaagccatgtttggagatttctgtatccagaagcagagtctgaaagaaatacgtctcccataatggaaactgaagaacaaggacaactttttgagagtgataatttggaaaaagaatgtattttagcactccacacaatataacacaggcatgcttgtcagcatgcttcatttttaaactaactctgatagaagatgttttctgattgtgactcattatttgttggatggtatattttatatagcacaaaaaagataccctttataagtaatggtccatcttaattgggatataacttaaaaattcaataaactgtaaaagagtgaagtagaacgtaggaatgtgaagcaaaaacaaagaaacgaaatatagtgcagccttcattagattatttcaattggaaatgatatcttttggtgtggttatttgaacaagttattagaaaaatcactactgctattttacctgcaattgttaatgtgatagtttttcactgccttggatggaatgaaagatctccagttatttatttctataacttctatgcagccagtaaaattcttgactggtacaggcatctgagagagagagagagagagagaagtagagataatttaaatgattttcttgaatatattattcttgcttcaaactggtcagggtatgcaactggatttggaggctgatttgatttattctacttatttatagtacagtaattcaaatattttcataaatatcaatccaaaaagtaataggatttttccatatcttggctattatgaataatgctgcaatgaacatgggcaaaattataaagaaattatgtttgtgtacatacaaacacaatgctattcaaccttataaaagaaggaaatcctgccatttgttacaacctggatgaaactgaaagatattatgctaagtgaaataagttagacacaaacatatgtgattatctcacttataggtagactctaacaaaatgaactcaaatacacagaaatagacaccaaatctgtggttataaagccaagcaaggtctgaggctgtgggtggggaaaaaatgtgcagatttaggtcaagagatacaaagcatcagatatttagaataaacaaatctacagacctaatgtgtaacatgaggattatagttaaaaatattgcattgtatttgggacttttggtgaatgaatagattttagctgctcttgctacacacagatgaaaaatgggtaactatatgtgataatggatgttaatttgcttcactatagttactattttactacccatatgtatctcataacatcatgtatctcataacatcatgtggcccataccttaaatatatacaataaaatttattttaaaaattagtaggaaagaatgtcaccttattcatcaaaagttactcatgcctatatatcttagtactgtatagattacatagtcactaatacttaaagaaaaaattacataattacagtaaattatcaatgaaaaatagaagaaaagctaatacactcatccttcccatcaaggcactacatttttccatctttggcctgtttcttgcagttttttctctcagacatcaattaccttgccttatctgcagatatcaaaacattaagaagaattgctcttctagggaccaaagctaacaaagtaatctataaagatttgtgatatattttacatgccttttgtgttctgcagcctgtcctccttaggaataagttggggaaaaatgataacaaaaagatactaagggtccaagaacaagaagagaagtacattgaagaacattcaatttggtgaacaaaaataacctaatcattacgagcatacaatattatactagtaattacatgtgtatctaaatgtatatttatgagaaaaagggaaagtaaaagtgaatacagctcagaatttaatagttagaaatgagcattcattcagatgctgtcctctgataagctcttaatattactaaaaatttcaagcttaggtgaaccaaattatgaccagagaaaccattaaacttacatactgaaaaatatattagttatcttaatttttgaattaaaattatacactatttgcatctcaagactttgtatcttattgaatatattataaataatagaataaggcctttgtcttgtttagaaatttcaggattaatatatttcactttttaaatcatagtttagaacctttgaaagtttgctataggctcaaatttactgcaaagactctcacctggtaatactctgtcaaacgtcaaaaatgactgaactagaaaataaaacaatatttcacacagtaagtttacaaacaagtcaagtagattccaaagaaactatttaatggaagcatttggcttttatatgctgcagttgggaaagtactgatttgtcattgttaaagtttctctagctttattaatgtttttaatttttagatttaattcttatttttactgcagttatatacttaatttaaaaataaagtttatgactatgtctcctgaaatattatagtttactattaaaaaaatgatcttataaaaatgcttttgattataatgatagtgaatgttcaaacttaaatctgacatagctcagcaatggcataaaagtatgtttacattgcagtacatatttttctctgttaagatccttattattcatagggataaaaaaaggggaaactgataatgtttaaattaatataaacacattaaagagccatgaaaaatggtctataaaggaaatgactctatgattactctattgagatacttctcagaattctataattcaatttcattcacacattatgaattaaaaatgcatattaatttattcaccttgggctttgaaaaatggcaagaaaaaatttcccagccattagcctttacatttgagtaaattcaaaatttcttcatttcttatgttttaatagactgaccactctctagttctatcacacattatctttttgcagtactgttcggaatagttatttagcttccaaataaattcccactttttttttcactttaaatatacaaacaaccttcttataaaaatgtgagcaaaggacatgaacagacacttttccaaagaagacagacacgtggccaaaaatcatgtaaaaaaacaaaagctcagccaggcacggtagctcatgcctgtaatcccagcactttgggaggccgaggcacgtggatcatgaggtcaagagatcaagaccatcctggccaacatggtgaaaccctgtctcaactaaaaatacaaaacttagctgggcatggtggtgcacacctgtagtcccagctactcgggaggctgtggcaagagaattgcttaaaccttggaggaggaggttgcagtgaaccgagatcgtaccactgccctccagcctggtgacagagcaagactccatgaaaaaaaaaaaaaaatgctcaacatcactaattaaatgcaaatcaaaaccacaatgagataccatctcacaccagtccaaatggctatttattaaaagtaaaaaaaataaaaaaaaaaataacagatgctggcaagattgtggagaaaaaggaatgcttatacaccattggtgggtgtgtaaattagtccagccatcgtggatggcaatgtagcaattcctcaaagccttaaagactgaaataccactcgacccagcaatcccatcactgggtacatacccaaaggaatataaatcattctataataaagaccatacacatatatgttcactgcaacactattcacaatagcaaagacatggaatcaaccaaaatacccagcaataatagattggataaagaaaatgtacatagacacaatggaatactacacagccatgaaaaagaacaaaaacatgtctattgcagggacatggatggagctggaggccattatccttaggaaactaatacagaaaaagaaaatcaaataccacatgttctcacttagaagtggaagctaaaggatgagaatagctggatacatagaggtgaacaacatgcactaggtctattgcctattggagggtagagggtggaagaagggagaggatgaggaaaagtaactaatatgtactaggcttaatacctcaatgatgaaataatctgtacaacaaacccccaggacaacagtttacctataaacctgcacatgttctcctgaacttaaaatagaagttaaaagaaaaaacatattttaaaaggtgaaaaaaaagagagagagagaaagggaactgagcatatgagtgaacaaaatgggaagactggactgaattttttttgtgtactttaagtgctggaaccacgttgaatttatcatttatataaaagtataatttaaaagctcaaagttaaaaatcaaaagaacaaattttctgtaaggctaaatttatccaatcttcatttatttcaaaggttcttgtttttataatggtgatagttgatagtagatactgtttttgatttttatttaatgtatttagttttttaaataaaaataatttattaaaattaataaagcatatattaacatttcattttgtaaaacataagtgaaacctgaactcaagtactgagccttaatactaaactctaaagcacatggtttttagatcatttctactgttgggaaaccttttttccttgaatttgtgtttataataatcaggttaattaggtttctgggacaggagtcttaaaagtaatagaagggaaacaaagatacacaattcatatgacaatttgtaatgtaaaatatatataatagattaaagacaagaaataattatctgcattagattataagaatggtaccattgcatggtatcttcatttaaaaaattgtagtcacgtgctgctgtgatttctcaaatatagttcttattattaatccaggacaaataactcctggttatttctaaacaatgtaaaatggcaatgtagtatgccaaatcatagcactaggaatataattcatggtactaagcattaataataaaaacaaaattctcgagctcgctggcaagatggctgaataggaacagctctggtgtgcagctcccatcaagatcaacgcagaaggcaggtggtttctgcatttccaaatgaggtacctagttcatctcattgggactggttggacagtgggtacagcccacagcaagccaaagcaggatggggtgtcagctcacccgggaagcacaagtggtcaggagatttccctcccctagccaagggaagccataagagactatatcgggaggaacggtgcactctggcttagatactgtgcttttcccacagtcttcacaaccggcagaccaggagactccctctggtgcctatgctaccagggccctgggtttcaagcacaaaactgggcagccttttggggaagccactgagctagctgcagaaggtttttttttttttcataccccagtggcacctggaatgccggcgagaaggaagcattcactcccctgcaaaggggcctgaaaccagggagtcaagtgctctggctcagcaggtcccaccccaacggagcccaacaagctaagatccagtggcctgaaattcttgctgccagcacagccatctgaggtcgacctaggatgctcgagcttggtggggggaggggcttcggccattactgaggcttgagtaggtggttttaccctcacagtgtaaacaaagccactggtaagttggaactgcgtggagcccactgcacctcagcaagggtgctgtggccagactgcatctctagattcctcctctctgggcagggcatctctgaacaaatggtatcagccccagtcagggacttatagataaaatccccatctccctgggacagagcaactaggggaaagggtggctgtgggggcagcttcagcaggcttaaatatccctgactgactactctaaagagagcagcaaatctcccagcacatcgtttgagctctgttaagggacagattgcctcctcaagtgggtccctgacacctgtgtatcctgactaggagacatctcccagtaggggctgacaggcatctcatataggcgagctctggctggcatctggctggttcccctctgggacgaagcttccagaggaaggaacagacagaaatctttgctgttctgcagcctctgctggtgataccaaggaaaacaggatctggagtggacctccagcaaactccagcagaccagtagcagagggaactgactgttagaaagaaaactaacaaacagaaagtaataacatcaacatcaacaaaaaggacgtccactcagagaccccatctgaaggtcaccaacatcaaaaaccaaagatagataaatccacgaagatggggagaaaccagtgcaaaaggctgaaaattccaaaaaccagaatgcctcttcttctccaaaggatcacaactccttgcagcaagggaacaaaactggatgaacaatgagtttgatgaattggaagaagtaggcttcagaaggtaggtaataacaaactcctctgagctaaaggagcatgtcctaacacaatgcaaggaagctaagaaccttaaaaacaggttaaacgaattgctaactagaataaccagtttagagaagaacataaatgacctgatggagctgaaaaacacagcaagaaaacttcatgaagcatacacaagttgcaacagccaaatcgatcaagcagaagaaaggatatcagagattgaagatcaactcaatgaaataaagcaagaagacaagattagagaaaaaagagtgaaaagaaatgaacaaagtctccaagaaatgtgggactatgtgaaaataccaaatctaggtttgattgttgtacctgaaaatgatggggagaatggaaccaaattggaaaacactctgcaggatattatccaggagaacttccccaacctaacaaggcggatcaacattcaaattcaggaaaaacagagaacaccacaaagatactcctcgagaagagcaaacccaagacacataattgtcagattcaccaaggttgaaaagaaggcaaaaatgttaagggcagccagagagaaaggtcgggttacccacaaaaggaagcccatcagactaatgatggatctcttggcagaagagggtggggaccaatattcaacattcttaaagaaaagaattttcagtcgagaatttcatatccagccaacctaagcttcataagtgaaggagaaataaaattcattacagacaagcaaatgctgagagattttgtcaccaccaagcttgccacacaagagctcctgaaggaagcactaaacatggaaaggaacaaccggtaccagccactgcaaaaacataccaaattgtgaagaccactgacgctatgaagaaactgcatcaactaatgggcaaaataaccagcaagaatcataatgacaggatcaaattcacacataacaacactaaccttaaatgtaaatgggctaaatgccccaattaaaagacacagactggcaatttggacaaagagtcaagacccttcgctgtgctgtattcaggagacccatttcatgtgcagagacacacacaggctcaaaataaagggatgtgggaagatttactaaacaaatggaaagcaaaaaaaaaaaaaaaaaaaaaaaagcaggggttgcaatcctagtttctgataaaacagacttcaaaccaacaaagatccaaagagacaaagaagggcattacataatggtaaagggattaatgcaacaggaagagctaactatcctaaatatatatgcaaccaatacaggagcacccagatttataaagcaagttcttagagacctacaaagagacttagactcccgcataataatagtgggagactttaacacgccactgtcaatattagatgaatgagacagaaaattaataagcaccacatcacacttattctaaaattgaccatataattggaagtaaaacactcctcagcaaatgcaaaagaaaaaaatgataacacacagtctctcaaaccatggtgcaatcaaattacaagtcaggattaagaaacacactcaaaactgcacaactaaaggaaactgtacaacttgctcctgagtgactgggtaaataacaaaattaaggcacaaataaagatgttctttgaaaccaatgagaacaaagacacaacagaatctctgggacacatttaaagcagtgtgtagagggaaatttatagcaataaatgcccacaggagaaagtaggaaagatctaaaattgacagcctaatatcacaattaaaagaactagagaagcaagagcaaacacgttcaaaagctagcagaagacaagaaataactaagatcagagcagaactgaaggagatataaacatgaaaaacccttcaaaaaaatcaatgaattcaggagctggttttttgaaaagatcaacaaactagatacaccaccagccagactgataaagaagaaaagagagaagaatcaaatagacacaataaaaaatgataaaggggatatcaccaccgatttcacagaaatacaaactaccattagagaatactataaacacctctacacaaataaactagaaaatctagaagaaatgaataaatttctggacacatacacactcctaagaataaacaaggaagatgtcaaatccctgaataataacttctgaaattgaggcagtaattaatagcctaccaaccaaaaacgtccaggatcagatggattcacagccaaattctaccagaggtacaaagaggagctggtatcattccttctgaaactattgcaaacaatggaaaaaaagggaaacctccctaactcattttatgaggacagtatcatcctgataccaaaacctggcagagacacatacacaaaaagaacatttcaggccaatatcccttatgaacgtcgatgagaaaatcctcaataaaatgctggcaaaccgaatccagccacacatcaaaaagcttttctaccacgatcaagtcagcttcatccctgggatgcaagcctggttcaacatatgcaaatcaataagtgtaatccacaaagaggagctggtaccattccttctgaaactattccaaacaatggataaaaagggaaacctccctacctcattttatgaggacagcatcatcctgatacgaaaacctggcagagacacatacacaaaaagaacatttcaggccaatatccctatgaacatcgatgagaaaaccctcaataaaatgctggcaaactgaatccagccacacatcaaaaagcttatctaccacgatcaagtcggcttcatccctgggatacaaggctggttcaacatatgcaaatcaataagtgtaatccatcacataaacagaaccaatgacaaaaaccacatgattatctcaatagatgcagaaaatgccttcaaaaatattcaacaacccttcatgctaaaaactctcaataaactaggtactgatggaaagtatctcaaaataataagagcaattaatgacaaacttacagccaatatcatactgaatgggcaaaaactggaaacatttcctttgagaaccggcacaagacaaggatgccctctctcaccacacctattcaatatagtattggaagttctggccagggcaatgaggcaagataaagaaatacagggtattcaattaggaaaagagggagtcaaattgtctctgtttgcagatgatgtgattgagtattaccaaaccccatcgtctcagcccaaaatctccagaagctgataaacaacttcagcaaagtctcaggatgcaatatcaatgtgcaaaaatcacaagtattcctatacactaataacagacaaatagccaaatcatgactgaactcccattcacagttgctacaaagagaataaaatacctaggaatacaacttacaagggacgtgaaggacctcttcaaggtgaactaccaaacacggctcaaggaaataagagaggacacaaacaaatggaaaaacattccatgctcaaggataggaagaatcagtattctaaaatggccatactgcccaaagtaatttatagattcaattctatccccatcaagctaccattgattttcttcacagaattggaaaaaaactactttaaatttcatatcaaaccaaaaaagatcccacatagcctagacaatcctaagcaaaaagaacaaaactggaggcatcatgctacatgacttcaaactatactacaaggctacagtaacacaaacagcatggtactggtcccaaaacagatatatagaccaatggaacagaacagagacctcagaaataccaccacacatctacaaccatctgatctttgacaaacctgataaaaacaagcaatggggaaaggattccatatttaataaatggttttgggaaaactggctgcccatatgcaggaaggtgaaactggatcccctccttacaccttatataaaaattaactcaagatggattaaagacttaaatgtaagatctaaaaccaagaaactgtagaagaaaatctaggcaataccattcaggacataggcatggcaaagacttcattactaaaacaccaaaagcaatggcaacagaagccaaaatagacaaatgacatctaattaaagagcttctgcacagaaaaagaaactatcatcagaatgggagaaaaatttttaaaatctatccatctgacaaagggctaaaattcagaatctacaaagaacttaaatttacaagaaaaaaaaaaaacatcaaaaagtaggcacaggatatgaacagacaattctccaaagaagacatttatgcagccaccaaacagatgaaaaaaagctcattttcactggtcattagagaaatgcaaatcaaaatcacaatgagatactgtctcatgtcagttagaactatgatcattaaacgtcaggaaacaacagatgctggagaggatgtgaaaaaatagaaacgcttttacactgttggtgggagtgtacattagttcaaccattgtggaagacagtgtggcaattcctcaaggatctagaactagatataccatttgacccagcaatccctttactgggtatgtaaccaagggattataaataattctactataaacacacatgcaaacgtatgtttattgtggcactgttcacaatagcaaagacttggaaccaacccaaatgcccatgaatgatagactggataaagaaaatgtggcacatataaaccatggaatactatgcagccatgaaaaacatgaattcatggcttttgtagggacatggatgaagctggaaactatcattctcagcaaactgacacaagaacagaaaaccaaacactgtatgtcctcactcataagtgggagttgaacaatgagaacacatggatacagagaggggaatatcacacaccagggcttgtcagggggtgggggcctcggggaggaatagcattgggagaaatatctaaagttgatggcgggttgatgggtggagaaaagcaccatggcatgtgtatacctatgtaacaaatctgcttgttctgtacattactccagaacttagatcataataaaaaaacacccagaattctcccttttttcatttcaaacatgttgtcttacatttctaaatatatcttcaatatgttaccttttattctacctccatattagtattacaatatttaattctctctctggcatttgatggctttagctctcattcctttaaagaaagttgaagtcagtggattatccatactgtataagcagtttccatattaataatcagtagtagttacacaaagtttagacagagggcattcgatgtgataatatagactgctgtatacaatattccagatttacaactcaacaattttaaatacaaacacatcacaattttttaaaatcatgtatctaatcatttgatgctatgaaaatacatgaaagtatgagaagttttcatgtttttatcctcttgacatattagacacaattacttgaagaatatctaaattattggttaacctggtattaaggaacaatttttttggagttgaaatgccttttccaaacaaatttttatttttatttatttattttaaaacttattttaaaatctatttttgtatgtgtgtgattttttatttaaaaaattattatttattttatagatatatagtaggtatagatatttgtggggtatatgagatattttgatacagacttacaatgtgtaatgatcacgttagggtaaatggggtatccagcacctcaagcaatcattatttctttgttctatgagcgttccaattttactccttcagttaatctaaaagatacaaccaattattgctgacttatagtcaccctgttatactatcaaatactagatcttattcattgtatctaattatatttttgtgcgtattaacctttctttttacttttgaatcagtaaagtcctttctctttatattgttattgccacttctgttttttaatggtagtctttgctgtctactgtaactgatttagcccaatttaagtgactttttagattagtgtactttgaaaaccaataaagttggtttggaatcaattaagaaatagtcaattggtattacaaaaacaacttcaatagtttcatctttattgtagatttattatttatttgtttttgaaatctatctttttagctacctatcttactaataattaggtaaaagttttagaaatgtaaaaaaaatgagattcttaaatctagcaataccaattgattaaatcaatggttttcatcctgtattatctgaggaacctacgttttctgaaagaacttcgtttagcaggaggagaacaactgtgaatagggcttctgctcccatgttactaaggaacaattttacttgtacatgctctcgatattggatttctgcatcagatttttttaaaacaaagcttctattgaaaaactatatattaaattaggctaaaccttttatgagagaaaaatttctgaagatatgtgtgtgcatgtgtgtgtgtatgtgtgtgtgtctgtgtgtaaatacaggcaatctcagatggatggatggatggatggacggatggatggatggatagacagatagatagacagacagacaggaagacagacatttccccttaaattacagagaatattccagttaagctgccacaagacctttcttccctgctgctgctgctgttgtgatgtattcttttctcagttttcctcatcattgtgcctcatccccacctggcactcttaatttgccttgcagttccaagttattacttggtatcattttcctgacacctgaagagcttcctttaacacatcttataatatagttctaattaaagcacattcccttaggttattttttggcctaaaaatgtcattaattcatactattttgagtgacattttttgttggatttggaattctgtgttgaagggtttttttgttttttaaagtcagcacttaaaagatattgttccattgtcttctgctttgcattgtttgagatgagaagtcagtgataaattttttattaggttttattaagattattagatatattgtttgatatttttcttcaaatctggacaattttgttattatttcttcaaacagttattctgttcttatttatctctccatcttttggaactccagttacttgaaatttttatctgtttaggtcattgagtctatgggttgttgaatctctgctcattttttccccaccattttatatctttctttcagcatagtttctactcctgtcaagtttaatggtcttttattctgcagtgtgtaatatattgttaaacaaacatagttgaggtattatatttttatctttagatgttctacttgtttcactttattagttgactttttgttatttctatactagattcttattttttagtttccatttttctcctatttttcttcagtccttagacaaattgataatgacaattttaaagtcttttacgttgatcatataatctctatgatttctttccttactggttttctttgagtcatttttatcctattggccacagtttcccacaaattttttccatatttaatcatgtttattgaattttggacattgtattattactttattttgtattcttccagatttttccctgtattccaattatttatgtaaataagatattgtagtagcaattactcattcatggccagaaaacctatatgctttttaaaaaataaattctacttggcttgtaacataaaataaatatgctatttttaaacgaaaaattccacatggcttataataatggaatgaacagtttccagtaccaaacccttactattaccctgattccctactcaaaaaaattttcatactatttcataaatttattctgttattgactttcaagtttctaagtaatatgttcatattgttgtgtattaccttttaaatttaacacatttttacttggcttagcgtttatgcttcaatgattgcccaactttacagatataaatccctctttttgttattcaaatactatgaacacttattaattttaatcttttaaacatttacagtctctccactatcatgtttaaaatttactttattgctctcctatggtgaatctactctaaactgaattctatatgttactcaggcttagtttattcatttattgatatattcattgataatataatcaaatttcattagtaccagcttcaaaatgactggagtatttgaaagctaataaataatataaggctgatgtaatttagtcctatacttttttagccacaagctaaaagtcgaaagaatgtgagtgatattatggtgagtaaattaatgactttaataaattacacgtgggccataaaggagaaaacagaaaaataaagaagtaggatattccatgctatgaatatttattaaatgcctactaagtatttattagtttctcataaatcattccaaggcttgggaacttggaaaataatagatcaagaaaaagagagaaattggtaggaagtgctgattctaaggccatatggatgaacttggatgttaatgtagtgtttctgatgtttagttgttatatagactaagaaaaaattggatggtaattatttgttgtctataaggccaactatcacatgttagtctataaatatcttaaatgtgggactttagcaacttagtgacaaaacaactatataaatataggaatactttagttcacaaaatttggtgatacttaaatcaattttattttactttgatctattcaccaagtcatatgcactttgtaatatttatgtggttcaagtggacatagtctacatgtagaagtaaactagaaagtgggttaagtcaaattccccatacaaatataaaatttatacatggatttaacaactatttactaagcacatactcggtagtaagcacagggtcaccatatatggttatgcaaattgttcattgacaaagaaagtctagctgataaagtggagtagagcctgaaaattaatcgacattttttccccaagctgtctgctcagaaaaggtgtgctttaaaaaatctgtaaacctagagggtttactttttctaattcaaacaaaatcaccatatagcatatgtggggctaggtgttggtgcaatatcatgttagtagaaacccagataaagttcagtttaaggaaatagactgatagatttctgtttctgataacagcacagtaacttgttggagaccaagtctcttattaatatgactagatataattcatataaaattatatttacaggctatagggaactaccacggaagcaaggacttgaggggccaatatctcagagagaaggaaagtacaaagtgttgatcttgacatttcctcttatattttgaatttacaagtggcagatgaaatttgcagaagctgaataggaacttctataagttttgtggttgaggtgaagtattgaaactcaggggcaaataatcattttctctggaggattggaatgacaaaattacaggacaacatttgaagctatgtttctaaagttttcaggtcagcaaggtttcaaagcagccgaaagtttattccatggatatttgcatcagtgtttttgttggttattatttcttcactgcagaaactggcaaagaatgtctctggacaatggaaccagaaaagcctgagcacaattttgtctgtttctctccagtttactctctcagcaagaacagacatgctcttttccacagtacaatctctacagcacctaccccatcctcagacattcacacacataatttcaatgcagctatctgtatactaatttcccatgatttctttattgtttaacagctttattgaggtaaacttcacatatcatatataatttatctatttaaaaatacaattcagggttttaatatgttcacagagttattcaaccattactacaattaattttagaataatttgtcaccccaaaaagaaacaccttacctgttagtagtttgtctctattatttcttcaatgctagggaattactaatattacattctatcctcatagatttacctattgtggatatgttacacatcctatgtgattggcttctttaatttagtataattttcttaacatttctctatgttgtaacatgtatcagtatttcaccccttttaattgccgaataacattccattgcatggatatatcatattttatctatacatcgcttgattcgcctttgggttgtttccatttttggctagtgtgaatactcctgctatgatgtttcatgtacagatttgtgtgtggacatatttgcatttattttgagaattatgagtcatccaataaattttctttatacatttgtgtgatatatttgggttcatgtttcccgactatactgaaatataactacttcagtataaattttgaggagggagctagtagctaggggctaattcttcacactgattttgggaaatcaatacatcaaaactacctttaattgaaaacatcctaaatgtccatctacaagatcttacccaaataaaatgctgtacaactacatgctgtgaattggagtagaaatatgtccataatggacatatggagtgtgcagtagatgccgtggtatccatccagatctccctctaggagtaaaggattttcatcctcctttcactattggaagtgatgctggcaagttgactttacatttgaacattctttgggaagtactttagcccaagaatgtgggatcatctaagtttactcccattttctgggggaagtttacattcaacaatgggtcaaaaagggacaataacagcctgaacccatcaccctaacttttgacagctcttaatggtcagtccagctacaaacttgacatgggattgttcagagcctttgggactcctccctaactcattctagcaaaccagcatcagcctaataccaaaatctggcaaagacacgacaaagaatggaaacttcaggccaatatccctgatgaacatagaagcaagaattcttaacaaaatactaacaaactgaatccagtagcagatcaaaaagttaattcaccatgatgaggtaggctttatttttgggatgcaaagttggttcaacatatgcaaatcaataaatgtgattcactgcataaacagaattaaaagcaaaaatcaaataatcattgtgacagatgcataaaaaagtttctcataaaagccaacatgccttcatggtaaaaaccttcaacgaactaggcattgaagaaacatacctcagaatatgagccatttatgacaattccatagccaacaatatactgaatgggcaaaagctttccccttgagaacttaaaaagacaaggatgcccctcacatcaccccattcaatagtactggaagttccagccacagtaatcaggcaacagaaataaattaaatgcatccaaaataggaaaataagtcaaacgatctttcttcaatgtgatgggactgtatatttagaaaaccataaagactctgccaaaaggctactggacctgatacataattttagcaagatttcaggatacaaaatcaatgtataaaaatcggtatatttctatgtatcaataacatccaggctgagagtcaaatcaagaatgtaatcttgtttacagtaaccacaaagaaaatgaaatacctaggaatacagctaaccaaataggtgaaagaccacacaaagagaactacaaaacactgccgaaagaaatcagagatgacacaaatgaatggaaaaatgttccatgctcatgggttggaggaattaatatcactgaaattgcccaaagaaacttaaagatttgatgttattcctatcgaactaccaaagtcattcttcacagcattagaaaaaagctattctaaaagaacaaaccaggaatcccaagaagacccacagaccctctgaaggaagtggagtgctcctgcaggaccctggagatatctcaaatactgtgctggtatccacagctgagagaccacagatggttaatatcacaggactctgtgcagacaaccccctggagccgggtaggcttgctgtgtagctagatccagaagagagataacaatcattgcatcttggctcacagaaagccacattcataggaaaagggggagagaactgcatcaagggaacaccctgtgggacaaaagaatcggaacaacagcctttagccctagacctttcctctgacagagcctacccaaatgaaaaggaactagataaccaactctggtaatatgataaaacaaggctctttaacacctcccaaaaagtctcactagttcaccagaaatagttccaacctaagaagaaatctctgatttacctgaaaaagaattcaggaggtaagttattaagctaatcagggaggcaccagagaaaggtgaagcccagtgcaaggaaatccaaaaaacaatacaagaagtgaagggagaaatattcagggaaatagatagcataaaggaaaaacaaaccttcaggaaacactggacacacttacaaaaatgcaaaattctctggaaagtctcagcaatataattgaacaagtagaataaagaaattcagagcttgaagacaaggtttttgaactaaatctaaaaaagacaaagaaaaaaataagaaaacatgaaaagtctccaaaaagtctgggattatattaaatgaacaaacctaagaataattggtattcctaaggaagaagagaaatctaaaagtttggaaaacatatttgggggaataattaaggaaaacttccctggccttgttagagacctagacatccaaatacaagaagcacaaggaacacctgggaaattcatcataaaaagctcattgcctaggcatattgtcatcatgaagaaggaattaatgaaataaactataacctaatagtagtagtaatagaaatttaaaacttaaagtttctgcaaagtgtgacccccttcccccacttacactcaagttaaaagagaatattaacagcctgtcttctctctgtggtcagtggacctcatctatactcctcaactccacattcctcaaagtttattacaggcccagcgtaataaactgcttacctccctagcatgcctgcagggtcacaagaccaataagtttaggtcgcaagacatgtttctctcaagatgtaagaaatgttgtaatgctgcctttgtttcttccttctgtaacttgcttcccatctcacatagttgctgctttaagatgtttaaaagtaggaaaagccttttgtttggggctcagactttctggacaaatgtctggctgagccagttatcaccttaatttgataaactctcctgaaccttttttggtctctccagtctttgattgtcctgtaccatttctgggggcccatctgggattggagatggcagattttctgtctcctttacctgtggactacagctccaggatgtgggagacttggggtccttggcactgccaggagagtttcagcctggaaggagaatggccctcctgcattctggagccttcccccaacagcacaaatggaaccagtagaaagggttgcaggatggtcacgggagcatgtgcagacatctgaaccacagtaaggtttgggccctaaggcaagacccatcccataaagacagaaggggagcttgatcacatcccagggcatgatgactagtccaacccgagggggttgggaacactgggagaggcccactgactcggacaaaattcacaccctaactgacaccagatgtggatggggcccacgagtcagaaaggaaaaccgtttcagggacggaggaggtgtgtgaaagtgtgtggaagagagtctcgggagagaccatcatggggcgtgatgtggggaggcacggatctcttagtgtggactatgtgctctgaggtgaatgtgggaaaaaccagatctaggacactgtatacagcccataggaccagctccacagctgcagctagctgtgacaggaattaaggcatgctcctggctaagcagtgtttgaacctcccataataggacccagtctggtggatccaagagtgaaagtgagagtgaaagcacctcgcaagggaggaaatgggaggaaaagtatcaaagcctactccactggggtgcatgctgaaaaattttaagaaaggttttaatgatattgggttatgctaactccacagaaactgaggaccctttgtgagatagaccggccatcttttaatgtagggtagctggctgaagggacaatagacagggaaataatgggccaagtgttccgggtagtcaccggggttggagaacagcctgggcacccagatcagtttccatatattgactcctggctaagtataattcaaaaccaccctaagtggctgcaggcctgctttgagacctactgtaagactctaatggcccagataaaaccaggaaccatagaaagagattgcaaggcatcagtaaaagaaaaggattcacaggaaaagcagaaaaaacccgtcctacaggccccacctgaagagttagaaagtccagccctctatgcaccaatttatccatccctggcaaggcttagacaggaagctgccccagctgcccccagaggttcagattcagaagaaagcacccctcaggcaacaccatgcagagaggagccagagcccttgcctgaaaagtgaagggaggaactccagggggatgaggtcagccgccttaggtcaggccatgcccaagcaatgcagatccccctccaagaaacatgggaacaaatttatttgaatgcacagaatgaagtccaagggggagaatggctcttaatttatcagcccttctctactactgatctcttaaattggagacaacatactccctcttatacagggaaacctcaagctcttatagatctaatgcagtccatttcctaattcacaatcctacctgggctgattgcaaacaacttcttcagtcattatttaatacagaagagcaccatagagttatacaagctgccttccagtggctggagaacaatgcacctgcaggtacaggatatatcaggcagtatgcacaacaagcactcccaatagaggctgacacaggctgggaccctaaccaggctcaagggctacaaagcttgcagtggtatcgagaggcactcctaaatggaataaaggctggagggaagaaggccaccaatattggaaaagtctcagaggtctgccagaagccagatgaaagtcccagtgaattttatgagaggctgtgcgaggcttaccagctttacacaccatttgacccagaggctgcgggtaatcagtgtatggttaatgtggcatttgtaagccaggcacaaggagacataaagcgaaagcttcagaagttagaaggttttgaaggcacctaaataacccaggttatctatgtggctactaatgtatttgtaaattgggatgaggaggccaagagagaagccagacacagagctaaggaaaaggcagacttgctggtggcagccttagttggaaaagaaactggttttgtgagaagatgtggttgtggtcatggtcgtggtagaggacaagctaggtaaaactaggtagctaagccaggacaagagctgacctaggcctgagagagatcaatgtgtgagatgcaagcagatgggacactgaagaatgaatgcccacaaagagaaaaggataaaggcaacaatcagggacaaaatggctggccagaaccccctactgctggtcaagggattcagaaatcagacatggatttaatcggactggcaggaatcaattattattatgaggactgagacagaccaggctccatttcattaggccccgaggagcctatggtctcaatggaggtaggaggctggaaaaaggactttatggtccatactggtgtggagcactcggtagtaaatcaagcaatttggctattgtctaaaaattatgtcaatataattggagctacaggaataacagaaaagaggccttatttcaaatctaaaatatgtgtccaacatgaatttttatatttgccaaattgtctggtgcccttgttaggaagagatttgctccagaaattgcaagcacaaatctcctttacactagaaggggacatgactctaaacctaggtcaaagaaaagccatcataatgacgcttactgtcccaacaacagaggaatggagactctatgagagatgcaaaatttgtaaagatgcattttgccagtgggaaaatgaggcaatgtataaggaattatttctcaagctgccaggggtcttggtggaagacaatcccccggggctagccataaatcaggcacccgtagtggtggaactgctgtggggcacttacccagtgtgaatctgtcacaatcccattccagcagaagccacccatgggattactaagcatatagaccagttccttaaatttgggataatagaaagatgtgcctcttcttggaacactccattgctaccggtgttaaagccccccggagattaccagccggtacaggatttatgggcagtaaataaggttgcagctacattatatgccattgtgtccaacccatatacaatgcttgggcgaattcctgctgatggtgcttggtttacatgcttatacataaaggatgcattcttctgcatccaactagctcctgaaagcatctttgcctttgagtggggcttatcacagtatacttggaccagactccaccaaggattgaaaaactccccaaccattttcaaggaagcactagcccagacctgaaggctttcatgccaccaagtgaccgccgtgtcctgttgcagtatatagatgatttattgttagctgcacccacaaaagaagagtgctttcaaggcacagaaagcttccttcgtgttctgtgggaggctggctataaggtgtctaaggaaaaggcacaaatctgtggccaaagagcaaggtatcttggctttaacatctctcaagggcagcgtgagctcggacatgagtgaaaagagactgtgtgtggcattcctcaacctggcactggacaacaagtgtgggagtttttaggggcagctggtttgtctcacatttggattccaaattacacactcggcaaaaccattgtatgagactaccaaagggaggggggaaagaacccctcctgtggggaaaagagcaggacacggccttcaaagaaatcaagaaggccttgatccaggtcccagcattggaactgccagacatgacaaggcctttttacctgtatgtccatgaaagaaaaggaatagctacaggagtcttggtacaaaaactagggtcatgatatcagcccatggcatatttgttcaagtgactagacttggtggctatgggatggcattggcagccactgccctgttagcgcaagatgctaacaagctcacatttggacaaaggttaataatttgcgtgccccacatggtcatcaccctgttggagcagagggggtatcgcttgctttctaaccctaggatgttaagatatcaaggacttttttgtgaaaacccctatataaccttagagactgtgaataatctaaatccagccacactgctgccaatacagtgggtggagcatggaaagcccccattgtgtggcccagggtatcactgttgtgtggaaacagtggatgaggttttctcaagctaaaaagacttaaaggaccagcccttaaaataccaagatgttgaatactttactgatgaaagcagcttcatatctgaaggtgtcagatgggctggatatgcagtggtaacactgaattcagtagctgaagcctgccctctgctggtcggaacttcggcccaaagagctgagctaatagctctcactagaacgttgctcttggccaaaggaaagtcagtaagcatctatactgactcaaggtatgtttttgccatttgcatgcccatggagccatatacaaggaaagaggattattaactactgaaggaaaggaaatcaaaaatgaaaaggaaatagagcagctcttagaagccatatgggctccaaaagaagtagcagtcatctattgcaaagggcatcaaacaggagggcgtgacgaggctagaggaaacagaaaggcgacagagaagccaaaagagctgcaatgacagaggtaactaagaaggaagaggaaacccttaccatgcccttactggagcttcccctaacagaacccactaactactcctctaatgaaaaggcatttgagcaggacagtggaagttaccagaaaggaggttggtggaagttctcagatgggaggctcgccttccaatagcccccccgcccgcccagttcataaaagtttcatcaaggaatgcatatgggaaaaactgcattagagactcttgtaggacagcatttctatgtgctgcacctaactgccatcgctcaagccatttgtgagcaatgtttaacttgtgcccaaaacaatccatggcaggggccaacatggcccccagggattcaagaaactggagctacaccgtgtgaaaacctgcttgtggactttaccaagctgcctcaagccagaggctactggtacatgctagtgtttgccttcactttctcagggtgggttgaggcatttcccaccaggacagagaaagctcaggaagtaaccaagatcttactaaaggacattatttctagattttgactgactctaacattaggatcagacagtggcccagtgtttgtggtagagatagtacaacagctaacgcagatgttaaaaatcaaatggaaactgcatacagcttatcacctacagggttctggaagagttgaaagaatgaactggacactcaaacagctgttaaagaagttttgtcaagaaactcatctaaggtgagatcaggtgctgcccgtggtccttctccatgtcaggtgcacccctactaaattaaccgggtattcaccctgtgagatagtgttcggctgaccaccctcaatcataattcagataaaaggggatttaaaataaattggggaattaaccttaagaaggcaaatgcaagccttaagtgagaccatgtagtaaatacaagggtgggtaaggaaaagaatacctgttagtctcacagatgcagtatatcccttccaacctggagactctgtctgggtcaaatgatggaacccaaccaccttagggcctttatcggatggtccccatattgtgatcttgtctacctcactgctgttgaagttgcaggtatcacaccttgggttcatcatagccagctaaaaccagcagtgaccacaactcaggaccagtggaccagtcaataaaacccagaccacctgacacggctgatcctgtggtgagaccaagccactactgacaagggcaactgccctgctccatccacactggaggctggtcggtccacgcacagctgaagcttaaggaaacatcaagccctgctctagtcacacaactggaagctgactagtctacacatggccgaagcctaaggaaatcaatgatagataagtaaatgtggattgaatttacaagcatagttatactcttacttgtactgattattttactgtcatgttgtctttgcaaatgttgccaagcttgttgcccagaagggtgcttatgcatagtatgagtttaatcatattagtaatactaaagccatttatactttcacctatggttataaaaggggactaggatgactgtcatcactgtatagtagaagcctggtccagaaaaggtgtgactaaaactctgttataccagacctactatgagtatacagagactcatacaggaacttgtgtctataaccagactagttactcagtctgtgatcctggaaacaggcagcccaagaatgttatgaccagagttcttgccttatgacttctggtttgaagtccaaattggtgaacccctaatgctatcatatacaaaccccacagaaactggggtcggcaaacttgtaaacaaaatggaagtattcccttactcaaataaagggcctatctccatatattttgattgctgccaagctgcacatcccagtaaactaaataatattgggaccatctgtaaaactctaggacaagaaaaagtcagcagcagagccaccaaggccgtaatagaagagtccaaaaaagagtgccctgattgttaaaatcagtggaccatgatgaatttaatcagcaactatacacaggaagggttgctctgtttgccagccaagaagtgaagatagggtgcacaactggaacatgcaacccactcaatctgacagtactaaagccaaatatgcctttctggactaaaatggataagggctactaacctttgatcaggcaggagctctcctaggacttggtattcctctggtcatcacgaagaaaacccaaaggacccaagtttaagttaccccaatgcaacagtttaggttttataaatctttcaaggaacactttaatcctgaagtatcaaaaattcaaattcctcctatatcagttgaaaatgtgtttacccagctagccaaaagtattgctaacaatttcggagttacttcatgttatgtatgtggaggtactaatctgggaggtcaatggccctgggaagccaaagaattgatgccgcaagacaattttaccttgcccgaatttgctacaaaattcagtgcaaatccaagtgtttagctattaaggaaccccatcatcggaaaatactgtatcgcctgacaaggcctttcagaaccaggtaggggaaacaacttgcctaggtcaacaatattttgaagaatccaagaacataacacaatgaagaagctttatagacaattcctctgtgtcagactgtaatccttttttgctgttcccaacattaaatcaatcatagtaccaattagatgctccaactgtttggagagcacctgcagggttatattggatctgtggaacaaaggcttatcaattactacctgataaatggacaggggcatgtgtattaggaaaaataaggccatcctttttcctactcccactgcagcaaggggaagatctaagctatccgggctatgatgaaggtggaaaaagaatcagaagaaatgtgtttacaaaaataagtactgtggaaaaaataaatactaacattaaaaaggacattgaaatagggagctggaaagataatgaatggccccctgaaagaattatcaaatactatggactggccagctgggcacaagatgggtcatgaggatgctgtactcttatttatatgttaaaccacatcataaggttgcaagcagttctggagattatagtcagtgaaacagcccgagccttagacttgctagccatacaggcaacccagaggagagatgttatttatcagaacaggttagcactggattatcttttagcttcagaaggaagagtttgtggaaagcttaattcaatgaattgctgcttacaaattgatgacaatggaaaagctgtcatggaaatcactgccaggaagcagaagttagctcatgttccagtccagatgtggtctggctggaacccaagttcactctttggaggatggttttcatggtttggaggctttaaaactttaataataggctttgtggccataataggtgtatgcctaatggttccctgtctcctgacacttctcatcagaagcatctaatccaccatagaagcaatagtagacagacatatcaccacccgaataatggttctgcaaaagtaccaactggtatcccaagatgagtatgtacccactcaagaagaaatagctaactgtagtgctctttactaatctacatttgtgtcgagcacaaaggggggaataaagaaggaattaatgaaatcaactataacctactagtagtagtaacagaaattttaaaatcctcataaagttgctgcaaagtgtgactccccccaccccccctcccgacttacactcaagttaaaagagaatattaacagcctatcttctctctgcggtcagtagaccttatctatactccccaactccacattcctcaaagtttattacaggcccagcgagtttctgcttacctccctagcgtgcctgcagggtcacaagactgaaaagttttggttgcaagacatatttctctcaagatgtaaagaaatgttgtaatgctgcctttgtttcttgcttctgtaactcgcttcctgtctcacgtagttcccaccttaagatgtttaaaagtaggaaaagccctttgtttggggctcagactttctggacgtatgtccggctgagccagttatcacttcaatttaataaattctcccgaacctttttcagtctctccagtctttgattgtcccgcaacaatcaggttatccaaagttaagacaaaggaaagaatcttaagagctgtgagacaaaagcaccaggtgacctataaaggaaaacctatcagattaacagcagatttctcagcagaaactctacaacctagagtagattgaggccctatcttcagtttcctcaaacaaaatgattatcagccaataatttttgtatccagcaaaactaagtatcatgtatgaagaaacaatacagtatttttcagacaaacaaatgaggagacaattcatcactaccaagccaccactacaagaactgctaaaatgagctctatgtcttgaaacaaatcctggaaacacatcaaaatagaaattctttaaagcataaatcacacatgacgtataaaatgagaatacaagtgaaacagaaaaaaaataggtacacaggcaacaaatagcaggatgaatgcaaaggtacctcacatctcaatactaacattgaatgtaaatggcctaaatgttccacttaaaagatgcagaactgcagaagggatagaactcaccaaacaactacctgctgccttcaggagactcacctaacacaaaaagactcacataaacttaaaggtgtaggaaaaggaatttcatgcaaatagacgccaaaagccagcagagtagctattcttataacagagaaaacaaacttcaaagaaacagcagttaaaagacacaaagagggacattatataaagggccttgtccaacaggaaaatgtcacaatccttaacatacatgcaccgaacactggagctcccaaatttataaaacaattactaataggtctaagaaaagagatagacagcaacacaataattgtgggggacttaaatactccactgacagccctagacaggtcatcaagacagaaagtcaacaaagaaacaatggatttaaattataccttagaacaaatggacttaatagatatatacagaacattttattcaacaagcgcagaatacacattctattcaacagcgcatggaactttctccaaggtagaccatatgataggtcataaaatgagcctcaacaaatttaagaaaattgaaattatatgaagcactctctcagatcacagtggaataaaactggaaatgaactctgaaaggaacttttgaaactatgcaaatacatggaaattaaataacctgcttctgaatgaacactgggtcaaaaacgaagacaagatggaaatttaaaaattcttcaaactgaacgacaatgacgacacaacctaccaaaacctctgcaatacagcaaaggcagtgctaagaggaaagttcatagccctaaacacctacatcaaaaaggctgaaagagcacaaactgacattctaaggtcacacctcaaggaactaaagaaacaagaacaaaccaaatccaaagccagcagaagaaaggatgtaacaaagatcagggcagaactaaatgaaattgaaacaacaacaacaaaaatacaaaagataaatgaaacaaaaagctggttctttgaaaagataaatacaattaatagaccattagcaagattaaccaagaaaagtagagagaaacttcaaataacctcattaagaaaagaaatgggagatactacaacagacaccactgaaatacaaaagatcattcaaggctactatgaacacctttatgcacataaactagaaaacctagaagagatgaataaattcctggaaaaatacaatgctcctagcttaaatcaggaagaattacataccctgaacagaccaataagaaacagtgagattgaggtggtaattaaaaaattaccaacaaaaaaattccaggacaagatggattcagagcagaatcctaccagatattcaaagaagcattggtaacaatccttttaacattattccacaagatagagaaagagggaaccctccctaattcattccatgaagccagcatcatcttaatcccaaaaccaggaaaggacataaccaaaaaagaaaactacagaccaatatccctgacgaatacagatactaaaatccttaacaaaatactagccaactgaatccaacatcatatcaaaaagataatccaccatgatcaagtgggtttcataccagggatgcaggggtggtttaacatacacaagtcaataaatgtgatacaccatatacatggaattaaaaagaaacatcacatgatcatctcaatagatgcagagaaagtatttggcaaaattcagtattgctttatgattaaaactatcagcaaaatcagcatacaagggacacaccttagtgtaataaaagccatttatgacaaacccacagtcaacataatactggatggggaaaagttgaaaacattctctctgagaactggaacaagacaaggatacccactctcacctctcctcttcaacatagtactgaaagttttaggcagagcagtcagacaagagaaggaaataaagggcatccaaataggtaaagaggaagtcaaactgtcactgtttgctgacaatatgattgtttacctcgaaaaccctaaagactcctccagaaagctcctagaactgatgaagaattcagcaaagtttctggatacaagattagtttacacaaatcagtagctctgttgtacaccaacagcgaccaagcaaagaatcaaatcaagaagtctaccccttttacaacagctgcagaaagaaaaaaaaaacttaggaatatacctaaccaaggaggtgaaaaacctcctcaaggaaaactacaaaacactactgaaagaaatcgtagacaacacaaacaaatggaaatgcatcctaagctcatggatgggtagagtagaatcaatatttggaaaatgaccatactgctaaaggcaatctacaaattcaatgcaatccccatcaaaataccaccatcacttaacataatttgaaaaaacaattctaaaattcatatggaaccaaaaaagagcccacatagccaaagcaagactgaggaaaaataacaactctggaagcatcatgctacctgatttcaaactatactataaggccatactcactgaaacagcatggtactagtatcaacataggcacatagaccaatggaacagaatagacaacccagaaataaactcaaatacttacagccaactgatcttcaacaaagcaaacaaaaacataaagcagggaaaggacaccctttttaacaaatggtgctgagataattggctagccacatataggagaatgaaactggatcctcatctcccacattatacaaaaaatcagctcaagatggattaaggacttaaatctaagacctgaaactataaaaattctagaagataacattggaaaaacccttctagacattggcttaggcaagaatttcatgaccaagtacccaaaagcaaatgcaataaaaacaaagataaataattgggacttaattaaactaaagagcttttgcaagaggaacagtcagcagagtaaacagacaacccacagagtgggagaaaatcttcacaatgtatatatctgacaaaggactaatatccagaatctacaatgaactcaaacatatcagtaagaaaaaaaaagcaatcccatcaaaagtgggttaaggacataaatagacaattctcaaaataagatatataaatggccaacaaacatgaaaaaatgctcaacatcactaatgatcagggtaatgcaaattaaaaccacactgtgttatcaccttactcctgcaagtatggtcataataaaaaaattcaaaaaacagtggatgttggagtgatgtgatgatcagggaacacttctacacactgctggtgggaatgtaaactagtacagccactgtggaaaacagtgtggagattctttaaagaacgaaaagtagaactaccatttgatccggcaatcccactactgggtatctgcccagaggaaaagaagtcattatacaaaagatatacttgcacacgcgtgtttactgcagcacaattggatggaatactactcagccataaaaaggaatgaattatggcatttgcagcgacctggatgagattggagactattattttaagtgaagtaactcaggaatggaaaaccaaacatatgttctcactgataagtgggagctaaactgtgaggacacaaaggcataggaatgatacagtggactttggggacctggcgagaagggaaggaggtgggcaaggaatacacgactacaagttggattcagtgaatacttctcgggttgtaggtccaccaaaatctcacaaatcaccactaaagaacttactcatctcatcaaatatcacttgtaccccaataatctatgaaaaaaaatgtttaaattagcatacaaataaaaacgtatgcacatttaacaatttaaataggttttgcctatttttcagccctgtagaagtatatgaaagagccctatcctctgaaagtttagaagtaaaaaagtgtgtgtgtgtaaaaaaaaaaagaaagaaagaaaaagagtattctaaaattcatacagaatcaaaaaagaagccaaatagccaaatcaattctaagcaaaaaaatgaagccagaggcatcacactacctgacttcaaactgtattgtgaggctatagtaaacaaaatagcatgacactagtacaaaaacagacacaaagaccaatggaaaagaatagaaaactcatgaataaagcttcacacctacaaccaactgatttttaacaagaccaacaaaaatgagcaatggagaaagatgtccatattcaataaatggtgctgggataactggctagccatgtgcagaagaatggaactggacccttacctttcactgtatacaacaattaagtcaaaatggattaaagatttaaatataagacctgaaactacaagaatcctagaagaaaaccgtaaatatccttctggacatcaaccttggcaaagaatttatggccaagtccccaaaagcaattgcaacaaaaccaaaaactgataagtgaggcctaattatactaaagagcttctgcatgacaaacaaaatgataaacaaagtaaatagcctacagaatgggagaaaatatttacaaactatacatctgacaatggtctaatatccagaatctatcaataacttaaagaaatcaacaagcaataatcaaataacaccattaaaatgtgggcaaaagacataaacagacacttctcaaaagaagacataaatggccaacaaacatctgaaaaaatgctcattgtcactaatcatcagagaaacgcaaatccaaaccacaacgagataccagctcacaccattcagaatgccaattataaaaaatcgaaaacaacacatgctggcaagactgcagagaaaagggaatgcttataaactgttggtgggaatggttcaaccaccccaccccaaagaagtttggagatttctcagagaacttagagctaccattcaacccagcaatcccattactggccatatatccaaaggaatatagtcattataccaaaaagacacattgaatcatatgttcattgtcacaatagcaaagacattaaatcaatatgagtgcccattaatggtggattggataaataaaatgctgtacatatagaccatggaatattacatggccataaaaaagaatgaaatcatgtcctttgcagcagcatggatatggctggaggccataagcctaaatgaattaatgctagaacccaaagccaaatactcatgttctcacttataagtgggaggtaagtattgagcaaccatggacataaatatgagaacaacaggcgctatggactactagagggaggaggatgagaggagtacatgggtggaaaaactacccattgggtactatgctcactagctggctcccctacacccatgtaacaatcctaattctcacatttaccccctctttattgtaactaaaagctgaaattttttaaaaaatgactgcatgtcatcccaactactcccactatccaatcctacttccttcctttcctttatctttcatagatggtgtttccaaagcattctctaaccacttgcccattaatctctatgtcagtgtctcctttccatagaactcaatctgcaacagaatggtcaccatgatacactcataactaagaaaagcaaaatgaataaaagaataccgaatgtgatattatttaataatggaggaacatatgtgcttgcatgtgtttttgatatttaacaacaaataagtaaaccataaaatatggttacttataagaggaggagggaaatgggtggaggtcacaatagaaactagatttcttaaaacagatctttagatatggatttgcatttaaaaccatgtaaaaatattgtatatagtataattatagcatagttatagaatgaaataaaatttaaaatgtaaaaatcagaagtaaaataaatgatcctgtgtcattcattggtggtacaaaaacgcataaaatgtctattccaatgttttaaaaatatagtaatttgggcacacatctctagtgggttcttaaggacagaaagaaccacccaaaaatgttaagggcagccggagagaaaggtcgggttacccacaaagggaagcccatcagactaacagctgatctctccacagaaactctacaagccagaagagagtgggggccaatactcaacattcttaaagaaaagaattttcaacctagaatttcatatccagacaaactaagcttcataagtgaaggagaaataaaatactttacaaacaagcaaatgctgagagattttgtcaccaccagtcctgccctaaaagagctcctgaaggaagcactaaacatggaaaggaacaaccggtaccagccactgcagaaacatgccaaattgtaaagaccataaaggctaggaagaaactgcatcaactaacgagcaaaataagcagctaacatcataatgacaggatcaaattcacacataacaatactaaccttaaatgtaaatgggataaatgctccaattaaaaggcaaattggataaagagtcaaaacccatcagtgtgctgtattcaggaaacccatctcacgtgcagagacacacatagactcaaaataaagggatggaggaagatctaccaagcaaatggaaaacaaaaaaaggcaggggttgcaatcctagtcttggataaaacagactttaaaccaacaaacatcaaaagagacaaagaaggccattacataatggtaaagggatcaattcaacaagaagaactaactatcctaaatatatatgcacccaatacaggagcacccagattcataaagcaagtacttagttacctacaaagagacttagactcccacacaataataatgggagactttaacaccccactgtcaacattagacagataaatgagacagaaagttaacaacaatacccaggaattgaactcagctctgcaccaagcggacctaatagacatctacagaactctccaccccaaatcaacagaatatacattttttttcagcaccacaccacacctattccaaaattgaccacatagttggaagtaaagctctcctcagcaaatgtaaaagaacagaaattataacaaactgtctctcagaccacagtgcaatcaaactagaactcaggattaagaaactcactcaaaactgctcaactacatggaaactgaacaacctgctcctgaatgactactggatacataatgaaatgaaggcagaaataaagatgttctttgaaaccaacgagaacaaagacacaacataccagaatctctgggacacattcaaagcagtgtgtagagggaaatttataccactaaatgcccacaagagaaagcaagaaagatctaaaatggacaccctaccatcacaattaaaagaactggagaagcaagagcaaacacattcaaaagctagcagaaggcaagaagtaactaagatcgagcagaactgaaggaaatagagacataaaaaacccttcaaaaaatcagtgaatccagcagctggttttttgaaaagatcaacaaaattgatagactgctagccagactaataaagaagaaaagagagaagaatcaaatagacgcaataaaaaatgataaaggggatatcaccactgatcccacagaaatacaaactacatcagagaatactataaacacctctactcaaataaactagaaaatctagaagaaatggataaattcctggacacatacacactcccaagactaaaccaggaagaagttgaatctctgaatagaccaataacaggctctgaaattgaggcaataattaatagcttaccaaccaaaaaaaagtccaggacaagatggattcacagccgaattctaccagaggtataaggaggagctggtagcattccttctgaaactattccaatcaatagaaaaagagggaatcctccctaactcatttcatgaggccagcatcatcctgataccaaagcctggcagagacacaaccaaaaaagaggattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgaaaatcaataaacgtaatccagcatataaacagaaccaaagacaaaaaccacatgattatctcaatagatgcagaaaaggcctttgacaaaattcaacaactcttcatgctaaaaactctcaatattgatgggatgtatctcaaaataataagagctatctatgacaaacccacagccaatatcatactgaatggacaaaaactggaaacattctttttgaaaactggcacaagacggggatgccctctctcaccactcctattcaacatagtgttggaagttctggccagggcaatcaggcaggagaaggaaacaaagggcattcaattaggaaaagaggaagtcaaattgtccctatttgcagatgacatgattttatatctagaaaaccccatggtctcagcccaaaatctctttaagctgataagcaacttcagcaaaatctcagcatacaaaatcaatgtgcaaaaatcacaagcactcctatacaccaataacagacaaacagagagccaaatcatgagtgaactcccattcataattgcttcaaagagaataaaatacctaggaatccaacttacaaggtatgtgaaggacctcttcaaggagaactacaaaccgctgctcaatgaaatcaaagaggatacaaacaaatggaagaacattccatgctcatgggtaggaagactcaatatcgtgaaaatggccatactgcccaaagtaatttatagattcaatgccatccccatcaagctaccaatgactttcttcacagaattggaaaaaaactactttaaagttcatatggaaccaaaaaagagcccacattgccaagtcaatgctaagccaaaagaacaaagccagaggcatcatgctacctgacttcaaactatactatgaggctacagtaaccaaaacagcatggtactggtaccaaaacagagatgtagaccaatggaacagaacagagccctcagaaataatgctgcatatctacaactatctgatctttgacaaacctcacaaaaacaagcaatgggaaaaggattccctatttaataaatggtgctgggaaaactggctagccatatgtagaaagctgaaactggatcccttccttacaccttatacaaaaattaattcaagatggattaaagacttaaaggttagacctaaaaccataaaaaccctagaagaaaacctaggcaatatcattcaggacataggcatgggcaaggacttcatgtctaaaacaccaaaagcaatggcaacaaaagccaaaagtgacaaatgggatctaattaaactaaagagcttctgcacagcaacagaaactaccatcagagtgaacaggcaacctacagaatgggagaaaattttcgcaacctacttctctgacaaagggctaatatccagaatctacaacaaactcaaacaaatttacaagaaaaaaataaaaaaccctatcaaaaagtgggcgaaggatatgaacagacacttctcaaaagaagacatttatgcagccaaaaaacacatgaaaaaatgctcatcatcactggccatcagagaaatgcaaatcaaaaccatgatgagataccatctcacaccggttagaatggtgatcattaaaaagtcaggaaacaacaggtgctggagaggatgtggagaaataggaacacttgtacactgttggtgggactgtaaactagttcaaccattgtggaagtcagtgtggtggttcctcagggatctagaactagaaacaccatttgacccagccatcccattactgggtatctacccaaaggattataaatcatgctgctataaagacacatgcatacgtatgtttattgtggcactattcacaatagcaaagacttggaaccaacccaaatatccaacaatgatagactggattaagaaaatgtgtcacatacacaccatggaatactatgcagccataaaaaatgatgagttcatgtcctttgtagggacatggatgaagctggaaaccatcattctcagcaaactatcacaaggacaaaaaaccaaacaccacatgttctcactcttaagtgggaattgaacaatgagaacacatgggtacaggaaggggaacatcacacaccagggattgttgtggggtggggggagtggggagggatagcattaggagatatacctaatgctaaatgactagttaatgggtgcagtacaccaacatggcacatgtatacatatgtaacaaacctgcacgttgggcgcatgtaccctaaaacttaaagtataataataataaaattaaacaaaacaaaacaaaaaaacattttcagtcaatagatgtgggtagtaatgatgcagttactctagtggagacttccgttgattgtaagaaacatgaaatatgtaattataatattgtcattggcatatttggaaggaaattaatgaaaaaacctacacttctaaattttgattatatgtatcactataagctcttgatgtagtttattataaaaccaacaaaaacttttctagctttgactactaaaaatgcttaaaataatgacaatgcagtagcaagaagcagatctagattccatttataatctttaaaaactacttcacatcacattcttggagaaatatctaatcattcatgtggggacaaaaaagaaactggaaactctacagtatgaaggcactagtttcttcaaaaaaatttttgctcaaataataaaacagaggaagaacctatagatcaaatgatatttcagaagtatattaattaattacaatatatctacctgatttggtttaatttatttggtttgatttaaacaaactcttttaaaaacaaggttatgacagccaaaattgtgaaactaactagatatatgatattaagaaattattattaatccttaggctaatgcaattgaggttatacattttgaggacttcttagcttatagaaatgtgtatagaatatttacagataaaatgttctgatctttgaggtatgtttccaaaaatctgaagatggagggtgtagtatacatatgatgtattagatgaaataaatttggctgcatttttatatttgttgaagctggcagatggctatagtgggtttgtcatactactctatctacttatgcatatgtttgaagatacgcaaagaaaaaaaaactcttactataggcactccaacatgatttccactggtgtttactttgcttctttcttggcatcatgacatcccaagcagttctcaagctccagcacattggtttaaaatgccctagtttttcaaaatctccatttctccttatattttaaatgtgtttatttgtcttttccttatctacccctttcctaatacctggaaactcactcaactgtgtcgtgctatcttctttatagcacttctccttcactctcaccttgtaaactttcggcctcaacacaaaaaaattcaccttatttctgggtagaattttactctcaacctctactcactgatgaagatacacatttttgtattaaagataaagatacacatttttgtattaaagataaatcttttaacattttgttaaacgagatcttgtgtttatattttaatatttaaaattttttcttcccacatctataaccactagagtagcccaacaagacaattctggcttgctaaaagaactgattgagaaattattttaatactaatagcaataattttaaacataccaactaataactattgagcactattatgcacttctcatttgtttctcatgataaatttattatgtagattattgattctgtttactattttctatttattgtttactgtttatactactggtattctgagaagaccatgcttttctctagcatcatatttacatatgtaaggtcttcaagcaaagagataatgttggattttttttccatatcattcctgtttggaagaaagcattatgcaagctgagctcagttcttttctttctcccatggaagccactcccatggaagtaactttcagatatgtgttgaggaactctctctgaaattgccaaacactgtgcctggctgagttgaatgtttcattctgtggtaaagtattcggaagcccactagttgaagatctaaatccacaactctaactgagcaattatcaataacaaaactgacaaaagtattttcatttctctgatgccttgcaaatgttcttcagctggttctaaacttgtttgggaaaggacggatctttcaaatctttgcagttcctttatattttagaaaatgaggtattttttcaaagtcacaaacctaagacatgacatggcagcactagactcaatttcaggctattgacagcagacatcatgctctcccttacttccctatactgagaatctttacagtcttatttaccatccttttaccaataatgacatttggcattattgagttgtttgaatattacaagtgatgcttattgaaggttccttacatcctgtagttttacccagtgcttttattaggactttgaatattattatggatcatcacataaccataatgtttcaacgtggagactgaatacagtattccatgtcttgtttgcttttgatcttaaaattatataaaaatgacattaaaattagaacaaaatcttttcatcaacatcagcaaattattggaatatacgctcagttttggtataagaataactgcattgtagtattacaagaaaactttgaaaagcaatgtataatattactatcaactaaataataaaatgtgtaagcaatgtcattatcttgctatccgtattgtttaattacatataaattaatttatatgtaatacaaatgacatataatatgtattttagagatataagctctgagtaaactcttatttatttaagaggtgctaattgtatcaactcctatatgattttatcatgaacttattatttattgaaagtagcaccttatgaaaactaaaccataaattaagatgcaaaaaataaaataatacttgttttcagcctgaacaattaggaaaatgccagctaaaataaaaatttagtctgtgatattgttcaatactaggtaagagttaatgattctataaaataaatagaatcttctatttgatacaaagtgcatatttttatttaagttgaaaattctcctttgattattaaaaataaaggaatgttatttaaagtgtttttagttttgtttttcaatttaaaaatctcaaagcaaagaaactcctcaagaaaacttaaactgtctgcaatttgttaatgccctattgatagttgaatgatttctaaaataattattcaataacaatatttattgctagagcataatataagaaaaggtagatcttgtctttgccttgaactacaagagtaaaatatgtagtttttttcccgttttgaaatatctacttgaagaagtcagcaataaaaataaatggaattttaagtcaaatgcttcagatttttatttctatttatttatttttttgctaatgatagttcactaaatagaaaatgtgtttagaaataaaggagattctagtgtgttgacactagtaaccaacttgtcttccaggattcttgtaactctagattctgtattaggtgtgtcagaaaataagtcattttggcaattttacagaagtgtctctactcagagtctaataatgataacattttttgtcatacataatattcttcagatcatcgtattacttcagatccacatctataatgttggaatatagattgaacaattttagaaaaataaatatgttttagaatattttagataaatctgaaaaaaaggtaaagactttaagaatgatagtaactatgacaagcccttgcttaaaaaaagtttattttacctaattccgaatgttaaaattaatgaattgattcacaaacatttctctatattccagagtttacagtaattccttgttaacccactatccagttattgcaaataattttgatagcattttcccagactttgaaaacataaggagagagccagttgtatggatctgggcataagaggctgatctcaaccccactctcctctggcatgtcacacatctgcctacactatccctctcaagtctctcgttatctgttttggaagtgacaaggaaatagttgaaaggagaaataagtctctaagaaggattcagcgtaaagctctggaattattctgggaagatacttacatcctcaaatgccacatttgtctgtatacaagttaattcggtgtgttgaaacccagtgatatgatttggctctgtgtccccatgcaagtctcatcttgaattgtaatccaaattgtaattcccaacgtgttgtgggagggacctcgtgggaggtgattagttcatggggccctgtcccccatgctgttcttgtaatggtgaatgagttctcacggtatctgatggttttataaggggcttttcccaacttcacttggcacttgtctcctgctgccatgtgtagaaggatgtgtttgcttcgccttccaacatgattgtaagtttcctgaggcctacccagccatgtgaaactatgagtcaatgaaacctcttttttttttttttaataaattacccagcctcaggtatttcttcatagtagcgtgagaatggattaatacatccaggaaattcagttttccacacaataataaattgagtgaagattgagatactggtataacaatctactcgaattttaagttaactaagaagaagaatactgaacttagtattctgtgattcttttagtcttatttcagtctatgcaagttttatttttgtctatttaaatgtagcaaacatggaaagaattattctgacagaggtcggctaaaccaagtagtattcagagattctagaatttctgtctcccttgaattacatagttacattatgcctctatctatctatgcatccatctatctatctatcaatcatctatctacttgtatcatatttgtatttatatctatctacagatacaacatatagttgtaaatatgactatccgcctatagatagatagcttccatttatcatctatcacaatcatttaagaagagacccgagagcagaataatttctagtaaattgaaagtatttatatacaaagacaaaaaattaatatttgcttcagtggactacaaggtcatttaaaacaaataggaagaaagtctataaataattcatcaggtgattgaggatttctaggggaacaaaagccctgatattttccttctgaaaagcagtcattaaaggtgttatttttattaccacactctattaaaatgggcatatatatgacatatggtgatacaaataataccatgtatgtataatgccatgcttagttgtaattatgtgtatacatagttatcaaatcttttgattatttactatatcagggaacgaaataatacattcctgtgagctaaaatgtaggagccccattttcaagatattccttaatatgaatttttaaacttcagtcattcacaaactgccttgtaattgttgctgtagctgaatacctcctatattaatctttacttcacatgtttctttaaaacaacccaggaccaacaccactacccattctaatctttcaataagcaaaaatacttatgaaataatgagttaatgtgcatgttctttcaatgcacactaaaataaatacagaattaaaaaaataaaataaaaatctgtccatgtgctgcctaacattaccccaaacaaacctctgaactctattattttggttggtctttatctgtaaaatgagaataacaatatagtacctagttaccatttactgtgggactctagtaagttaatatacgcaaaatattttagaactataccaggcccttaagtgttcaatatacgttcactagtatctgcatcattcatcaacttatgagcaaatcttgagaaatcctgctttattcactatctctattgttttctagggttgcttctctccccactaacctatgaaacccttgtccaagtcaccaatgtttttatcacaaatgtatgcctgtcttttcgtcttaccctgcatccaactcagtgatggtatatagcaagtccttaataaatatctgttgacaagttggttgaatgagtgatttaataacttaaaatacatgggatggaaaaatgaattcaacactaacatacttgcttactcatttttaaattcctgttcttatatctatatggaagaaaaaggtacagaattgtaattattcgaagagtaataattgtttttgccccttgggaaaatataattttattgttaattttgtaattttctctccatcaaccttatcttcttgctcaactccttccaaaattgttaatttcatctaattatacagttcattctaatggtttttacctaggttctacagtgaaatttctctataattcattcaacaactatttgttgggtcttatgttcactagaaattgtgctatggactatagacagatggctgaagaagtcatatccctgccctaaagtggttaccagtatagggaagagaatacctccccctacacacacaaaataattataatgcaatatgactaggtgcttcatgaatataggaacacagaattccctatttcctgctttattcctggcatttattttaaaaatcaatgctatataatattatattggtggtattcagaagtctttctgaatagtagtctgtaaaactcagttggaaatagaaaaatttatgactttgagtccaaatgcactaggagttgaacattatacctcatttgagtcctgtagcaatcctgtgagcactaaaacatttaaaatattttagtttttaaaaatttatttctccatcattacctgtgcatcttctagattaggcatttgaaaattctgtgcatacatggcaatacagtcaacttaaaagatcttcccattacttggttgaagcagacctggtgtaatttcaagggcattaggaaaatctcaaaagcaaacaaatttttccctctgggtttgttgatgacagaaatctcaccctctgtaatttatccttatggataaaggcgtttaggttactgaagtgtaactattcctgggagaggaagcatattaaattatcaaacatttaacaacttactagaattgctttgatcagtttctttcctgagaacaagaactgatggaaagaagttaataaaagtgcagggatattgggcttgggggacaccaccaccaggaagaaagtttgaaggaagactgagggtacctgagactggcagataggaagttggccctgccaagtgggttcattgttgcctacagtctagattttccagcctgatgaggtaggggaaacatctgtgctggggctgccagaaaatatggtttattagaagtaaatttgtaaatacaaagaacagcaactggcactgtgagccaccggaggttagctgcagtaattacactggcaaaaggcttgcttgaacactgctcttgttggtggcagaaaacagtcacttgaaacagcctaaaagcactagatgctcacccaaaacaaccaaaattatagagttcagaggtttgtttctgaaaacaaaaaggtaacacgatagagtattagatatcacaatccctgatttatttgagcaaactttggcagagatgtcagatataaacaattacataatcttttctggaaaatatataaacacaatcttaattttttgttaacagataccctaattttaaaataagttccaaagtgattatttctgcaaagccaaaaaattactcccacaagcgccatcaccactattgatcattcctttttgttaaagtgttaatttttatataggacatatatgttctaatcctatatgctagtgattctgtaggtgggtaagtaaaagtgaagacagaagcttaacttcacagtttgtttcctcatccataaaaaaagaatgttaagtgttttctttctgctttcacaatccacaatacatgatataagcatctggaaaaatagccatgattttctcattttcatgtggtattctattttttccttcatttgagatgtaatagaaaattgctattctgaaatttcccagtaaattaattgtctctgcatactatgtagattagtttgaaactttaagaaatatgtgtaatgggtcattaaaggtgttatttttattactaaattctattaaaatgtgcatatgtatgaatatatgacatataatgatacaaataataccatatatgtataatgcaatgcttaattataattatgtgtattacatagttatcaaatcctttggttatttatttaatacatcagggaaggaaaaatatattcctatcagctgaaatgtaggagccctttttcaagatattccttaatatggattcttaatcttcaggcaactgccttacaattgtttctgtagctgaatacctcctatattaatctttacttcatatgtttctttaaaacaactcaggaccaaaacaattacccaatctagtctttcactaagtaaaaatactcatgaaataataagttaatgtgcatactatatcaatgcaaactaaaatcaatacagaattaaaaaaaattgtccatgtgctgcctacagttatctcataatttcccgattgtgtgtataatacacatgggaaaacagaattttgtgtgcaaattaattaagagcttggagtttggagtcagctgcctaggtttaacttcttatcctgctgcttagctatgtggcttccaggtcccttagtttcctcattagtaaaatgggaataataaatcatctacctcacagggttcttgtgagaattaagataacattaaaaaactcagagtagtttcacatagttcgtaacacacacactttttgtgctaatttttaccgtgtattaaagaatcattgtgtgggtatttgtattcattgacttttccatgcatgcaatactccaatactaactgttaaattgaaactgaagcccagattatttgctccaaatccaagttctcaatagagttgcagaagcttctaaataagtctaaaaccactttcctgagcagtttatttcctgggagatgctaacttattgttttggacatccattaatcaattcaaactttaattcaaatatttactgagtgtctcctgtgcacaagacagatgatatgaaagggatacaaagatgaatcaatcaggcagagctctccctagcagagttaacaaataacactcgtataattagcaagtggcaagtgccacaggagaggtccacaagagatgagcttcagaagttctgtgaaaagtaaggagatttccagctcagggaatctgggaagatgttaatatttgatcagaaactttaagatgccaggcactctgcaaatcgttatgtgcattatctcatttactcctgaccacatgccaataagttttccctttctgcaaaagcagtaacagaaaagcgaagtttgagctcagggccaacattacaacatgttgttttatttatattatctaaatataaattataaaattttttaaaattacatgtggggggcttggaattactgtttcatttgtattccatcgcacttggtgacttgccatttatgtttttatatttttttaaaattttttattgtatgtgggttcatagtaggtgtgtatatttatggggtgcatgagatgttttgataaggcatgctaagaacatacactaggaaaaagacaacgtgttcaatacacagtattgggaaaactggcttgccatttgaatgctatttactctagtaatttatttctttagaaaattaaatgctacattggtgtcccataagagttggcacagcttccaaaattacttagcctcttccccctgaagcagtttatactttaggagaatgtgtttaatcatgtgtagaataattatatttctgaatatttaaatcataattcaaaataatctaaatcaatattcttagtctgggcttagtaacacactaacattttacattttcctgctcttttaactgtcagccctttgtacatctttacgcattggaagaattcgttgatcagagaggaggcgtctcagcacaggcttcaggttctggtataaagatgacacaattatccagtgtttgccaaatacacacagtttcgaagaaatatgcaacattgttatgtagagcaattcttgaggatggaattgtctccaaattgtcaaaatctgtttcaacataatctcctttttttctttcctattgtaactacgggtgctattgccctcagcagagaatttggtgagctgtggaaaacctgtcaggtgagcaagcttaattagcccagaatagttctttaacatttctaaatccaagccctaaagacagatatgattgaagactataaaaaataaaaatatacttaaaatgctattttgaggctcattaaacttgaattagtcaacatctatttctgcagacagagtcaatttgcatttattcagtggttctctttggacaattaataagtgggtgacattaagtaacttgaatcaaaacaaaataattaaaatatgtagtgaaaaaactacatcaaaaatggaagtgaagataatatgaattcagactctggtcatttgtttcttatgacagaattatatagacaattgtcaatgaccttttttagagaacatcataaataccacataaagtaaacaataacaacaactgtgtctgtgtatgagcagcctcttatttccactttaagaaaccacaagttctactgccaaataaattgagttgatagatgacaagtgatatttttatttttcatctgaaagggctacaaagaaattacctatccttctttgccactaattctaaatatttttttcaaggctctggcaaaaatgtggaggatgtttctcaactttcagacatatctggctaacttaccctttttctacttttgaagcattacataaagggatgtgtgtgaacgaaattttgaaagcctgttgggaaaggaagcaaagtggttcaggcctaagtgttctgattctagttatgtaatactggggccaggaaactttttccataaagggacagagaacaagttttgggatttgagggccacttggtctctgtctcaactactcagatatgcccctgtagtgtgaagtagcacaagacaatacattaaaagtgtggtggctgtgttgcaacaaaactttaacttgtaaacaggtggcaggtcagattttgcccaagagcagtgtttttttcaccactgatgtagtctaatgccaagactgattaagtaaacctagccaaggaagagtattttccattagttattcaagcaaggctgtgttctttacagattgcattcaagtatatggagctgtgactgaagaaatcagggaaatttccagaaggtctgatgggagccatgtcttttggtgactaaaatggatatgtctcctgttattggataatgatgatgaattcctgattgaatatcctgtctgtactgaattctttctgtgccatttagaaaagctaaacttgtttcatttgcccaggtggtgtctattcctggtccctttgccaatctgtgtccatgggtgtttgtgcatcagtgcttgcagcttgatagagactgtcaaaatagcatctgaaaggctctttcaccagagggtgccagaaagttatgatgcttctgaactcttcctggtatgttaaacctgcttcaaagtggcaaaacttggtggacaatatagtgttgaattgcacataaaaagagagcaactgcaatacatcaccaaagtgctctggtacctacaggtatttgggatgcaattccttcccaaggagtgtggtctgagtagcttcatgtggggtcttccagtacaagaatattcaatctccactgccaaactagccaccctcagatctcaggatgaaaacctttcccatcatttctatgttagccatgaatgaggattgcagtgcctttgctggactattggaagttggctctcttcacttttcagggtctattccaaaaaccaagtcacacggtttatggcgtatggcaaatatacatgcagataggaataatctggggtcatgttgagttgagacagtatctaaaatatgccaagaattcaatgccagaaaatggaaactgaagaaattcatagttgagagtaggcaaagcagtaataggatagacagcagcatttgtcaaagcagaagaaatgtcaaatactaactgagaagttgctacgatcagtggccaagtgagtctagtttcttgatcatccataattttgtcatcaaagagaaatttatgcatgggtttccctttcatacaatatcctatttttcctatattactgggcataaagagggagaatttaaaagtttcgggcatttaagagaaaataatggtcctcttatcccattcttctagacatgcagatatcacagacaattcaaatgtcaaaaaatattaagaagacttatgttaggttgtccacttattatttttctcaacaagagcattaacaactctcatatgcttgtattatggttttaagtaaagaatattctgttgccaaaaaaatagaaaagataatataagatttaaaatgttccaatttttaaataaatttatgaaattgaaagaaaaattcttattttacccaagaataatgagaatgcatttgtttattaatcaatgtttgggaaccattaacccaatttaaatacttctcatatttgaatagctttgataaactccctgtaaaatggtttgctggcctatgtctagatttcttcagttatggaaaattctgtaccacttgaagtatgtcatttgttcttagactctgaaatacattcgtactttacaataaaatctgtcttcctataaccacttcattagtccttatctcagttcttcggcatctgtaacaaagggccatagactgggtggcttcaacaacagaatatttgctcaatcagagttctggaagctagaaattcaaagattggggtgccagtgaattcggtttctggtaagaattctcttcctggcttgcagatggcctctttctcactgtgtcctcaaatggttgaaggagatagagatctctagcttctttctcttaagggcaacaaccctattggattagggccccatccttatcacctcactgaacattggtcacttccccatttccaaatacagtcacattggggattagggcttggacatatgaattttgagggacacattcagtccataatcatcctcattttgctttttaataccatgtaaagcaagtatcatctcttttccatataccaatccagtcactatttggaaaattgtaactctctgaagctctactaaccttcctcaaatggtttcaagtttcttcataatatgggcaattctctgaataggggtcaaaagatctttatcactttaaaaagaaaaactaaaacactaaatatgtgaacacatttattgtacacgtttacgttctcttagcaggaacttttattctcattattctaattctaatgtagatactatcccaaaaatggacatgaggaaactaactactagaggaaacagatcttcaatttgtctttcacaaccacttggttgtatatatttagaccattctatgaaaattctaacttcacatatttttccacactctgacctcatgttgtgatatttggaggggcacgctacacccctaaactgaagaagtgaacacaggccatcactggagatgctctacactagctgagaagttactcggccttcttgtgtgccgctatgtcattatcatgacctacctcttgggctagaccttcttggtacactagacttggtgctattcctgacctggaagtaacatatgagagggagaggtagtccttgttatttttctcagctgtgaatacatttttttgtcaggttaaaatttttggaaattcaattatgagatagtagtttcagtttcaggaagcccaatatgaaactttagaggaaaaatttgtttctctcttaatttgtgttattacaaaatatatatgcagcatagtcataaagccacagttctatttctatatgcagttgggcctgctgaatgctaaatagaacaccaatattcctgttactcataaaatgtactagctaggttagtgaatgccagagaaagtaaccatttcttaaagaaagacagattttaagggacttaacttttcagtgcaatatgttagcatgctcctattccttgtgggctctcagatgtacaacaaacaagcaaacaaaaaagaagcttagctgatccagcccttttgcagcaaagggacccagaagtgtttttccttgaaaacctgaggaaaatcaatctcagggagaaacaaacatgctgtaggtttgttttatttttaacataatagtgcacccaaaaagtgacccttcctggaaaattttgctccaaagaatatggaactatatattttgattatcacatcactgtgctaagaagtataagaatacatttttagataaaacttttctttatgatttaatcagaaaatatggtttttttttgtgcctactatgtgcaaggccctgtccaaaatcctatggatagaaatgaaaataaaatttcatgagtgtttccagcaaactgctgtccggaaaattcatggacaagtaaactgactgcagagcgatatgataactactaaaggaatgtgtaaacaatgttataggaatacgaataaggaaaagatggattgtgactgaggggccagggaagcattcacaatgcagcttaatttgaagaagataatatagtccatatgatacaaaatatcactttaaaatagtattaacattttttagtctacaatcaggctcatttttgatcattttaattaaatattctagttgtattgttgctgtaataaaagcaactatctttcaaaacaaattttcacaaacctaacacaaataagaagatcttcttttgggcttgaggaaaatatgatcacaaaagtattcctttaacaattgcattttttttcttcaaagttgcttataatttaggacacaacacatacacacttacatacacatataattgcactcatcattgtttcaatgtgagagttagatattttcattttccctccactctcttgattaaggcaattattactttaaatgtaagttggatgtgtacatggaaatgacatttagaaataggccatgctattattatgtcatttaagcatttcctcagaagcatctttgctttcttgcaattggagtaagttgaattttatattgcctgatagctttagattgtttagtcaaatttttccagaaaaatttttaattttgtttatatgggattgtttgaacattaagtttagagagatgatatcaaatagcctggaagaaaccttcaagaatatttttgtaggagctggtgctgccatttatctcctcataattttatagaaaagcttcagcttcaacatcttcaacatcaactacttgccttcagataataagtagaaatgacaacagtaagacatagaaaaataatttgcataagcaacaaaatctatacagaaaataactaaacgtaagtataggaacacatttctagatcatatactctaattttaatagaaattcataaaataatgtttaaaacactagagtatactttccacaggcataatagttatttaagttacaaaaaagaaagggtctaaataatttttcctaatgatgttgaagacttctttctttccaaaagtagaggttgctaataaagaagctaagaataaccggtattctgacaagaccacttgaaaacaatctatccacaaatgtcacaaaaatttcatagtaaatatgcagaagtattttcttgtgatattatctcaagatacaaggttctgattttatagtttatattcaacaaattacagaaaatataattattctttaattattagaatagaccaagaatgaatgaggaatgtatcattcctgaggtttttcttttctttatttttggcagtgtcagtgtgagaggacataaccctctactaaaactataaaataatatgaagtaatgtatttactttgatttttacttcaacagtagtgtcacaagttaggttattattataaagccactctaagacttcatcagttttatccagagcttcatttaatctgttaaaatttacatcattctcttttaaagtgcctatcatgtgaatatccttgtcaattttctttctttctctttcctttctttttccttctttccttctttttctgtttcattttctttcattttctctttcttttttttttgtgcagtgtgtgatcatggctcactactgcagccttggtctcccaggctcaagcaatcctcccaccttaacctccagaagagctgggaccacaggtgtatgtgggctagactttcttttcttcaattcttaactgatataatcctgcaatattctcatttatttgtgattctgcatataatcaagtggttttcaatgtcgatttaatcaacactgagaaagcctttatcttttgtaagatatacatttttttattttataaacaattgcataggatttgccctgtgtttcaacattggacagttggcaaaaaaataaagtggacttagactttggcattgatgtgatcggttaaattgcacactgatgttaagctgagaggcatgcttgagtggcagggacttggtggtgacttcattaatgaatgttttcatgtcttgatcacgtttttcccctgtgcaacctattaactgtgacttagacatattatttaatatttctgacattagtttaatttctttgtttttaaatggaaatagtaacagattctgccgcttagagctgtgataagttaagttacttgtttttttgtaatgtgcttaacaggccttctggctctgaacatgtcgtcaatacacgtttactattatttcattaaaagctatgcaaaatcatcgtcaatctaccaaatagtgtgtcagaagtgcaacacaatttatgcaagatgtcttgaactaactataacttattaaacaatctttctcatttcttacatttaactttatcacagcaaaaataaatgcgaacaacatcaaaatcatattaaaatgtacagtatatctactgaagatttataaagaccaaagggaggcagaataagtgtagtcatacaacaagattttctaagatgtatatttatacattctttcctctccataaaccccacatttttaatagctggcccagagcttcgttcatctctctaccctgtcttatcttcagccttttatgacacacatcatgcagcccttatctatcatcttcaacatttcagtttttttccctgtacagttgattatttcttatccatagaaatttagtctctaggctttttcctgtttcctttaccaaatttctggccaagaaaaatctagggaccacgtaattccataaaaaattctccataaagaccaagaaacagacttattagtatcttggccatggctgactttggttcttctgtttctgttcttagtagctgtgtaaacttagttcagtcattttactcttagttttctataatatagaatcagggatttaaactctatgatctctaagctgactttcaactaaaattttgtatgtgtttctaattatttaaaccccaaattcaagaacattatgaatatagcatacatgcaaaataacaataaacatttgcttatttttgtgaaaaagtttcttgcttaaacgtaggagaataaaaaatgtggtactcaaaacagataaaaatttatttccctttctcttccctgctaatggtgaataaatctcaggctgcagtaacatgttttaaaggcttttctacctttaaaatgtatctaattattagaaaaatcaatctaattaacccaaattaagtggatcttggaatttatattgaagaatgtttacccacttttacattttaaagaaaactgtacaattagagtggaataatagacattggaaactttaaaaggtgggtgggtgggagtggggtgagggatgaaatacttcctattgtgtacaatgtacactatttgggtgataggtacactaaatgctcagacttcattactgcacaatatattcatgtaacacaacagcactggtacccctaaatctataaaaataaaaataacctgtataattagtaaaagatgactatttttaatggaatttttattgttcttataagtttttgttttttttactcttcgagtatcattcaatttacttgtgttcagacataaattcaaccattcagaagaatatcaaggaaaagtaaacatgatggtgaagttaggaagtgattaaaatgatcaaagaaagaaataaaaaataatgacacacaaaagattcttttcaactggaaatagttacaataacctaaggaacatgggcaatggcaatagaagaatgagctactggctagcaaatgagagaaaaaagcaggaatacagaagaaatagagaaaaaggagggaagtgagtgctaggctacatatagagcagaaataatcagaattggcaacacatgggtgacatacatctctatagtttgaagctgtgtcagcagagactcaagagagctcttagagaggagagaggggaactatcaactagaacatcaccatagggcaagctatgtctcagcccctccatcactcttaggtgtgcctctgaagctctggaaaatcaggccacttttatgggagtaagacaacgtataagagcagccatggacactcacaggaaagttacaaccagcagtctttgacatctctgcactgagagtgtgccactccaaataaagggcaattcatttgtacagtagtccccccttattcatgggtgatatggtgaactgagaataatattgaaccttaaacagtatataactttttgcatacatatatacctatgataaagtttaatttataaattagacacaataaaatattaataacaatagtcaagtataaactagaacaattataacaatatactatattaagaattacatgaatgtcatctctctctcttcctctcagaatactgtaatatatttggactgtggttgtacacaggtaactgaagccatggaatttgaaactgcagaaaaggaaggactactgtaatctgcagaagcactaactagaacagagttcagagaattatattgtttgtaatttgaaaatatgttagtataaatagcatgatggatgtatgtgcctgaattacttttcatctataccttaggaatatttggttaatattttaaggttttgtagatcacataactaagtctgcaaccttatctttatcctacattaattttttcaggttgaatttgctcttctgccattaggaagtgaagtgaagttttctttcccgttaatattggttgactcagtgacagcattatgaaagtaacagaggtaacattttaggactccccaaatagtgatatttcaggagcttagaaattaagaaggcctggcagtgtctgcttttgtgctccaaaaagggagctaccatgtaagaagtccaagaaagttgagatggtcatgttttacaataaaaatgtcaagctagccatatggactggcaataggtgagaaagagagagagatagagatcctcactagaccaaccaaatggctgaactgtaagcaaataaattttatctattgctttaacccactaacatttaaaaaatttgtcattttatgccatttgcaaacaatttattttctgtacataaaataaattgatatctaagagtgggatgatgtttgaacaaaagggtaaagcatattgccttattttggggaccaggtattgggtagagattttaagattctcaaggaggctgttagcaaaggttgcaagaacaggatgaggttgctattgaaggccagagaacagggatcctgagtgatctactggcagaaaaaaaattagcaaaattaatacctgtggcaatgtggacaataggaagaaaacttaatgatcttgtgatctgagtaggaagatttctaggctgttgaaagtgcttgctctttttagttgcatttcttttcgttgatcatgacaaagttcttttagttgattatgacaaagtttagaaggaatgagatgtggaaagaatgttcagcgtttaagaagaatttagtgcaatataaaggagcttggacatgtcagatttgaaaataaactgtttctcatcctcattcttgcttaaaaatagaaaagattatcaaagtaaaaaatagttacagaacaatggtcgaatcccaagtgatttcaccaaatttagcctcataataaataccaaaacaaaggtttaacttttttgaaacctcagaaagatttaaggtggcatttcctaaagagtctctgctgaggaaatgggcatatgaatatattaagtatgctttatagatcctctcttcctagcaaaaatggctcatgagaatctcatggacactgatccaagcccaaaatagaaagaaatgtgtcttaaggagattcataagtgtggcttttttctaagggtatgaaccacttatctaatagcaaggaaacccacaactaaaaaaattatatatatttgtaatacaatggacagagatgggtcaaaatatagagacttctgctctcctattcttcaacttattaaagaaagctattcagttacaacttaattcagtgtttttggaaagagagggaggatggaacacagataccagagagtgtgtctaagagccactcccagggcatatagcaaagtttctaaaataggaagtggtgataaacacctagttggatttcagaaaaaaaaaaaattatggctgttatctttgatctttttacattgtgaatggggtctacggggatgagataatgtattctatattgcatatgtcattgaattcagagcggctgcattgaagagctgtacttatgcaacggcagcgtggggagctaccctgaggctcccttcccacagctcttccacaatgtgaccatagcattacttctttaaggttagatcttgtgccactcatcttgaatctgggtttgtcctgtgcaaactttgaccaactgaatgcagcattctggaatatttgagcctagacacaaggagcctgacatcttctacttttgtttaacttttattttaggttcaggcatacatatacatgtttgttatataggtaaattgtgtgtggtgggggtttggtgtacagattatttcatcatccaggtaataagcgtagtatccaataggtagtttttcgatcctcaacctcttgccaccctccgccttcaagtaggtcctggtgtctgttgttctcgtctgcgtccacaggtgctcaaagtttagttctcacttgtaagtgaaaacatgtggtgtttggctttctgttcctgtgttagtttgttcacaataatggcctcctgctccatccatgttgcttcaaaggacatgatagcattcttatttatgacttctttcgtggtgtatatgtaccacatatttttaatccagtctaccattgacaggcacttactttgattccatgtctttgccttgctctttgtgaatagtgctgcgataaacatatgtgcacgtgtctttaggttagaatgatttatattcttctaggaatccaataatgggattgcttgttgaatggtaatttttttaagttcgttgagaaattgccaactaatttgcattgtcaccagcagtatataagtattctcttttctctgtagccttgccagcatgttatttttttactttttaataatagccattctgatggtgtgagactgcatctcattgtggttttgatttgcatttctctaatgattagtgattttgagcatttttcatatgtttgttgcccacatgtgtgtcttcttttgaaaactgtttgttcatgtcctttgcccatttttaaatggggttgtttttgcttgtaaatttcttcaaatttcttatagattctggatactagacctttgctgtatgcatagttttcaaatattttccctcattctgtagtttgttggtttactttgttgatatttcctttgctgtgcaggagctctttagcttaattaggtcccatttgtcagcttttgtttttgatgcaattgctcttagtgtctgcctcatgtaatccttaccaggtcctatgttgagaatggtatttcctaggttatcttccagggattttatagtttgagggttacacttaagtcttttaaccaccttgagttaatttttgtatatggtataaggaaagggtctagttccaatcttctgcatatggctattccagaaccatttgtcaaatagttattccagcaccagtttatcaaatagggagtcctttccctattacttgtttatgtcagttttgtcaatcagatagttataggtgtacagcattatttctgggctctcgattttgttccattgttctatgtgtctatttttataccactgccatcttgttttggttattgtagccttgtagtatagtctggtaatgtgatcacttcagctttggtctttggcttagcattgccttggctattcaggctcttttttggttccacatgaattttaaaagttttttctaattctttgaagaatgtcactggtagttgaatgggaatagcatttaatctgtgaattactttaggcagtatgaccactttcacaatattggttcttcccgtctatgagcatggaatgtgttttcatttgtttctgtcatccttggtttctttgagcaatgatttgtaattctcatttagaagtctttcacctctacagtgaaaattacagaacattgatcaaaacagacaccaataaaatagccacgatatccctgtttgcagacaataggattctataccaagaaaatcccatagtctttgtcctaaagctctattgtagagctgtattcctaggtattttattctttttgtggctattgtgaatgggattgcattcttgatttggatttcaccttggatattgttgttgtataggactgctactgatttttgtacattgattttatatcctaaaactttgccaaagttgtttataaggtcatggagctttagggcagagactatggagttttcttggtatagaatcatattgtctgcaaacagggatagtttgacttcctttcttcctatttggatgtgttttatttctttctcttgcataattgctttggctaggaattccagtactactgaataggagtggtgagagagggcatccttgtcttgtgccagttttcaaggggattatttccagctttagcccattcagtatgatactatgtatttgtcatagatggctcttattattttgaagtattgtccttcaaatgcctagtttgttgagggtttttaacatgaagggatgtggattttattgaaagccttttcattatctattgtgatgtccatgtggttatttttaattctgtttatgtggtgaatcacatttattgatttgtgtatgctaaaccaaccttgcattccagagacagagcctacttgatcatggtggattagctttttgatgtgctgctgaatttggtttgctagtgttttgtttagaatttttgcatctatgttcttcaaggatattggccaaagttttatttttatgttgtgtctcttccaggttttggcatcaagatgattttggcctcacagaatgagttagggagaaatcccccctcctcattttttcagaatagtttcagtattaatagtaccagctcttccttatacatctggtagaatttggctgtaaattcatctggtcctgggttatttctagtttgtagggtttttattaatgattcaattttggaacttgttattggtctgttcagggattcaatctcttctcggttcaatcttgtgtggttgtatgtttccaggaatttttccatttctactatgttgtctagctcgcatgcatagaagtgttcataatagtctctgacagttttttgtatttctgtgggttcagtggcaatgtcccctttgtcatttctgattgcgtttatttggatcttctgtttttcttcattagtctagctagcagtctatctatcatattaattctttcaaagagcaagctcctaaattcattgatcctttatggttttttgaatcttactttccttcaatttagctatgatttgggttatttcttgtcttctgctagccttggggttggtttgctcttgtttttctagttcctctaattgtgatgttaggttgtttatttgagatcttcctaactttttgatgtaagtgtttagtgctataagtttcccttggaacactgctttggctatatcccagagattctggaatgttgtattgtttttccattagtttcaaagaatttcttaatttctgacttatttttttgtttacccagaagtcattcaggagcaggttgtttgatttctatgtaattttatggttggttttttttttttgcattggtttctatttttattgtgccatattctgagagcatggttggaacaattttgggtttttagaaattaattgagaattgttttatgcctgattgtgtgggtaattttagcgtatgtggcatgtgtggatcagaagaaggcatattctgttggtattgggaggagagttctatagtatgtttattaggtctatttggtcaagttgaattgagatcccaaatatctttgttaattttctgccttgatgatctgtctaatactgtcaatggggtgttcaagtcttccactattattctgtggtcatctaagtctctttttaggtctctaagagcttgatctatgaatctgaatgctcctgtgttgggtacatatttttttaggacagttaggtcttctagttgaattagacctttaccattatgtaaatgcacttctttgtcttttttttaaatccttgttggtttaaaatctgtgttgtctaaaattaaaagagcaccccttgcctttttgttttccatttgcatggtaggtttttctccatcccttttatttcagcctatgggtgtcactgcgtgtgagattggtctcctgaagacagaataacattgggttttgcttctttatctaatcttccactctgtgccttttaattgaagcatttagactgttcactttcaagtgaacatgtattgacatgtgcagatttgatcttgtcatcatgttgttagctggttattatgcagacttgtttgtgtggctgctttatagcatcactggtctgtatacttgtgttttttttttttttttttttttttttttttgtagtggccaggaatggtcttttcctttccatatttagccctcccttcaggactttttgtaaggtaggtctggtggtaaaaaattctctcagcatttgattggctgaaaagggtcttatttctcctttgcttacgaagcttactttggctgaatatgaaatccttggatgaaaattattttctttaagaatgctgaatatatgcccccaatctcttctgatttgtagggtttctgctgacaagtctgctgttagcctgacagggtatcctctgtgggtaacctgcccctactttctagctgcctttaacattttttctttcatctccacattggagaatctgatgtctctgtgtcttgggggtggtcttcttggggatggtgtagtattttgcagggtttctctgcattttgatttgaatgttgacctctctagtaaggttggggaaattttcatggatgatatcctgaaatgtgatttccaagttgcttagcttttaaccctcttttgcagggacacaaatgagttacagatttggtctctttacataatcccatatttgtcagagattttgttcattctttattgtttttcctttatttttgtctgactaatttattttggagagccagtatttaaactctgagattgtttcctcagtttggtcaattctgctgttaaagtttggtcaattctgctgttaatacttgtgattgcattatgaaatttttctagtgtgtttttcttctccataaaatcagttggctctttcttataatggccattttgtctaccagctcctatactgttttattgtaatccttagatttggttgggttttgactctctcctgtatgttgataatctttattcctatccatattcttaattatgtttctgacatttcagccattttagcttggttgagaaccattgctagggagctattgtggttgtttggaggtaagaagacactctggctttttgagtttccagagttattgtgctgttttttccttatttgtggggattatgttctttcaatctttgaagttgctgtcctttggatggattttattgttgttgttgttttcttctttgaggggttgattatggtataggtgtgcttggttgaatggcttcacttctagtccactcctgggtcttggaggagccctctctgattactgtctccatgcccacatttcttttgttctggcccacaaggatccttcaggcaggggctgctgttggcagacaagctgtattgtcaggttggccctaaactgctgtctgtgtgcttcatgtgaaacagaggattgtgcctgcatgcagagtttaggtggaattgggaccactgggttggaagctctagtgggtgtagcctgtctagcaaggagaggttggtgtgggtggagttgcctgccctgccatccgggtgtttccaaggcaacaggaagctgtgccccttggcaaattcaggaagaagtaggacggctgagccagaagctctagcaggtatggctcacctggctatcagcaggaggggtgggtagagcatctgggttcctccagggacaaaagaagtctatgcctgccagctaagttcccatagaagcaggaccgttggaccagaagctctagtaggcttttcccacctggctatcggtggaggtgggtgggtcatgcaccctgctttccatgtttcctgggacaatagaagccgtgctctccagctgagttttacagaagcaggaccacagggtcagaagagctaataggcattagctgcctggctatcagcagctggggtgtgtggggatgcctgcccttccaggtgcttctagctgcactctccagttgagttcacacagaagcaggaccacttggctggaaactctagcaagcattgcctacgtggctactagtggcggggcaggtaaagtggctggcccagttcagggtgaagggagaccactgggctgaaagctggtgccaaattccctttggtagggttggcggggggtatgggagggtggaggtgtggggggtgggggatgagtggtgtgggggttagggcctgggggttggagcaatctaatacgaggcaccacaactatggcctctattgggtctatggcaccagtgctggcaggctttgtggcccaaggcttgtagaagtccttttgaacttgagaattacctctgcataacatccaagtggttctctgcttcagtgtagaaggctggtgggtgtggggtgggtgcaggggagctgggggattttctctatcccagtcttgcacagatccctgtggagagcatgaatgcccctgggcactctcacttattcaccctttcccatgttggagatgttttcctagctccatgctgaggccagataggcgggtgcccagctttgctcttctctgcttcttgtgttccccttctgctttaattgatcccaactagtttctcagatgatcagccttacagggccactgctcactggcccttttgtttcctctacgtgagagtggcatacaagagctgctgctcgtctcccatcttagcttatgcttttatgtttgggagaaatctagtaccctgaagctgccaaacggtaaagtagtcccagctaagcatacagaaaggtactatggagagaatgagagagacagagacagggagagggagagagccggcagtctagtcagtcttctttttcaactgtctttgctgagacacgtaaatgaaaaggtcattttggacatttcattcctaaaagattccaagtggagcaaaaaagagttctcttcactgactcttagcaaaattgcagaactgtgaggaaataagttatatctgttatttttaagtactaaggttttggagttagttcattacaaagcaataaataaatatcttagtcagaaagtaacacttaaaaattggttacttaatacttcagatgtccttatgaaaatacaaaatatattttgttaattagtatatgaataagtattttccaatcctgtggtcatttagaaagattttccaattaagtataagaatatgtatggcaagcaaagaatgacttttggtatgcagcctcatttgtcattttcttcatccactttacagaagctgtcacttgactatatcgcaatgctgatttgctattgctgccatcagaatgtcatatgttagcctcaaaattaactcttcattgaaaacatgagttaaagagcttaaggacagtgtgaaatttttccagactaaatgaaagggtggtaataactatttatgcctctcggctaatatatgtttgcatgttggacagagtttaacctaggcttgctttctttgtaatataccacatgcaggtgagggtgtggggtaggagatatggcagatactatctacctaccagagtcttcaggtgcttacaaaaaacctgaagacagctgaagagccaaattgactcaagacagtttgcaaaaagagggaattctggccaatggtagtaagaatgaggagtaaagaagaggtttgattattatagattattttctccactttgtattaataggttttttagagaaggacaaaggaaaggagacagacaaaagcaaagatatatatgaaagtttaaaaaatgatacattctgtataaggctctataatacacaatctcaaacaacagaaatgataccaaatcaatgcaagagtatccttttgtcaacaattgtgttttctttcatttttaccagtgagcctaatgcagactaaattttattccattgaaattaatacaaaccaaaaataaaattatattcaatatcctgctattccataaaaaaattgtgagtccttctagaggcagataaaaccatggagattacaaagcaaaataagaaagatctatcatttcaaagagtatgtaccatagtggaagaggacagaagacaaagtgctgattgcagtaaaaataagataatatttgctagaatagacacaaatctacaggtttctgtggaatcctgtttaggggaagttaactcagacttaattgtcagggaaaccttccttgaggaattggaggacaggacaacaggagcttcctgggggcaattagagatggtcttctaggtagagacaagaactcacactaaagatacagacaaaatggggtctggggacaactacatggaattacaaccctgaggataaatacccaggcaaatgaaggactggggaaaaatcagtgttagcaaactggaataaaaggaggctgaagaatctgaaataagtcggtgacataatatcttagaaacttccctgctccacgcatactgagaattccaacaatttctacaaggtatgtgaggggcctgagctattttgttttctgagaggtggctttagaattctgcactctctctaggataatcgcattccttttcattgcttccactacagctaacctatcagacatcgcctctgggatgaagtcattgtctcagggaaatctcaacctgattttcccacaggcactttagactaattggtacaaaagtagattcgtcatttgaggcttacaacaagcctccaatatacataataaaatttattttttttaaagtgaatttatcatcttttctcattgacttgcttcctttcctatattttctatctcaggataggtttcctcagctacataatcagcccagaacagaaacctggctgatatccttgactacacccactacctcaccttaaaacactgaccctgagaaggcagagaaaggctttgtgaatattttcattaatgcataagatccaggaagatggagattattcaccagtgaatccccaacacagaataatgcctggcacatagtggatactctctagctggatgaatagatagatagatagatagatggatagatagatagatagatacatttgttggattaataaatgaatgaatttctcatttatttttgtcagctcttatctcattgaaaaaaagcatactaatgaattaagatctttttcagaatatgaactgattcaaaaggagcgtccatagatagtgaatccaaagaaacatattaggatttttaaatttgttataatactaaatgcttttaaaactttgtttaaaacagacattgcattaaaagtcactcaaagtagacccaaaacaatggtttgggtaaaaggtgtttgactttgttatttgtagtgaggcagtatagcgtaggttttaaaagtgtgggtttgaattttggcccttgtattcaatgactgtgtaactaaagtcaggccattcagcctctctgtgcctcaattcccttatctgtgaaatggagatactaatattacttactgcaaagagttacttaaaacattgagatagtaaatgtgaagcaattataagagtatttaccaaagggaatgtgcttaataactattaactactattagaaggacaataattttataaaggcattttgtaaagttgtgtttttgatttttttttaatgaacaaatgagcttccaaaatgatcttacatggctgaaacatcagacccgatctctccattgtggtctaataagcaaagcaagcgagatttacaataaagtagatgttggagctatgctgactgggttcaaatcctcataccatcactgcctagttgtataagcttgaacaaattacttgttattgctgtgcttcaatttcctcagctgtaaaatatgggtaagtacgcatctactgggttgttgtaaggattaaatgagctaatatttgtaatgaacttacagctgaccctagccaaacaaacaaacaaacaaaaaaagctacatgctccagaatgcttgcttacttgttgaatgagtgcatgaatgtcctttaatgttgtatacatgatgtgtttcctccctttaataataaagattaatggatatagtgtcaaagcctgaggaatggttaacagacaacatcagtgacagtgaagaacaagatttcatggaagtatgaaaataatttttgttttcttattctagaagggtagacaagttacactgtcttaaataccagcaggctgaatattcattaatctgtttttctaagtaatataaaaataaaacatggtgagtattttagaaaaccaaaatgataattatttttaaactaaatatttaaaaaattattaatattagcatatgaactaggatcaaatgcttcataacatgagcttctatttatgcatcacagtcaatttctaaactttcatttccagaatggagtatataggactagaaataacttcaaaattattgttttatgtttgattagcacagagtagaatgaaatatcaatgctggggggaaacttaaaataatagtaaaggataacagttattaagtgttaaatgtgcaatatcttaatcattcttccttaaaccttaagaaggtagagtctctattttgcaggtaaagaaaaagcccaagcaagcataaatggcttgtccaaggcaccatggcaatgaattgagggagctaggaatccaactccagacctacaattcttaatcccacatctctactggcccttttgagttagcacttgtagtgatattactggcttcataagaaagcactattgcatgtcatggagaaaatggagcatatctcaaaaaccttaagttgacaaagtcttagcactaagaggattggtttttaattatcagaaagctagttttgtcatatcatgccctgtaactagatactgttcagtttctgtcttcgaaggagcagtgtagttactgataaagcaatgtaatattttacaattgactttacaaagtactttatttttatctttatggattatgctgaaaattctctaaattcatgcttcacatatttttttcagttctcaccctccttaaattttacattatgattttcttatgtaagatcattcacctggggtttctgttctatagcctttagctaaattagccttaagtccttaaatttcactagaaaactatctcccaaattaatagccccaaagcacttaagccaaaaattgattttattttacttgctgttgagttacatagaccacactgcaaaattaaacagggtttttaaattgtgatctatattactagaattccctaactaatataaaccagattacttcttgttttactttacccatttttccctaaccacttgcaagggaatattgatggactttgatttgataaatctattaacatagaaaaaagtgaatatatattcatttgtctctattttcttctgtaaatttatttcgtagtttaaactatagacctgagatgtgttattatatggttttgttgatttgtttttgttagttttaaaatgaaaagcctttgagatcttttagaattaagtgaaaatttaagcagaacagaaggaacaccagatgggagtctctcaagaagtgtcctcagggatatcacatgaaagtgaggtgatcttaggtgagcggaacacaatagaatttgtgactgagataatatcttaatacaaagaatgtctgtgcaatttatatgctgaggaaatggtatgtgacatatatatgtacatatgcctacatatatatgcatagaatcatcgtgaactggaataaacttaaaaaaataacgtagtccaacttcatcatttatggaagagtagcttaggggaaagagatttcaagtaatggttaacaatgtcacaaaactcattattttttggcagaggcatgactaaaaatcaggtgtccttgtttcaagcctggtattttttctatcaactcaaattgtgtctgggaaaagaatataaatttattaaaatatagattttcccccatgtagcaatatttgctgatttgcaacttcaattttttttttattccaggcagagttacagagcattacattatagacatcattctctctgagggtaaagattttggcttgagtaccaaaaggctatgaagcatgcttaataactatatgcttgaaacaacaacttgtacaaacaaatgtaaatgtgttaatttgtgtttgggatttcaataatcacctcatgtataatagctgtaggaaactacttggccctctatctggtttcttttcatttatagcttcatcacttttcaaactcagtactgatgttgctcaaagctgagtgatgtacggacatttttcacagaaaaataagtttcagaaatcttcagtattcccttactactaattttagtaaaatattactattttatacactttatgtgaaatataaacttagatacaatttcctcatatttattgcctcacaaaattataaaaccaaaacaatttgacaagctaaatagaaacaagtccacaaagtcataaaattgaagttagactatttaacttaatgtaattattggtatgaatctggtaaaattaaattgctatacaccaaataattttagcactgattgttataatacaggcactttaaaaaataaagattatggccgagcagggtggctcacgcctataataccagcactttgggagtccaaggcaggtggatcgtgaagtcaggagttcgagaccagccttgcaaatatggcgaaacccgtctctactaaaaatacaaaaagcagccaggagtggtggtgggtacctgtaatcccagccactcaggaggctgaggcaggagaattgcttgaacccgggaggcggaggttgcagtgagccgagaaatcgtgccactgcactccagcctgggtgacagagcaagactccatctcagaaaaaaaaaaaaaaaaagattacaacacagatattacatgtataatacccacaggtgtatatgcatacaaatatataatggatatgaggatataagtattttaaagactagtgataaaatgaacacgcatgttctttttactaactttctttatactaacgttctttatactaacggttctttatactaactctacctagttagtataaggcattatgagcaatggtgatacctgctttgagccttaaaaactactctttgatctcttctccgttcttacgtggttatccctgtactgatttctaagttttctagtcctttatttctttatcatctaccaaacatatatatgcacacacacacatacacacaaaaatatatcagagattacatattgtttaagttctcctatttgggaaatttatataatggggatatttgtttatgactttctttttttctcttccatgttatttttttgagatgtattcatgttgatgtgtacaggtgagaatcactgattttcactactgcatatgttttttggtatatacagtatacatactactgtaagtggacgttattgttgtttttactttttatattataaagacttttgttatgaacattccagtaccatgtctccttatatatacatcaaagaatttcacctaaacaggaaaattttggtgtattggatatgtacatcttcaactttttaagtgatgccagatggttttttaatgcagatttagaaaaactatatatgtattaaacttttccctgcagttgcaatttacatacttatcagttaagtaagcaaattcatctaaaatatcccctttttgtcagggcaaaacattagttcttaaaagaatacagatggtgttcctttactcatcatcatgggctttaatagaggtggtcatttcttttataagtgtattaataatatccatatcaaagaatccagtggatgtctttcagcccttattctattttgttttttcatttttggtttcagttttagcccttattcttgctagacttcactgcagcaatattgaacagcccctccttctcaaaactttgttcttctggctttaatgataatacattttcttggctgtgcccttgcccctctgcctgtttttctgcctgatattgaattactttcttattaaatgtcagatttcctcaggactttgttctggaccttcctatctcattctcttcactctctcctgaggttatgtcatctggcctcacgtatttaaatactatagcctgagaacttcctgaatcatgaatgtaagtgttaacttggtaaccttccctacaagcctcagaaacacctcaaacttaaaagtgtccaaactaattatcttgttattctcccctaaatattttcttctcaatcttccccatcttaatgatgaccctcacctccatttagttgcttaatccagaagtctgaggctgatgtttgactctccctctcacatcttcataggtttacatgtgcaagtgtacagtttatttctgcattttctaattagattaaataattaggatgatataaatacagtggtacatctaaaccagagagtgcttgaatagaagaaactatgattaaatgaatggagaccgtttcaaactagaagcacacacaaatggagagatcaaacagaggtccgaaggatgttgaaaacacacagattaagagagaatcttgagtggagacagatccagggacaggcccttccggactattggcactcaagagttttataagggcaggaatacatagatgcagagctgaaaaaaagatgcatcagagtaaaaaatgggaagagtggtgggtgggaaaaagtggagtggtgggaaaagaggtttccttctgttgggtaggagccagtttctgctgctccagggagtggagtccaatccatggtgtattgttgtctcactaagaaaggcaaggcctgcctgggcacggtggctcatgcttgtaatcctagctatttgggaggctaaggtggatggatcacttgagctcaggagtttgagacaagcctgggaaacatagagaaaccccatatctacaaaaaataaaaattaaattaaatttaaatagcagggtatggtggtacatgcctgtagtcccagctactaggggggctgaggtgggaagattgtttgagctcaggaggtcgaggctgcagtgagccaagattgcaccagtgcacttcagcctgggtgacaaaagtgagaacctgtctcaaaacaaacaaacaaacaaaaaataaggtgggtcctcatgtaggaataaattgtaaattgagagtgattcttatacgtgcaaggaatgggaaataattcttattggatgagtctgcatctgataatgtcttgacttgtgattcagtgccctcagcagaatagacaccagatgcccaagtccaaatggtagtccagcggaataagcagatgggtgaatgaatgaatcatttaccacataacttctagaaggagcaatgggtcataaaacatggtagtgaaaccttgatgtctctattactttgcttatgtttatcagaggtttgggtttattttcaccagtaagtggacccctataaatggctatttaagagacttacatttgttgtgcagtgattctctttttacacattgttggacagaaaatgaggacagggtaatgattaacttttatccctgtaatttacaaaacccaaaagtgttgaatgttgttacctttcttgatttcttcaatggtgtgttttaattttttctaattattttgtgtccattagacaagtgtctttgaagagctgaaaaaggttgacacgcatccttttacagaatatcataaacacatttagtgaggtgccactagatacatataatgtctctaacttgataagctgggacaagtaatataagcaacccaaattttctacagataactgaagtggtttctttcttcatttgtttttcaggaatctctcacaagtccttaaagagaatcctgtttttatgttttagacatttcatagtaatttattttggctaaaggattttgatggctaatgattgacagggctttttataaaagtgaatggagcaaactaattattgactttgtaagtcaatgtcttgaacatacctgaagtgcataacactcatttgctttaccagtgtccctatttccaaatggattcactagaaattaaaaaaaattaaattgttaaacttctttactgtgttgaaattataaactaatttgaaaattaagataatgtttacatttttggagtcggtcactaattcttcaaaaattccagtcaaatataatagtacatgcaatcacacatgtgttttcaatcctagtgacttacttacatctgaaaaaaaggtagcatctttctagaacttataatatcaacttctgcatatataaaaaacaaatctaattgattaacaatatttatttatttccataattattttatttcctctcatacttagcaaagagaatagctggtaacatctgcatttactaggaattaagatttggtgtccttaactaacttggacccgaaagcaagagtccatgcactgaaaagtgtaagcaattaaagcactaccaaggaaagtgtttttctaccaccagagagaaggcatttactctcagaccttgaaagttatcatcatttatggtcatcaggggaagcagagtttttcacaccccaggcacaaaattgaaagtgtctgtttcattctcttctcacatcctgagctctgggtgattttgttaaaggaagcattaaacaacctgtcagcacatacacattggattagggactcttatcatgtggaggggctctggccagttcagaaagacattattggaaacttaggggtgagagcataaatgtaacttaacactttttggctcgaggaatcaactatagttcttttccttagtgttttatattacaaacctgttgtttttaattttctgagcactaacagcctactgtgcttaaacagcttttaatcagaacacaatgattagatagagcctgcatgatacttagatattcagaggagctgcattgcccagaaacatattcagaaggctgaatttcctatctttctttttctgattcatcatacgagttctctttaagaattatcatctagatacattttacagtttgtatcagtcatctggtatatagcaatataagtgtatgtctcagatacatattctagcacacacacatacacacatagttactgtgacactgtaacagtataaaaaagaataaaaaatcaatgaggggctgacataaaatctttcaactacagcatatttaacaaggagggaaaacctgcttagctggctgcctttttaatttcaaggtaactttattggtccaaatactgaatgttcctccaaatttgattataacaaatgtccagttcccttacatcacaggatgaatgtcgagttttttagtgagataatcctttagtaaaggccaatgtttcagacaaggttttaggagaaaaagtctttcgaaatttagtcaattattatcatcatctttctgcaatttcaaaactctgtcctcccctacataacaacctctctgacttattaacaagcttctagaaaaataacctaaaaccactctgttgcttcttccagttcatttattcttcctcagaatattacaatttgatttttgttaacattttttctccagaaactggtgggtgaacttttgtaacattggtgttcaacagatgcttctttttccatctttggttcttgtgacatttttttcctttgtctacggccagcctctctattccttaactaatttggcatgtacctctttcttagcctagttcttgattgctgattcccaattctcagccttcttttattttaatcctcaaaatcaattcaatcagttattatggcttccaccatctcctgtgcagactcccacagccatatgttaatgatcttttgtgaaccgaaggcccgtatttcaaatgacttgtgcctcacaacattccactaataggaatgatattcagcaggaacacacacaaaggactgatggattagtggtgatggcaagccagttgttaaatatttgaaaatcatttctgcccaaaagcaactgtattagtctgttctcacattgctaataaagacatacttgagacagggtaattgataaaggaaagaggtttaattgactcacagttccacacagctggtgaggcctcacaatcacagtggaaggcaaatgtggagcaaagtcacgtcttatatggcatcaggcaagagagcttgtgcaggggagcccccatttacaaaaccatcacatctcctgagacttattcactaccaggagaacagtatggggaacagaactaccctcatgattcaattatctccacctggccccacccttgacacatggagattattacaactcaaggtgagatttaggtagggacacagccaaaccatatcagcaactcaaatgcaatgataaacctgccgttttccctataaataatcctagattcattccccattttgagaatgggactataaattctatggttacataagccaacctggtcattaaaattccaaattttctatatattttttgccaataattatttttaagttcaatagcattcataattattctcccacccttattgccaaaataccttttttgtttaattattctgaacaaacctgactttgccatttcttacgatgtagtcctaacccctccagttgtacactttggttgctatcagagtgaacatagcatgatgacaattcctactcaaactttttaaatggctcccccatttaagaagtatgtaatgtatagtatatgtatatggcagcaatatgtaaatatataccattttgcattttacataggattaattattctctggctcccactcacctatccaaaatcaagtgttctttctgctcacttcatatcaaaccccatgtctccataataataaattatgtctactccacctccccatccctcagacctttccattacctaagtctgtgtatatgtaatattgtctctgtctacaatgacagcctacatattatttacaaggaagacacttgatctttcttcaaatttctaattacaactcctctacttcttcagagaggtcagaagacatctttttctatttttctatattgcttctgcatgtttatatttataataaagtaaatgctcagctatatttatattcaggggtagctaattgagttgagatattacactcaattaatgtatactcaattaaatttagttttatattaaaatttatattttatttgggaaaaagtatagttatgaaataagaagacagatcctgattttggcaggggttttccgagtacatgattgatagattcgcatatttgtgtattcctccctaaaatagtcagctcagcgttacatggatccaattcttgcctgtaaccatttaagaaagaaatggttttagtataagtcatataaacatttatctgacaaattaattaaactattatcaaaagaataatttaagtaaatagattatttcacaataaaacaaagccagaagcagattaatctgttataaattagaatccttaatgctttaagtacataaacacaaagttacagtttgacaaaacaacaaattatagcaatcaaccaatgaaataaataaatcctgataaacagatctttctcaattgtaactgaaacaatgatggattataatattccattttagctttttacattattaaattttctgtatgagtgaaaaatattaaaaagaatcaaatttcaatgcagtcatacagtgtacaatatatacttaggtggaaaacagatatattgcagacagtaattagttgtagaaatataaattataccaataagcaaagcacagaaaaattaacaaatgaataaatcaaatataacttaattagggagatcagagtaataatttccatatgcccattcttttagaaagatgaaaaagacaaaatactttgtcaatactttaacatgtagatatgcatgtgtcatttactctagccatatgtttaactaattgtttaatccagagattggcaaactataccctaggccaaatcttgcctgtcatctctaagtaaataaactttaattggcacacagccatatgtttctttacatatagtctatgggttttttcataacagaattgaataattgaaacaagactttaagtcccaaaagcccaaaaatatttactatctaacccttatagaaaaagttggtagatgcactattcaatttatctattaaccaagcaagtaagctttatcataatccttttcaaaataatagtacacattcttgggaggagccaagatggctgaataggaacagctccggtctacagctcccagcgtgagcgacgcagaagatgggtgatttctgccatttccatctgaggtaccgggttcatctcactagggagtgccagacagtgggcgcaggtcagtgggtgtgcacaccgtgcgccagccgaagcagggcaaggcattgcctcacttgggaagtgcaaggggtcagggagttccctttccgagtcaaagaaaggggtgatggatggcacctggaaaatcgggtcactcccacccgaatactgcgcttttccaacgggcttaaaaaacggcacatcacgagattatatcccgcacctggctccgagggtcctacgcccacggagtctcgctgattgctagcacagcagtctgagatcaaactgcaaggaggcagcgaggctgggggaggggtgcccgccattgcccaggcttgattaggtaaacaaagcagccaggaagctccaactgggtggagcccaccacagctcaaggaggccggtctgcctctgtaggctccacctctgggggcagggcacggacaaacaaaaagacagcagtaacctctgcagacttaaatgtccctgtctgacagctttgaagagagcagtggttctcccagcacgcagctggagatctcagaacgggcagactgcctcctcaagtgggtccctcacccctgaccccggagcagcctaactgggaggcaccccccagcaggggcacactgacacctcacagggcagggtattccaacagacctgcagctgagggtcctgactgttagaaggaaaactaacaaacagaaaggacatccataccaaaaacccatctgtacatcaccatcatcaaagaccaaaagtagataaaaccacaaagatggggaaaaaacagaacacaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgaatcaactgaaagaaagggtatcagtgatggaagatgaaatgaatgaaatgaagcgagaagggaagtttagagaaaaaagaataaaaagaaaggagcaaagcctccaagaaatatgggactatgtgaaaagaccaaatctacgactgattggtgtacctgaaagtgatggggagaatggaaccaagttggaaaacactctgcaggatattatccaggagaacttccccaatctagcaaagcaggccaacattcagattcaggaaatacagagaacgccacaaagatactcctcgagaagagcaactccaagacacataattgtcagattcaccaaagttgaaataaaggaaaaaatgttaagggcagccagagagaaaggtcggattaccctccaagggaagcccatcagactaacagcagatctctcggcagaaaccctacaagccagaagagagtgggggccaatattcaacattcttaaagaaaagaattttcaacccagaatttcatatccagccaaactaagcttcataagcgaaggagaaataaaatactttacagtcaagcaaatgctgagagattttgtcaccaccaggcctgccctaaaagagctcctgaaggaagcgctaaacatggaaaggaacaacccgtaccagccgctgcaaaatcatgccaaaatgtaaagaccatcaagactaggaagaaactgcatcaactaacgagcaaaataaccagctaacatcataatgacaggatcaaattcacacataataatattaactttaaatgtaaatgggctaaatgctccaattaaaagacaaagactggcaaattgggtaaacagtcaagtcccttcagtgtgctgtattcagaaaacccatctcatgtgcagagacacacataggctcaaaataaaaggatggaggaagatctaccaagcaaatggaaaacaaaaaaaggcaggggttgcaatcctagtctctgataaaacagactttaaaccaacaaacatcaaaagagacaaagaaggccattacataatggtaaagggatcaattcaacaagaagagctaactatcctaaatatatatgcacccaatacaggagcaccaagatccataaagcaagtcctgagtgacctacaaagagacttagactcccacacattaataatgggagactttaacaccccactgtcaacattagacagatcaacgagacagaaagtcaacacggatacccaggaattgaactcagctctgcaccaagcagacctaatagacatctacagaactctccaccccaaatcaacagaatatacatttttttccagcatcacaccacacctattccaaaattgaccacatacttggaagtaaagctctcctcagcaaatgtaaaagaacagaaattataacaaactatctctcagaccacactgcaatcaaactagaactcaggactaagaaactcactcaaaaccgctcaactacatggaaactgaacaacctgctcctgaatgactactgggtacataaagaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatgcaaaattgacaccctaacatcacaattaaaataactagaaaagcaagagcaaacactttcaaaagctagcagaaggcaagaaataactaaaatcagagcagaactgaaggaaatagagacacaaaaaacccttcaaaaaattaatgaatccaggagctggatttttgaaaggatcaacaaaattgatagaccgctagcaagactaataaagaaaaaaagagagaagaatcaaatagacgcaataaaaaatgataaaggggatatcaccaccaatcccacagaaatacaaaccaccatcagagaatactacaaacacctctacgcaaatactaaagtagaaaatctagaagaaatggataaattcctcgacacatacactctcccaagactaaaccaggaagaagttgaatctctgaatagaccaatagcaggatctgaaattgtggcaataatcaatagcttaccaaccaaaaagagtccaggaccagagggattcacagccgaattctaccataggtacaaggaggaactggtaccattccttctgaaaccattccaatcaatagaaaaagagggaatcctccctaactcattttataaggccagcatcattctgataccaaaaccaggcagagatacaacaaaaaaagagaattttagaccaatatccttgatgaacattgatgcaaaaaacctcaataaaatactggcaaaacgaatccagcaacacatcaaaaagcttatccaccatgatcaagtgggcttgatccctgggatgcaaggctggttcaacacatgcaaatcaataaatgtaatccagcatataaacagagtcaaagacaaaaaccacatgattatctcaatagatgcagaaaaggcctttgacaaaattcaacaacccttcatgctaaaaactctcaataaattaggtattgatgggtcgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaatggtattcatttaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagcaaacagagagccaaatcatgagtgaactcccattcacaattgcttcaaagagaataaaatacctaggaatcaaacttacaagggatgtgaaggacctcttcaaggagaactacaaaccactgctcaattaaataaaagaggacagaaacaaatggaagaacattccatgctcatgggtaggaagaatcaatattgtgaaaatggccatactgcccaaggtaatttacagattcattgccatccccatcaagctaccaatgcctttcttcacagaattggaaaaaactactttaaaattcatatggaaccaaaaaagagcctgcatcgccaagtcaatcctaagccaaaagaacaaagctggaggcatcacgctacctgacttcaaactatactacaaggctacagtaaccaaaacagcatggcactggtaccaaacagagatatagatcaatggaacagaatagagccctccgaaataacgccgcatatctacaactatctgatctttgacaaacctgacaaaaacaagaaatggggaaatgattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctgggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaactgacaaaatgggagaaaatttttgcaacctactcatctgacaaagggcttatatccagaatctacaatgaactcaaacaaatttacaagaaaaaaacaaacaaccccatcaaaaagtgggcgaaggatatgaacagacacttctcgaaagaagacatttatgcagccaacagacacatgaaaaaatgctcatcatcactggccatcagagagatgcaaatcaaaaccatgatgcgataccatctcacaccagttagaatggcgatcattaaaaagtcaggaaacaacaggtgctggagaggatgtagagaaataggaacacttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacgcatgcacacgtatgtttattgcagcattattcacaatagcaaagacttggaaccaacccaaatgtccaacgatgatagactggattaagaaaatgtgtcacatatacaccatggaatactatgcagccatcaaaaatgatgagttcgtgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtcgggttggggggaggggggagggatagcattggcagatatacctaatgctagatgaggagttagtgggtgcagcgcaccagcatggcacatgtatacatatgtaactaacctgcacaatgtgcacatgtaccctaaaacttaaagtataattaaaaaaaaagaaaaaaaaacaaaaaaacaaaataatagtacacatattataaaagacacctacatagcatccaacaatcaatgccattctgttccatgaatatgtgacattctggttttcatatatttatattgaattatggcatacataataaagagggtaaaggataaagctctatgaaatattatattgtgaacatagtcaagtaaccactacccaggacaaaaggcacaaaattactacctagactactccaccacaacatacacaagcatgcacacacatgcacagacacacacgcacacacatactctctctcacaactcttctatcctcattcaacattatgtttttgagatatatatttttgaattgaatagtttatttattttcaagatatatagtcagatacttcacaaattattctaatgttggtatactgtgaaattttaaattgttgagctatgaatagtgctgctatagacatgcttgtatgtattgtttgatgtacagaaatgtgcatttctgttgagcatttaacaaaaaagtacttagagttctatgttcagtatatgtgctctactgattatatattttgcaaggattttctttttactttgggtatcttactgttttagttttttaatggtgttttttaataatcagaagtttttcatcttaatttataccaattgatcaatcttttccttaataattagtattttgttgttgttcctgacttactccatttttgaaactatattttagtattgacatttagatctacaatccacctgagattggtttttatatagtcccaagtatgtatcagtttttattttttctctatggaaatccaatcgactcagtaacatgagtggaagaaaactatccattctccactgttctgcagtatcgcttctgtcataaatcatgtccatatatatgtaggtctgtttctagactctcttttctgttctactggtcaatttttctatctttgtaccaatatatcaatgtcttaagacttactctaaaagtacagtatttaatacacagtagagtaagtcctcctacttcattttttcccccttaacattgttttggctgtgtgtgtgcatgcatgtgtgtgcacacaagggtgtgtatgtgtgtgtattcctgggctctctctcttttattggttcatatttctacctttgtgtcaatattacactgcctgatactgatactgcctaatgctaacgccttataattattgatattttgtatagtaaattaccttactttgctcagtttttttaattgagataattaaatatctctttctttctctcttatgtgtaatgaattatgtttgctggttttcaaaagtttgggtgtattcttggagtaagtttaacttggttatgatatatggctttcttatataacagtggatttacttttccatatgttaaggaatttttacatacagttaataagggatagacctttcaatttcaatccgtgtactgctctggtaagattttagtatcaagcctatgctgtcctcacattcagaaagattgtgttacactgatgttatatctaccttttatgtatgatagaattcactagtatagcctactgggcctgaaattttctttgtgttttctttgtggagatgataaatatggattacatgtatttagttgatataaattatctatgatcatgtctgttttgtcacattgtattttttataggattttttaatctaaaatttcagttattggcaaaaatgtttcataatttccttttgttattggtattggttttggaactcccacatctgccattttttggtatggtatttggctaattgtgtcctttctaattttgttttgtaaatcaatgttggtagaaagcagaaaatttcaaagaacacacttttggcactgttgatagtctccattctctgttttctacttcattgacttctgctctttatgatttccttcctttaactttctctgtgctttatttactcttttgtttctaaggtttttaatctaacatgcgctttcaggatagaaaattttttctaaacataaatttaaccatattcaacaagttctatttttcattattatctgttcaaaatattttctaatttcctttgtgattgttttctttggcctcagtggtatttagaattgcattgtcaaattcacaaatacacaggtatttttctggtcattttttaatattctaattttagctcaaattgagattgtccagaaaatattatctttaaacttttaataattttataggtatttaataataggtattgaaggtagatgccaggaaaggccaagtaactgctgaacaccataaagttgtggctgacctacattgatattatttacatgcttaccacattattacacagcaagttttaaacttgaacacgtgttaggagacagaaggagagggattaaataggtcaatcctgtaaatgattctctttcagtaagaaacttgaacacgcgttaggagatggaaggagatggattaaataggacaatcctgtaaattattctcttttaattctttgaaatatgttgactcaggctgcattgcccagcatatggtcaattttaatgatattttcatgacactggaaagtctgttgtttggtgaagtgttcttgatatgtgaatattgtcaggttttacacacacacacacacacaaatatacacacgttcaaacatatttatccacatatacacacataccacaaatatacagacatccaaacacatttatccaggtttataatacatttagaataaatataataaaacagtgaaatcatgtctatgatgtatgcaccttttttcttcttgagaaaatatttacacatattcttcaaatcctcctatctgtataatgatataaacctcatagacctaagaccaggtatggtcatgcagccaactttggggctttgataaagaaagctttgacaattttttgaaaatatcaatgatattccctatgttaagactatgggagaaaaaatggttcaacatttttagaaaccactggatattcttggattctgtatttagaagcaaactagaagctttctgggttaattacttcttacaattaaactgttaaaaatatctgagggagaatatagcttccaggaagctattcattaaatgataaaaataaaaaagcacaactgctttaataattctctaaaatttaatgtttggaaaaagtttgtactgttttatgatattaaaatagcaacaatagttattcactaacactttgctaatgaactcatttcttataaatgaaacacattaagatatcaaatatatttatttgatctttgattatgacaactgaaagactaacataaaacaatatatatgaactctatgttttctttccttactatacaagcaatataagctcattataaaattttataaaaataaacaaatttacccaacatccacacttggcttttataattatatcaattgacctaaaatataggtcaataactatatatctggatttattttctggttttcaccattttctcttatatgactatatcactatttaagtgaatcccattattgtctatttagtttattttttgaaattatagaatcaccaccacaattatgtagtaattaatacttgggaagtcatctcacccttgtttagttattttctcataaggaaaatttattcactacagatgaattattgaatcaaattataagcaattttaatgatttgtcatcaaattgctggcctgctctgcaaactttgtacctgttcatctaaaacctacaattacataagccaattccttgaaataatttttttaatataagttttctgttagttctgtttccctggtaagaccctgactgaaattttggtacctgatgtatggagagtatcaagatgactgaatttttgactcattgtacaaaaatatctcttatattttcttatttgaagctgtgttagtgctgatggagtataaaatctgactttttaatcggagctggtcctgataatagtttctgttaaaatcacaattcatgtctctctcaaatagtattagctgcatggaattcagttccttaagattttctgcagaacagcaatggatcaggtgattagcctttgactatcaactctaagctagagaattgctatgatttttgaaataaataaatgaacagaagaaaaaggattttggggaaaagtgaatatatcatgagggaaattatttatagatatattgcatttgaggtttttccttgaaagttaggatttttgttattttagagaatttctattcattgtcacagaaggtagtcagcttcaccatcgggaatactattatctatataatagttgtgcaggttttcacctttggataagtatgggaatttttctttcatacttaaaattcttcatggttattcttgttttcaaagatattatcttatctgaaataaattacccattgtaaatgaatacaaggatggcacatcatcttttctcatacatatattcagagagctggcagctatgttgcaggaagatgaaaggtaagcacgcctccattatacctacgtaggccatcaggttttctttgtcatagatgcaattctaatatttcatctagcaggttgttattttattcaagaggcacactttttaacagcagttgtatctttccccttaggcttattagagcagaggcaatcttgtgctgattgtgctcgattgaatctgactgaacatagaaaaacagtcctacaacattattgtttagcatttgctgatgaacagtttgcttagctcaccatgcagtgtaaattttttccatcaaggctttttaaatgctttctctaaaatcagcaccgagggtgctttaaaggtcaaatgagcagaatagtttttcttttttgcataattgtatgtaaaactctcttgaggaccactggtgtttgaactacctttaattgttcttccaaacttacagtgattgttcaggtttgtcatttggactgacataacggtaatcactaactactctccactaaatagagtatggaagaaaaatttagtgagccatgaattctatccattaagtttatgtattcagagtagatgcctggaaaggtcaagtaactgctgaacaccacagagatgagggtgacctactgtgatattattcacatagctactgtatcattacacagcaagttctaaacttgcacaggtgttagcaaagactaaggagatagatgaaataggcaaattctgtagataaatattcaaaaaggcagaaaatagcaaaattccatcgtgttggaaatcaactctctcatctgatcatttttgagcattacaatcgtcaaccttcagaaattactgactcaaatcttaagcttaacaaaattgttcttaattgaaagcaataaaccttcctataaaacctgagtatgtgtgtatctactttgttgtttatcacatttgcattaaaaaattgattccatcagtcataaaaatataaaggaattagtatgaaataaaagcaaatgtatgcttttaagaaagattcaggcctgtaagttggctattcccacaaatataaataaaaattataaacatcaacttagatttttgatgaagacacactttttttattgatacatgatacttgtacatatttatgggctacatgtgatttttggggcaatatttttatcttaacaaattaccccatatatctacagatattttatatttaagtaaatataaaatatattcattagcttaaaaatacttattaaactgcaactacaaattgatttttaaagggatttaaatagatatagtggatatttctgttagggagacttattcaattctcatatttattcaagtaatttccacaggtgacatggaactgtccccagattccactatatcttgtcatatctctgaaaaacttaaaatgaatttcctcacttaaaactttgaatggtagactattgccaaaagaattaagtctaaacacgttcatttggaattcaagtccccatgtttcctgtttaggcttttcttatttggttatctatatctatgacagctcaacaacagaaattttatgctgtacttgtcagtctcttagttatcttaccatgtccactcgtctatgaattcttctggccctttgctgaatcctgtttccccacttgccaaggtttttattttgccaactgatatattacttataattaagactttatctaagatccacctattacctaaaaagtttctaatatttgcagtcttagtgatctctttaatgtctaacaccattaaagtgtgccactcatttttgcattcaattacatattgctttctccttttatgtgattgtatgatatttatgttttgtttctccagtaaaaaaataacctctcaattggcagagttgtgatttatccatctttgatttcttaataaaacttaggcttttgattaaggacttagaaaataaaattttgagttttagttgataggaaaaactgtgttcctagaaatgtaccacatattcccttctatcctaaataaatgtgtttctaaggtagtgaccttttcatttgcaggaagccatcaagttgctaggtgcttaaatggcacctccttctatcacagattgcttctggtctttatgttaggatcagatcattcgtttgcccatggggcttcccactggcaaagtaactgtttgcattcattgagcactagtcagatttcctaacattgacaggcaattgaacaaagattagctaaaaattttgaattcaatattaaaaataccatgcaattcaattgttctctggcaaattctaaagtaaagattattctggttgatttttttcttttagggtacatactcttaagaaccgtgtaaatagaccttctttttccttttgtgtttgtatgtgggacaaaaaatatttccatatcgtgttatgattcttctgaaaggactgctagaacttcagatctttccactgaatagattttaaaatatgtttttgcatttgtgattgagattaattatcagtgatatggttaatactccacattaatcattgtgattctaattatattatatttcaggagctgtaaaacaatactcaataataaaataattgacattagattattaaatactaagatcattgaaaatttaatcaagaacaatatatccaattatcgttatcattataagcaattaagccacatctagtaatattcccttgagataaaatatagactttataaaaagaaaacaccaagagaactaggttaatttagcatacatttatattttatattatttggcaaaattgtgtaaaaatatttaaaaatatggtacttgacaatttatgaatattcacaaaatatgtctgaaattttatttttcttaatcattaaaaggataaaaaaaacaaagtaattttttttttctgagatggcgtctcgctctgtcacccagggtgtagtgcagtggtgcaatcttggctcactgcaacctccgcctcctgggttcaagcaattctcctgcctcagcctcccaagtagctgggattacaggcatgtggcaccacgcccggctaatttttttgtatttttaatagagatggggtttcaccatattggccaggctggtctcggactcctgaccttgtgatctgcctgcctcagcttcccaaagtgctgggattacaggcgtgagctactgtgcccaccctgaaagtaacttttaaatttaatttgctagatacttttcttcctatcatgggcaatcctgaaaagaatattgggtcatgttgtgaacacctccaagccttcctcagatcagcaagaacaattcaagaaaacaccagaagtagaggtgataaagcaagactgcttatgtagagaaataaagggaagatcaaaagacaccttcaaaatgacatgtgtaatgcaattttcctctgagaaactggattttttcagaggaaaatccagttttttgttcgtgaatccaaaaatcagcccactgggtggctgagatgttgggagcttgtgtagggcttaccttgaaagtgtatttcttatattctgtgctgggggtggttagcctattacagtttcaagagtgatggctatttaattatgtaaaattggggagtaaatccctagtcagattagtcacataattaagtttgataaagctcaatattatagttgggcatttttagctcaatctagttgcatatccacaacaactcataaaatctattagccttcaacaatgtcactggagcttttaggttactttgctttaacacatgagggataaaatagacaatgaggcatactcatttgaaaccatatatgctgttgattcatctgaatttaatttcagaaacacacaaattatttttgttccctagtcctttttctaaattgtaatatagagtgtgagagtgtgtgtgtgtgtgtgtgtgtgtgtgtgtgtgcacgcacgcgtgtgagcttttaagaggaaatagggaaagcctggtctttggagtaagaaaggctccatttcaaatcccagctttaccatttattatctagcagaattttactttttatttctcagataggtattttaaaatactaccacgtgtcaggcaagacagtccacgctggatgcaagattaacaaaacagcattagggtccttcttttgtaattcaaatctcaagggagaggacaatatgcatcaaacatcaagatgcttaatggggttggggactgatttaatctgaaatgtcagggaacacactccaaaggaagtgagatttgagatggagtctaaataataaataagaatcagtggactggcagaattaggtaagagtgtgccaggcagagggaacagtatatacaaaagttcttgggggcagaacgtaagaaggcatgagttgaaataaatcctgaagaattgatgcagaatcataccatgtgtgggaacattgatggggaaaatgggattagagaaaaagtcaaggccacttaactttttttaacactcttatttattttattttatttattttaaagttctggggtacctgtgcaggatgtgcagatttgttacatacgtaaacgtatgccatggtggtttgctgcacctatcaacacatcacctaggtattaagcccagcatgcattagctatttttcctgatgctctccccgactattcccccaacaggccccagtgtcacattcagttttcacatccatgaagtgacatgtctaaagttattgctaaaaatgtatatcttaattaacccatcctttcattgtcaaataggagacttgggaaattagaacaaagttaggtgttcagtggatgttagttttcttcttaaagggagtttgttttgttctggtttggagctatttatgacaaacccacagccaatatcatactgaatgggcaaaaactggaagtattccctttgaaaaccggcacaggacaaggatgccttctcttaccactcctattcaacatagtattagaagttctggcccggcaatcaagcaagagaaataaataaagtatattcaattagcaaaagcagaagtcaaattgtctctgtttgcagatgacatgattgtatatttagaaaacgccatcatctcagcccaaaatctccttaagctgataagcaacttcagcaaaatatcaggatacaaaatcaatgtgcaaaaatcacaagcattcctatacaccaataacagacaaacagagagccaaatcatgggtgaactccctttcacaattgctacaaagagaataaaatacctaggattcaaacttacaaggatgggaaggacctcaaggagaactacaaaccaatgctgaaggaaacaagagaggaaacaaacaaatggaaaaacattccatgctcaggaataggaagaagcaatatcgtgaaaagtaatttataatttcaatgctattccccatcaagctaccattgactttcttcacagaattggaaaatactactttaaatttcacatggaaccaaaaaaaaatcccatatagccaagacaatgtgaagccaaaagaataaagctggaggcatcacactacctgacttcaaactgtactacaagttcacagtaaccaaaacagcatggtactggtagcaaaacagatatgtatagaccagtggaacataacagaggcctcagaaataccaccacacatctacaacaatttgatctttgacaaacctgacaaaaacaagcaataaggaaatgattccctatttaataaatggtattgggaaaataggctagccatatgcagaaagctgaaactggatcccttccttacatcttatacaaaaattaactcaagatggattaaagacttaaatgtaaaacctaaaactataaaaaccctagaggaaaacctaggcagtatcattcaggacataggcatgggcaaagacttcatgactaaaacaccaaaagcaatggcaacaaaagccaaaattgacaaatgggatctaattaaactaaagagcttctgcacagcaaaagaaactatcatcagagtaaacaggcctcctacagaatgggagaaaatttttgcaatctatccatctgacaaagggctaatatccagaatctacaaagaacttacacacatttacaagaaaaaaacaactccatcaaaaagtgagcgaaggatatgaacagacacttctcaaaaaaagacatttatgcagccaactaacatgaaaaaatgctcatcactggttattacagaaatgcaaatcaaatctgcaatgagataccatctcatgccagttagaatggcaatcattaacaagtcaggaaacaacagatgttggagaggatgtggagaaataggaatgcttttacactgttggtaggagtataaattagttcaaccattgtggaagacagtgtggcgattccttaaggatctagaactagaaaattgacccagcagtcccattactgggtatatacccgaaggataataaatcattctactataaagacacatgcacacatatgttcattgcagaactgttcacagtgcaaacacttggaaccaacccaaatgcccatcaatgatggaatggataaagaaaatgtggcacatatacaccatggaatactatgcagccataaaaaaggatgagttcatgtcctttgcagggacatggatggagcaggaaaccatcattctcagcaagctaacgcatgaacagaaaaccaaacactgcatgttctcactcataagtgggagtttaaaaatgagatcacatggacacagggaggggatcatcacacactggggcctgtcatggggtggggggctgggtgcgggacagcattaggagaaatacctagtgtagatgacgggttgatgggtgcaacaaagcaccatggcacatgtatacctatgtaacaaacctgcacattctacacatgtaccccagaacttaaagtataatttaaaaaaggaataaaaagggttcatcaattaatatggaagataacaccatttatggcaaaacagaggtgctggaatatcttggtatacttgatgctaatgaaagaagtggggcttctaattcctcacaggtgatattaagccagattcagtactatacaaatataaattgttttcaaggaatgttttatatgctattttaagaattagatacatacaatttaaaatataactatatggtattagcatatatatgtacatatatgtgtatgtatgcacacattattatcattattattttagaggtggagttttgctcttgttgcccaggctggagtgcaatggtgtgatcttggctcactgcaacctccgcctcctgggttcaagtgattctcctgcctcagcctcccgaggagctgagattacaggtgtccacaaccacgcccagctaattttttgtatttttagtagagatgggctttcactatgttggccaggctggtctcaaactcctgacctcaggtgattgacccgcctcttcaagtgctgggattacacgcatgagccacggcgtccagccgcacacattatttttttttaaaagggaatacataacagaggtttaccataaattatctttggagtattatttctccttattctgctctaaacctttggagaaggaatggtttaatggaagagcaaatggagaataaataatgagttaataataaataaataaataataataaataatgagtaataagaaatgttttctcattactatgtgtttgaaacataatgctttatagttcaaggcctgtaagacctttagatataaaatataaatgtgattgtgactgctacataaaagaaagaaaaacattaagtcacactatgcaactcagcctccctccaatcacctgaggagggagagaggatgcctaagaacaacatgaaggacaattctgtgaccaaatatttttaagtacgctggtacatatatttccacagttttaaaaatctgaatgcttaaaggaggtgtatatctgggaaagtagtgattccaagacttgagccccagctggggtacagggatagtataaatcccaacacagggtattctcctaaaactgagtttgtcttttctagaaagccctgcataacatgtatttctgtgagaaaaaatacaatatagaatgtattcattctcctgtgagaagagatacaaaaaccaaacttctgtagtgtctgtagggtacagagaattggtaaactctgaaattataccatagtcaatatgactcttttgttttttcttccaacttgtattaggttggtgcaaaagtaagtgtgatttttgctatgttgagggcatacatgtgcacgcttgttacatgggcaaattgtatgttgctggggtttggtgtacaaatgactttgtcacccaggtaataatcatacaaaccaataggaagattttcattcttcacaccctcttcccattctcaaccttcaagtaggccctgtgcttattgttctttttgtttccaagtgtactcattgtttagctctcacttataagtgagaacatgttgtatttggttttctgttcttactttaatttgcttgggattatggcctccagctgcatctatgttactgaaaaggatgtgatttcattcccttttatggctgcatagtattccatggtgtatatgcaccacactttctttatccagtccactattaatgggcatctaggttgattccatatcttttctattgtaaaaagtactgcaatgcacatatgactgcatgtgtttttatagcagaacaatttatattccgttaggtatatacccagcaatgggattgttgggttgaatggtagttctgttttaagttctttgagaagtcaccaggcatgccagactccaaaagcaattgtaacaaaaacaaaaattgacaagtgggatcaaattaaactaaagagcttctacatagaaaaaggtgatccttgagagcataacacagttttgtttctttttctttccattcaaagagctggaagtttaatctagcaaaatgcgaagcaattcttaccaagacatggccacaaatagaccatgccactggtcatgaggctttggttgaactaacttcaccaattttatatgttgattattagaatctgaaaaaatgctcttattattttgggcgcattggcttgtttcagaaagtagaaagcaaaatgaaacctgagtaaaggtaagagatacatggtttttgttcagggaagctagtaacacacactatggtaatttgttgatatatcaatttatgttgataggtctatagggtctcaagtacatttatgcacattttgataaatctaaatttttttaaagacatgtactatgaaagtgctcttagtgaggatttatttgggagacaaaaggagggaaaacaaattaatttatttaggggtaagtttatattttatatagcctgggtttaaaaaatccagcactacctttaaaagtaactagtgattcttatcagtagaggggaacacagacgagttactcttggggcatttataattgtaaaaattagggcattcatggactcttaagatttaataggactgtgttagtgcagataaaaaaagagattcagggcatttaaccaggcaggacccatgagtctgtgaattaacacaacattttagggtcctggctaacattttatctttgcatccaacagtcagattctgttctgcagcattccctgatggctgatggaaactcaagttaaaaataaaatctgatttattatattttcttaccatggaatgagagtgaatcctcaaaatagtatctgagactgaatatgatttttattatacctagtttcaaggttttactaactgaaaatgagtcgcattgctatcttgtcactattgggaatcttcatgtccaatgagccttttacttccactgaagcaagaattgaaactgtctctaaggggaaaagatggctaataatcactgccattgaaagacaatcttagttggatttaaatgaaaactaaatattttttattatctggttccaaatgccattctatctttctttcacagtcatatttaaatctaagaagcccaattcattgttgtgtgtatgtatttgtgaggaaagcatgtttataatattttcataaaacatgaaaaattctgtctttgtcttttagagtaatatgacaaataaaacacatcaactctagccagaacattggcttgactgaaatattacatggtcaccctgatgtgtatatattggtttttactgtgtgtctatgtactctcacctactatgatgataaactttctgtgcactgttaaaggacactttctttcctcagacaaaatctgtaacatttatgctgagtgaaaaacattagaattttggatactcaaaatttttagttgggtagtaatctttattttaatcttggttttaactaccagcataaagtttaatcagcttttaagaaaatgtggactgttttaagtctttagaagctcaagatgaatgattttacacattacaaagtgtatgtgtggggataatcaggagagaaacactgaatcttccttaaagggatgttgaaaagccatagttctatttttaagtatgacagctatttaatgatatattgaagattttatataaaaattaacctgaccattcacaaattataaaataatggtttatattagaagttagagagaaaatgattacaatacagcatcatataacaccatataggagaaaaatcttgacaatccataaaacataaaacagtaacaagcagaacacaaattattgaaattaggttaaagtctctcaaatttggagaattaaataaaagacacatgtgagaaccaatgactcagaagtaagttggcaaagttagatcatacaaatggaatccaaaaaatcaggtcaagcattagcattcagtagcaatcaaaattcaaaacagaaaataagacaattaggctcatacatttataaaagtcacaaagcagtttaaatatataaaataggctgagtggcatggctcaaacttgtaatctcagcactttgtgaggctgaggcaggatgatcacttgaggccaggagttccagaccagcctggacaacatagtgagatcctaccaatatacaaaagtttatttcaaaactagccaggtgtggtggcttgcacttgtagtcctagctatttaagaggctgatttaggagacctccttgagcctaggagtttgaggctgcagtgagctatgattacgagtgtatatgaatatacacatatatgagatacacatatatgtttgcatatatgtatatttgtatatatgtatgtaatatatacacatatatatgtatatatgtttatatatgcatgcatgtatgtatatatgtttatatatgcatgcatatatgtatatatatacaagtatatataaaatgataaatgtgtattagtaaaatctgttatgaattcaagaggaatgaattgatatccaaatatagcctagaaatttaatacttcattactagattatgaaataaactgaaaaaataaataatatagaacatttgaaaaatatggccaataaaatgtaattaaaatctatatatcaaaattttgcctatacacagaatatacataattttctaatatccacagaatattttatatttgttttatattttgcaatcaataatattttggtaaattttactaaaagcacacaaaaattaatcattctttgacaaactagtgtaagaagttttaaagaaaaaatgtgaatagcctatttaaaacaattgttcccaaacaaataatgaagaatgaggactcaggcaatttagactgaggagatcttgaaaggtctttgttagtatttatttatctaatgctgtgtctacctaattatatcagatgaatattggggttggtagagatatataggaggatgcataagtatagaagaaaaggagaaggcatttgagatgctgaggatgttaataatggcaaatttgtttttcaaaaatagtaaaagttgatgtctagtaatatactcatttaaaaattttttttctctcttttcctgaggaacctcaagtgtgtcagctgtgaagcatgtactgtattcttctggtggaaattagcatggccactatatcacaaatggatattatcgcaaaagttaattgtattactagttctgtttaaagataaagaatcagacatgtgcaattatcttctatcacctctgcttagtgagattcaactttctttttctttactatgaataaaacaaactaaaaattcacaaagatatacaaaatgcacgtgtatataagtggatggtaaagttaaaaaaaaatagagacaaaattttggatggagaagtgctaactaatttagccgaatttatgatgcatgcctgtggaggaggatactagtagaagagagccagcttattccacaaaactgctaaaaggccaaactcctatacaggctgcaaggagcaggattaaaactatggatactagttgaagcttatgttcagggcaagtaaattccccttcctcaccttgtgcagccatatattccccactctcccttaaaggagattagatatttatcccctctactctgccatagttttggcagtggttctgattctccaccctccaaactcctgtcagatagtgccttctacagagctccaagatctaggctatggtcatacttcctccttctcaggcctgcagttggtaatggcttctcagccatcattagtctcccgatgcttcccttgccaatgtccaaacatctataaattatcttttcattaaactctgtttaagccctttgagtataaatgtatttgtctccatctgggaccatgattgatacatcagagaacagacaaaatcttcaaaaaactgtaattgaataatatcctcagggagaaaacagaaggctattcttgtccaaacaacaacaacaacaacaacaacaacaacaacaaaaacccaaaaaaaaacctcccctcccaaaaaaaaacagtatcaggaagaacacaaagtacagaaaatatcgtaaaggttaggacaaaagataaaaatatagaaaatcaatgaaataatttaagggactaagatactagtactgctgtaccatgccacaaaggcttatgggaatccagcagagtgaaagataaaagaaaaacactaagtacatgctatggtctaaatatttgtgtcttcccaaattcatatgttgaaatcctaacgcccaagttgatggtattaggatgtgacatgtttgagaggtggttaggtcatggaggcagattcctcatgaataagattagtgcctttagaagaaaagtctgagagagaccattcaccttctccaccacataaggacactatgagaaggcgtcatctctgaaccaggaattttgcccttaccaatgactgaatcagctggttcctagatcatgtacttcctagccttcagaactgtgacaattcattttctgttatttataagctacccagttcatagtattttgttacagcagccaaaatgaagtaagattgtacaactttgtgaaatttcaggagactaaaaatagagaagaaaccttaaaagtttcctgagaaatgaagagaaattaaaagatatcatatacaaataaatatctgaaagttattagatatttcataggaacacaggatgctagaaatcaatggagccatgccttcaaaattctgagggaaatggttcacgttttgtgtataaatttgtgtaaaattaagtttgagggtagaacatctagatatacataaagatgtggcaagattgtcactttccaggcagccttgattcaaaaacctaatatatactatgttccagcatcttatatcagacaaatgaaacaaaataagtaagagaaaataagacattcaataaccatttggccaaacatagaagaatagcaaagtgaagtttcattgctaggagccataaagtaaatctcatgaagagttaaaaaaagataagcataataaaattatgcaaataataaacaaggacattatttactgggcagagggtggtgaggttataagaaaaggaaagctcactgtagtataatacttggctgtgccaaacatcagcatatgccatttataatggtttatactttgcccgttgcttttcaaacaatggacctaattttggggatgatcaagcaaaacaatcagggttgatgtaagataggtaaatcctcattcttcataacaaaaagtcagtgataattttggaaatgaatacataaaaatagtaaaacacactttttacttggaagtatgaatattgagatacagaagaaactcctgaaaatatataggtaattacctttgaaataaagtaggatttggagaggatgagtatgtctctctctaattttctaataaaattacagatgactttgatataaaatccagtgcaaaaatgcaacaaacacaatagttgtatgaacacaaacacaagaataggcaatatgtgactagaagaaccacactggcgaagaaaaaattctgggtgttgccaaccaacaactacactaaatggattgtagcacctttagcatctggtggcaaccttggtggtgtttgaagtacactgagagccacacaggtgtttttcatgtaactataggtaaattcatttcaaacaacaacataggccttatgtctttggacacagaaagcacaagttccacaaggtcacatggcacccctgtattttcaattctgctttttgtgatgctctaaaaaacaataaatgttttattcaaactgcatctatgtagcttcccagtcatggcatcactggccatgtttatttgagactaaatgtcatcatggtttacattctctctgtcctaatagagaattactcttggtgagaacatcaagcatgctctgcctgtatcacattgctcttggatgtgttatgaatgagtctgaggcccattctgagggtacaatgttctgtccatatgcattaagagtaaatgcttcagttactgggagaagttcatatgttccattattttaagctgcaaagtgtgggattttttattgacctattttgaaagtatgcttactcaataaaaattgctagtgattttgcagtgttcttcaaatcataaggcataaagctagatgtttttaattgcactttagcatctcgtaaggaaatgctctcaagcctcagacaaatggtaagctgttgtattccctttggaaaaacttcatttgattatagtagtatttctctttctcctaaatattaaaataaagcaagctgaagtttctaagctttatagaaactatcacagagagttttgtctttcctttttaacatattggacaaaaactgagcttaatgtataaaaggctactttcagcaaagctgctcgtgtgctattccaaaagaagttggtctctccttggaaaggatcctagaaaactgaattggaggcagattttttggctaccttcgcacatgaatttcttcagagtagtggcagaaatcaatggcttccttaaataaagcactccagggacagaagaaatcatagcctggctcagttcctggaatttgtgtttttgcttgtatgatcattacttagcaagtactttcaaagtcaaatccctttttctacatttataatcaaaaagaataagaacctaaactcagatataaaattctgatgcttaaagtaattctcatcctggtgttatcaaatcttcattttctagtctcatctatggcagctgagcttatgccaaattaacaagagcagcagtaaaccactcaatttctgagcttattaaaattattccatattttagtgtatgtgaatgcatctctgcatgagttttatgagttctttataagccgttaggtctttttttttttttcttttcctctggtttgttttgtcttccttatattaactcatttattcacacttaattcattcatttattcattaggcaaaacttcataagtacttaatgtttatcactcaccatagctaagtgctaagaaattggaggtttaactttatttctgcatttttattttgaacttttttgagacattaatggtacatcttagtaaaattttctaagttccatccaggcacttgggtaaattttccaaatattactcagcataatatggctgtccttaggtaaaagataatgatacataacaaaaaattatcaatgttgataacctaataataatcttattagctaacatttattaagtgatactaaatggtttcacctattttagcttttctgatcctcagtaaacccaggaaaactgagaagttgtgggacttgacccaaattgcacagcaagtgatggtggtagtagaactctggttgtccaactcaagaactcattcttttcaagacaacattgtacggtactgcaataataatgacataatgttgactgaaccattacttcatggtcctggacacagtggtatgataattagagcttttatacattacagtgaaaagctatacacatatatttgtaattttaaaatgctcaagagtaaaaacaattacaaacatttattgagcactttctgtatgcaaggcatatgtagtaccttatactatatgaaaaattaccctctgcagcaggtattattattacctgcatttaacaaatgagagatttaaggttctgagttctttggtaacaggtacaggggtttacaatgggtagcagtgctagaatttgcttttaatttgcttgtttccagaaacttgttttaattggtatgctttacttcctctcttaaaaagtgaaaaccatttataccttatcaaaatagaccatttagatacatattgttggtggtgaattagattgcattgaataatgacaagtttctgacaattataaagcagtgacattcaggaagaattttttttatttagttgcatactagttattatttcaggaataatattttaaaaatctagtttttcaactctagcaaataatgcatattcttacctgtaagggttggctttttttttttttttttttgacagcgtctcactgtgttgcccaggctggagcgcagtggcacaatcttggctcactgcaacctcggcctcctgggttcaagagattcttctgcctcagcctcccaagtagctggcactacaggtgcacaccaccaagcctggctaattgttttgtatctttagtggagatgggtttcaccatataggccaggctagtcttgaactccagacctcaagggatccacctgcattggcctcccaaaatgctgggattacaggcacgagccactgcgcctggcctacggtcttgctattaatattattcaaattaaaatatttataacacaacaatgtttttcaaaaatgttttcatatgattgtttagattccagagtggtgacataggagaaattttaggggagacagggaaaccacagggtggggctaatagttccctacccaactcttcctattatctccaatccaggtctcaaacagaagaggctatcctttaattatttcatactgtagctatctacgtaacaccttgtttaaaaaaaaataactctctgcaaatttgtggtatggctatttagttcttcatgattgaatacacttgatacatattaaagtatgtatcttaagaagcttcagagtaatactttggaaaatcacaacctttttattttctaataaccagttctatgctatttcttatagggcagaaagcactaaagtgagttttttcttgcctttaagtctaaaggagtctttcctgtgttctgccctctgtgtgttcgaatgagaaaaccaggcaaaataggtctatttcaccagagaccagtgtgatcagatcacattaatatctacgtgattacctgcaccatctatgccttggcactgtcataaaatcacagggagagagaaggaaactctcattgactgaaattgattttctgttatctcatcagaatggggactagaaatgtaaattaagttgagatgtagaaaataaaattatatgtcttgcatacctgagttattggcagagattcctgtatgctgcaattggaatatatgactataattgagggaaggttctgtcccatggaaaaaaaaaagagtaagtttcaccagagtcatgctcctccactctattcccgactttggtttcaagttagatttatattgtgatttgatcacacagtccctgagaaaaggtgaggtatgctgtggtattaaggatgctttgtgaacggtggttaatattcaccaggtttctgcttccagaaatgtctggagtactgtgggggtgccagggtgtcagctgaactggaaaaatgcaagatcaaatagaacagccctgactctgactacaatttaaatattcgctatggctcccatctgagttcctcaaaatttcatcctggctagttccccacaaatcctctctatagacgatcataagtagctatattagtccattctcgtgctgctaataaagagatacccaagactgggtaatttataaaggaaaaaagtttaactgactcacagtttagcatggctatcatgagaatagcatgagggaaaccacctccatgattcaattacctcccatggggttccctccaccaagtgagaattatgggaactacaatttaagatgagatttgggtgaggacacagccaaatcatatcattctatcccgggcccctcccaaatctcatgtcctcacatttcaaaactcaattatgcctttccaacagtccctcaaagtcttagctcattccagcattaacctaaaagtccaaatccaaagtctcatctgagacaaggcaagttgcttctgcctatgagcctataaaatcaaaagaaagttagttacttcctagataaaatggcggtaaagggactgggtaaatacacttgctccaactgggagaaattggcctaccagaacaaagtccaaaatccaacagggcagtcattaaaccttaaagttctgaaatgatctcctttgaagccatgtctcacatctgagtcacactgatgcaagaggtgagctcccacagccttgggcagcactgcccctgtggctttgcagggtacagcatcccctcctggctgctttcaggggctggtgttgaatgtctgtggcttttccaggcacacagtgcatgttgttggtgggtctaccattctggggtctggagaacagtgtctttcttctcacagctccactagacagtgcccaagtggggattctgtgcggggtctttgaccccacatttcccttctgcactgccctagcagaggttctccatgagggctctgcccctgaagcaaacttctgcctagacatccaggcatttccatacctggtggaggtatgaaagatttcacacctagatttcatacctctgaaatctaggcagagctccccaaacctcagttctcgacttctgtgtatccacaggctcaacaccatgtggaaactgccaagacctggggcttacaccctctgaagccacagccagaactgtaccatgtgactttgagccaccgctacagtggctggaatgcaaggcaccaattccctaggctgcatacagccgggggagcctgggcctggcctatgaaccatattttcctcttaggtctctgagcctgtgttgggaggacctgctgtgaaggtctctgacatgccctggagatattttccccattgtcttggtgattaacattcagctccttgttacttatgcaaatttctgtagcaggcttgaatttctccccagaaaatgggttttggttttctattaacttctgtgcatccacaggctcaacaccatatggaaactgccaagatttggagcttacaccctctgaagccacagctagagctgtattttgtgactttgggcatcaaaggctgcatcatcaggctgcaaagttttcaaacttttatgccctgcttcctcttgaatgccttgccacttagaaatttcttctgccagataccctaaatcatctctctcatgtttaaagttccacagatctcttgggtagggacaaaatgctgccagtctccttgataaagcatagcaagaatcacctttattcccgttcccaataagttcttcctctccatctgagaccacctcagcctggacttccttgttcgtttcaccatcagcattttggtcaaagctattcaacaagtctctaggaagttccaaactttcccacatttttctttcttcttctgaaccctccaaactatttcaccctctccctgttactcagcttcaaagtcgcttccacattttcaggtatctttacagcagcacctcactctctgtggtaccaatatactgtattagtccattctcacactgctaataaagacatacctgagactgagtatttataaatgaaagaggtttaattaactcacagttcagcatggctggggaggccacaagaaacttaaaatcatggtgggaggggaagtaaacatgtccttcttcacatggcagcaggaaggagaagaacgagagcagtgcaaaaggggaagccccttaaaaaaaccctcagatctcatgagaacttaatatcataaaaatagcttggaagaaactgtccctgtgattcaatcacctcctactggctccctcccatgaacgtggggattatgagacctaaaattcaagatgagatttgggtggggacaaagccaaatcatatcagtggctatggttgaaggggagggcaatttaggatgatgtcatttctcattagtataactcttaaattatcaagcagaaataaatgttaattttgtctttcatatctagggaattttttttaattaaatacattcttctagtaaggtcaggctgacaagtaacaatttatctttggctcatgaatcatttaaagataatccacttcctaaatgctaaacacaatcagtatgctagttactcttctaaaaaatcaaaatgcacagattaagagcttgctctttttctctttctcaaaactaggatacaaaaataaaaataatcaccaatcttttgtaataacttggaaactgctgattagtgttttcaaatatttcagggagggagcgaagaagagagagagagcgagagagagagagcgcatttttttgtttggggggtgtgtgtgtgtgtgtgtgtgtgtgtgtgtgtgtgtgtgtagatcagtggttctcaaacagggattgtgatttttgccctctccatcctccccatcaagaaacatttcacaacaactggaacgattttggctcctcccaagtgagggaaggggtagaatccagagttgcagctaaacatcctacaatacaaaggacagcaccttacaacaaataattatctagccccagtatcaatagtgctgagctagatgattgacagatagatagatcgatagattgatagacagatgatagatagacagatagatgacagacagatagactttttttttctaataaagacatttaaagggtgcccattgaagggaagacttcatgttactcgaaacatgttaccttctttgttttgagaacagtcactcaattgcctcattccattaggcaaataagtgtggggcatctgtgcagtgctgaaagggatacagacaagccaagggcctatccctcttggaatatggataagcatgtatgttctactttgtagcaagaaataagggcaatggtggacaagggttgttaggtcatattgctattctaaatctgctgaggaccttcgtactttaaaaccttatggtacttggtcaattggaatggctgggatgcctcagggaggaaacatggaactttctgttgtgaagcctcaataggttgagtataaaaatattttcttagtgttatctttgaatcctgttttgctttttttattagaagagtctcagaagtaatcttcacatgattattattatcacattagtgtaatagaacctattaatacatttggtcttaattgttcttagaacgatggagtgagaggttaattattatgagcataatgtctatgttaatcttgtgctaccacttggtttaatattcctgtcaccttacaagtgtatctgagagtattcattactttcatttgtagtgtagatttttccttcagaataataatgtgcataataaatagttcattttatatagataacattttataactgtcttttaaaatgtaatacatgtctattaggactataggcatataaaatactttcttttttattttttggtttttcttttagataattttgttttgaaaatgttgaatgcctgttttgtaaatatttaattcatttattcattcattcaatcaatcactcagtaaggatttactgatttttctgcaaagcattttgttagatcttgagaatataaaaaagaataagtgaagttttcactctcaaagtactcagattttaattttagagtattttctcttcatggattaacaattattgatatgaaaacttattggaaaggaagtcaattcaattgtataaccactttcatttcaagtaagatgtcacatgctatacagattaatttgaaaccatcaaacctagaccattaagcaatttaatttcctagttgtaaaatcaatgtccatttcaaattcagccagctaaacattttaactataagtttagtatattcaaattgaaatatacacaatgtttctaattagttctaattactgacagacatgtagtaggtagtgtttcctaacattatagaatcgtcatgcctcttgaggtgatacaataccaacagaggaatcgctttcctttcacaggtatgttaagaaaccaaattcttggccaaagcaggcggatcacaaggtcaagagttccagaccagcctagctaacatggtgaaaccctgactctattaagaatacaaaaattagccaggcgtggtggcgtgtgcctgtaatcccagctactcaggaggcagaggcaggagaattgcttgaactcggaaggcagaggttgcagtgagccgagatcatgccactgcactccagcctggacgacagagcaagactccatcatgggggaaaaaaaaattctttagagttgccaatgagatcaccaatggcaagctttatataattctgaatgggtcacgttacttaagttgcttgtatataaacttaatatgaacacaatcacttttgattattttaaatgctaacatttcttggaagaaaatgtttattttagcacttaacctttcattttgcattcccttttaaatgctatcctaaaattttcaaccatttgaataaaattaagtttccattttagtgagaaagttcttcaataattaacataacatattcttcaactataaaatattatgatataaagtttgactcaaaagttgagttaatgattttatctatttaaaataaccacagtagtgataactcagctaaatcaacccccgttttcatatttttgacagtttacgacctacataaaatatgcacacagatataaaacatccagtaaacttcataggcatctgtttaaaaacagaaaatattttaagatatttgagaaagaaggaggactcatttaaaacactgatattttattatcaatattttatttaatacctatgatgtaccagatttttacccaggttattgtgagcatgcaaataatttcatgcaactctggagaaaaaaatatttgtgactaagtctaagcagttagacagcctagcgaccctactgaaacagaacttctgatttttatggctgcaccaaactgcatctgctttatttcactgcaaaccctgcgtgtttttaagacaacagatgtggctcactctaagattgcatttcttcccgtgctaattttctctcctctccaacacctgcccaccgttgaatctcaaatcaagtttcatccctgcctttcattcattatttaacatttatttattaatcaacaagttatgccccagttacacgctaggtgccaggtgtgtattcaaccgggaagaagacagagaaatccctgaacacatgaagcttacagtctggttaggaatatagaaaatcaatgagtaaaacaagtaaatataaaatgaaagtaggtgctataacagataacttgagaggaaaaattttagacagaacagttaaggaggatttacctctagagatgacttttaacctaaaatttgaagaaggaggaagaggccacacggaaccaatgtgggaacagaagagaaaaatactgaaaacgacacattattccagttggaagaagcagtgagattaagggctctggggtaaaaagcatttcagagagtcctagaagtaatggaatgtcaaagtgaatgcagcgtgtgagagggaggaagtcaggtattgggtgaggtcgaggaacacaggcaggaacacaaccatgcagggtcttgttggcaatgacaagaagtctggattttattttcagagtacaagtaagccaatgaagaaccttcaaacagggaagtgatttgatgtaatatgtttttttaaaaaacaccctggccatagtggctacaatgttgagaagcaggcaagagagaactgccagagcccaaataaaaaaatgatggaagcagccaggtgtggtggctcacgcctgtaatcccagcactttgggaggccgaggcgggaggatcacccaaggtcaagagtttgagaccagactggcccacatggcaaaaccctgtctctactaaaaatccaaaattagccgggtgtggtggtgtctgcctgtaatcccagctacttgagaggctcaggcaggagaatcgcttgaacctgggagtcggaagttgcagtcagctgagatcacgccattgcactccagcctgggcaacaagagtaaaactccatcccaggaaaaaaaaaaaaaaaaaaaaaaggaagctttgaccagaatggtttcagaggtgacagagaaaaaataagtagatgtaagacgaaatgttgaaaaggactttctgaaaaggcttgaatataaagagcaaactgatgagtaaaaaatgactttcattatataggtagacaatagtgttatttgctgagacaggaaaggccatggagggatgtgtgaatggggaaggaaggaaggaatggaaagtagagaagcgatgttaggagtaggagaccaggaattgtattttggatatgttaaatttaagatacagatgaggcatacaagagaaaatattaggtaggtgtttagatagatgagtctagaattcataagaaagttctatgctggaacaggcataaaaagagaaaaaataattggtcaccgagataggagaaacaccaacaacttactctttttgaagcagacatagaaaattacttcaagaagatagagtgtattcactaaaatgcttagtacaatggagacagaaaattggctttgtcaacatgaaggtcgtatagagtgaccattgtctcacactgcttagaataatttctgtttgtacatgttgtcccagagtcataactaacaacactcttttttatttttaaatatttatcagtttgaatgacaaaattctctactcacaggtgacagtaacaaaagctgtgtcagttgtgggaacatggataccagattggataggactgaatagtaaagaacaagtaacaaaatcaaaatctcatgtgtggcaaacttttgacatgttgactttgaagaggaacagaatcaaagtaatataagatctcgagaggtgctgtgttgcagctgagaaattttaaagcctttttttttcttttttttggaaatggttcagcagagagaaaaagatggataatacaagaaaataaaggtgatcctgaagaagagaagtccttgaaaatgtgaaaaaggatggagtctagcggttggcagaggggttggctttggatagaattggatcaagtcctcccagtagcaagagggataaactatttctcttaaaccctgtccttcagatatgtgaccattctgttctaaacttctataagcaacttatcatgccatgattagccacagttttcaaatggaagtctccagctatgctgaactctgactttttaagaattattctgtttctggtaattacagaatcactatttctagttattttttagtcaattatatatgagaaccattttgcataatattattgcattgtttcaaatgatatgaaaatcttgcaaagctttttctaaaaaaaaactagatcattgtttctcagctttttggctatcaagtgaaaaataactagatcaatttttcttttagcttaaatttgggcaaatttcattagcactgtgttttattgcagttagcatgataattagtcattaatggttagttcccttaaaaaataaatacatctgacaggattatctaggaatttacatttcagtggttcctagaagtattctgctagagaatctgtggatatggacttaatgtattcatttttattgacatgcagtgatcaatgaggctttaacaattaaagcaacatgcaaggtcataacagagagtacaccaaagcagcaggtaaccaacaactatagagaatgtcaacttggggagagactgatgtatataagctaaatgatatacagactgcattattccatgtaggctctagtcaattaactgtgaagacccttttggaagtgttccatacttcctaattagaatgctttgaaacttaactttcctattgttgtattgatttaacttgaagcttgctaccttcaatatgctctcattatatattaaaaaaggccatataacaaaaagatatttgactatcctttttgagaagatttgatgtaaacaaaaatatattaggtattgtaaccctgataatatacaactgaaggaagcaaatataggcttgacttttgattctgaagtcatctaaatgaacatagaatgagaaagcacatgaaagcaaccattatgtatacttcagaattccttttcacaaaataacttttcattaatagaaaaaacttaagaagtaacacaatgaagtaggatatgttcttttcaaactgaaaggaatttgatagtatttgtaaaatgacttgaattaagcattaattttctgaaataatgattattctaaatgtttctcaaaagtgagtttacctcccataacacaactgactttcaacatttgaattttctgacatctattgattcagtaaactaattacactatggtgatctacaagaaacattttaaagacttaaattcaaagtattatgtatctagcatttcaaaatgcactcaactggatcataatacaagttaatgagaattaaaatttatcactcaacaattgccttcaatattgcaagtttctcttaataagataaccataatctttatttttatatttacactgaaatatctcacaggaaggctttctgaaactgtggttaatataaccttgttttattttttagcaagaatattttttcatctctgttttcttatatgaaatactaaaattataaactatccactttcagtttgttttcaaactgtttgtattagcataggagacagttgacctcttggcaaagataagagaaaaatgaggcaagctagaattacagctgagtcaagtgaatcatatgcagcagaaagatttaagtagaaattttaactgtaggtcatttatactagaacctctcttatcaggttagagtaaaaaacatcatcaaaaacaagacatatttcaggtaaaattgaaggacacgagtaatcagtggatacctgttgaagcctatactatgatatgctaatctttgtttccataagttgttgagcctctaaagggcatacatttgtatggctcagtaaatgtcactaaattgccattatccaattcttactaaaagcatgcatttggcagaaataagccaattatactttatgatattgtctatttctagcctatattattatcttgttttaaaaagtgctttcaaaatatattttgaaattatttttgctgaaagaataagactcaggcctttgacttgtgtatactttgaatttttatatcccagatatatgataaaatgcctgggtacaatagcttcccagtaattccacataaatgcagctgctatgtgcttcttttggtaacatctgccctttttgatcaaaatccaaccaaaaatattctcaaaactcttgaggtccagacgacttatagactgacatcagctacataatttcagctgaacttccacagaataataaaaaatatctttttctagagaaaaaaaccccaaaactctgatgttaaatggacgtatcaagtaaaaccaaaattactctatgctcctctgatttgactaacagtattaataatagcagtatattttgttagattaatttcagtaattttataataggtaatatgttttcaagtaaaatgatgggaaatgtcctactttttaaattattttgtgtttaaaaatagcccctaaaaggtgattggtaaccaatttatcagagcactggaataaattgaattaaaaattacaggccaggtgcagtggctcaggcctgtaatcccagaactttgggaagccaaggcaggtggatcagttgaggtcaggagttcgagaccaggctggccaacatggtgaaactctgtctctactaaaaatacaaaaattagctgggcatggtggcaggcacctgtaatcccagctactcgggaggctgaggaaggagaatcgcttaaatcacagaggtggaggttgcagtgagccaaggtagcaccactgcactccagcctgggtgatggagcaggattctttcttgagaccctgtctcaaagaaaaacttaaacatggttaatttctattctaattaactggcctatataggttacattttaagatcctcttttcccacgttaaatgatgaaatttcactcctactctatcttttgtgttaaaggaatatataccacttggaaaggaagagaaaaataggtttatgatacaggaacaattccttggatgaataattatcatttaaaatgaaaatcaattgttcattttttattttgttcaagttaaagtaaaatcagtattccatggtcatgtttttcttgacactgctgacaggggttaattaaaagattaatgggataatgtacacatttcattagaaacaaattttttattttttggaaagtagttaaatagctaatttttgtttgtttggttccacttcactgattttccagcactctgagccaaagtattcccgctctaattgacacatgtcctgttcttggtttcattcttaatgtcttccaaatgaagtgcaaaacttggatgcttactctagtgataatgtttccattgtctttgttccaattgttactaaaatttgtggtttctttcagactgctctgtgttttgaatgcacaatttgctgcatttttataatattttctaccactcaaacacataagaaggtatatgatgtgatgatgaaacaatttttcattcctaggcattatgcgccagtacgccgggtgaatcctggagtagtttaatggaaagtagaaagaagcaattatttaaaacatgtaatctgacatgctaagcattttgatgaagttataattatttaacagataaatagcgtatatatcagtacatattttgtaagcaatgcaataaaccactaaaaaccaagattaaaagaaatatgagcactttggttcaaattcaactactaagtgttataaattgtgtttactgattttttgcttttatcctaaaggtagacagttatattttcccttatagaaataattctcatcttgtttattccactttgttttagctgatgtactcttcctcgtgggtgcaaagctagaaaaccttttccagcttcccttgtcatgaagtgtctccatgtgactaatctctagccaacagaatgcagaaaggggtgggatttgccacttctagtcctgccccattaaacctttcaccagtccttcaccatgctgactggtggagaattcattttctcagcagaatatacatggaacacttcaacaatataatttgagtaaggttaaataaatgaacttttcacaaagatgtggtcagagagtagaaaagccacaaaggattgtacagaatgccaggaccacaacatagttactctgacactatctctacatctaaagactagaggaagagaggagttatcagaacagagtagagggccatttgccaggagcaaagaccttgactttagggagagaaccaacccatgggacacaacacaaggtcaaaggaatacacattcaggctttaccctcctgcctccctatttttttgatatgaagaaagaatctgttctagacctttctctttggcttgaaggtggctgtcttctgtcttcatggtgtctatcttctgtatgggtctctctctatgcccaaattttctctttttataaaaacaccaattatattttgttaaggcccaccctgatgaatttattttaatgtgattacctctgtaatgactctgtagctaaataagcacacattctgagctgctgagggttaacacttcaatgcataaattttgtgaaaacccaatttaatccataaaagagcccactaatttaatccacacaggtaaatctcagaggaccagcgcagaaagaaaagggaaacgagctgtagagcggatctggagaagcccagacattgagagtctattgggtactgtaggttagcctaccctattaaggacagtgagtactcctttgattatttatctgatctcttacttaaatatcctccagtaagactctattgcatacgatgtagttcacagttcttactgtggcatttgatgacctatacaacctgactaccactgcattttcatacccaattctcattccttcctacctaaataatctcaaattattaccttcctctcttcttttgataccagtacttaattaaggaacacccttctcctattatcatctaacaaattaatataatgacattcaggctttgtatctggttctgcatcacttgagaaaatatctgccagtgtgtggatttcattggtacatgtcagtcttctaaagtgtcatgtcatttactgtttatataaatcatatgccctttttcaaaatgctttgtaatttattgcatgtctaatgcaatgatttattgtatccaatgcatgtggatgactgtacataaacatagctggtaaattattatctcaaggataattaaagatgttctcatttgttctaggttatttggctttgcagagtttgtagaataggaaccacctgctgccaaagggccaaaccaataaattctccaggagacagttttagaactgacagagtgtttgtgaattacttacaaattaagatattgactcaaattaggatattgttgtcttaaatctaagacaagaaataaagtaattttttaaaattaatggcagtatttttaattggtagatacttagaaaaatctaaaatcccatagattaggaggtcagaaaagcctaacttaactctcttttaatcccaaattctacccttcttcaaggacaaggtagaatttaagcggtgactttaaatggaaaaaggcccataatacacttgttattaaaggcaaactcaattattatgttaatataattatgttttagtatataattataatgtaatatatattatagtgtaatatatgcaatgattataagtagtatatagtatattaaaaacttaatacaatacacatgcataattataactataccaacagacatgaataaaatataacatcagactctcatatttgtgctttacagaaaatacatgtgccactatcttcagcttctcagcagcaccttctaccttaatgttctacctggtggtgttcaatagtggagtgacaaatgctcacccatttgcattttgcttcatgacatactctatgctatttttctgccttctaactttactgctttgtcccattttgactgtccctttcattaaaatatgagcaccagctatagttaatttctcactaaaataatttttagtatgtgtgcttttagtatctttattatgccaaactgtatttcacctgattttaagcactccatattttccttcctgcttttgttattttaagcaatcacacatttctttttcaaaaggaccatcctgctctgcagaacagcttgtctttccttgttctcaaaaataatgagccaggttactttttcacagagcatatttgtttcgctttttctgagatagatcatcatgggcctagcacaattttgctgtcctttttcttcccagttctataagggtacgtaaggcaagacctttctcctatattcatattcaagaagaaagccatatttcaacaataacaaaataaaagagggtaaaactgggggtgaattgtgtgcacaccatttacttttattagaagaatatgtaaatggtcaaaaaattttagctgcaacattcatgaattgtgttcaactcataattcgtgtttttgactttttttccccaggactatattttaaagatactgaaaaataaaattaatggagcttcacttttgtactttatagatgataatcatggacaaaatatatttctataaattttttattacttcaaacaaaccaaaaacctgagaagaaatatttctgagtttagattatttagatcagatatagacagggtatcaactaatttttgataaaaataagaagcaatggtgtatgtaaattgaaacaaaattatagtcatataacttaaaagaaagtgattttttggttaagtattcttaaaagtgacattttgtaataaagatagtgaaaaatatgtattcttgggatttaaaaaatcttaaacatctaatgtttcttttaaagaagactagtgttttgttactttaaaaatacagactgtccatgtttagtaaaaacaatgatcaggtcaaggggcaggagatctgggttctaatcttgctcccttactgactagcaatgtgatagagaaagttgtccagcttctatgagtctcagctttcaaatatgcaaaatgactgctatgggttgaattgtgtttcactcaaaattcatatgttgatgccctagccatcagtacctgagaatgtgactatatttggaaatagggtcttcagagaagtaataagctaaaatgaggtcattatggtaggctttaatccaatgtgtctggtgatcttattacaagaggaaattaggagatagacacatacaaagggtagatgatatgaagacacagagagaatacagccatctacaagcaaaaggagacctcaaaagaaatcaaacctgttgtcattttgatctcagaattgtgagactaaattgcaattgtgagattaaattgcctgtagaatagtgagaaaattaatttctgttgtttgagccaccttgtctgccactttgttatggcagcccagcatcctagtaaaataggcattataagttttacgatgattagatgtagttatgtgtgtgtaaagcatatggtacatgttaattgtttagtgtgtgttaattaatattgttgtttcttctgctagtatttttactggacacatcatttataactcttatctttacctgatcttgaacatacagcagttctttcctggtgggggaaaacaggaattcaattcatattacatttctctagcatggttcatggggcctgtagcttcaaacttacagattttggagtgaaagcagccttgagattgtgtcattttctagttatgtcattatctgtacttaatctccctgtctctcagttttgcatctgaaaagtatagataattataattgtttataggaatacattcatatatgtaatacaattagtacttgatataaattcctgttgaagaaactataattatgattttttaaaaatgtatttttttactctttttcagccatgcctgaggccagaacagcttctgtgggttttccctctgtctcttcatgataccaatctgtcattctgctttattcaggagcccatctatgtccttcatgatttgattcttactgccacccaaggctcatgcacttgcttccctacagatgatggtcatccctgcccagggaaattattacctcgactgagatggcattttccaaagtgtactgcccccagcatttgttatttaggagattaaaatgatgagaaagatattaaatgtgtgtctgtgtcatggcacttttaagtatagtgacactaagcattaagaaaaaaaagaaaaaagatgatttattaaatagcatctcagagttcttaaaatgttcatgttcattttgagtattctgggtggggagtagatatgatgtaggctttcctcaatttatttgatgatacattattttttggtcaatcatttgtaagaatctgtattctagataatagaatttgggtagttctggcctaaggaagatagaacttccttaaaacctctcatttaacttttttcccagtctctgtttaggacttcttcttcttcctttttttttttttttcctttttattggctttaaacagatgtttccttttactaaataatctattgccagaaaataatttaatctacataccagcttatggctgtggtatgtgttttcagcatcactcaaagaaataaaaaaggtggagggaggtaaggcacataacaaaaaagcattacatctatattaaaaattaaaatttactaaaaatcaaatgagaaaaaggaaaagtttacttatcagattggcaaactgatttatttcagatgttcatgagcatttggggatagggtcaccttaaaacatagcttttgaaaatattaataatataccttaattactcaatctggattgtggtgggccattttaatttccttctttatgcttttctggaagtgccacattttctacactgaatataatttactttgttcatcaaaagaaattaccagtttagttgatttgttacaacagccatatgagaaaaatatgaggcttttatggatcttttgtaaatctccttatgtgagttcattgataatgtaatccctataatattcttttctcagtacattttttagaatatatagaaaagcttgacaaacattaattcatacacatgcacatgttaatactaatcagtataacctcaattttgaaatgacaagtacaatattgttagggatagcctttgctacttaatgagattaactggaaaagaaataattatcttacctgataagcagtgtatacttttgcccgttgtccactctaacagtagtattaatgcttttaaattttgcttcaccaggacagtaaaagtggtactgttgggggaaaaaattttgtcctcaaacagtttttcagcatgaaattaataccatatatttgcactggactttattatttatcaatatattttacatcactttggagagacatgaagtttgaaacttaaagagaagtgataactgaaggtttacaactgatatgtcctagatttaatacatacaaatatatgagtattatatagatataaatacacatgcatacatgtgtacacatacatgtctagattcttttccagtattctgaggaacatggttgagaaaagcaacatcctctactagcagaaagcaagtattttaggaattttccttacataacagcaattgagcaaggcaaagaatggttaatacaatctagagggcaatattaatgtcacaggaaggcaaacttcaagattgtgaaaactaaccattcattccaagttttttgagatgtcagggtgtctgggttcatttgtagaattactgttaatggcaactaagttatgatctagagaggaaaaatcatgtctatatcaggtatgattaaccaagtatccccaggaaatacatggatgtgctacattggcttattaagcttcttagcaagcatgtgcctacaggtatatggattatattgtgtctattctttcccagagaggggctttaatatttttattgtatctaaaagtgatctataacccacatgtgttaagaaactcacttgcattgtgtttcataacttgtgcccctagctgtatttaagttgatatacccaaatcctctcacatatagtccaaagataaagataatgctatatattttaactttttatgatatttgggccattgcaaaagactcctttcctttataagattatttattgtcagttgactttaaaaactccaataagaagcattaggaggaattattggagacttgtaggattgtaggtgaaaatattttatgaaataatgtattattaagactaatggatagccactactttccctatcaaatgggaaaaaaattaattcacaataggttaaacgaagatatttaggaaccataaaactaactagtgaatagaggtatagaatttctttccctttggttttatgaaaaagaaaggatatatacttacaagtctacaataattactattatttacttaattgtaataatttgtcaatctccatcttaagaaaatttaagatcatttacatttcagctagatgatcagagttcaaaactcagctctgttacttggaagttttgagacttcacatgtgctttgtgctaaaatctactcacttgtaaaatggggtaatacaaatttttgtgtgatttaaattggtaaatgaatgaatattgtgaagtaaatattataaatgggcaaataagtcaatcaaagtggaacacacagaattatacctgggacataattatatatgaaggctatgaaggctagcttttttttccttttttttttggctctatctcccaggcaggagtgccatggtgctatatatatatacatattatattacttcagaaacatgagcatttaaagaaagtcaaactaagggaatttgcctatttaaataataaggtataactcatcctttcatggaaattcacaacatgtacacttaaatcacatcataaaagaaatggtagcccaaatgctgttattatgtttcatatattagaattatataagttaattaccttattgtgctgagttattgcaatgatgattgggatgagttccctaaaccaggtattcagagcagggatatgagaaaatttgttaaggtagaatgatgttgggaaaagagcatgcactttcaaatgaagttggtttcaaaatgttattagctgcataaccttggacttttgaaaggttcttataacacttaccaagtgcaaagtcagcaatctcaaactttttgatctcacagtctctttgcattcttaacgtttattgagaaccccaaggagtttttgttaactcagttgtgtctatcaatatttacattgctaaaaattacaacacacatttttaaaatacaaaaatacataataaaatgatacattagcgattagagcaaggatataattgcatgtcatgtagcctctggaaaactctactatacacttatgagagtaaaagtgaataaggcaaataacaccccttgcctacagaaaacttacaaaaacaggttttctcttgaggatcctctaaaaatatcttgggattccctagggtttcccagactctacctgcccttaaggttataaaaatggtaacaattattatcattgagaaattaagaaattgggaaactggtcaataaagaagtagaagaaaagttgaaaataaggagaaaaaaagacaatgaatgttaattcaaatcatgtaccgtttgaaatattaatatctaaatatatataaactgatctatcagtatgaatgtaaatttttctccgtatagtatatgagcttcttaagaacactctcttgtcttctgaatgatattctaattaggtatattttccagaaaaaatagagaccttttgagcaaaatactctgacaattatattttttaaatttataaatatgtgattaatgaaatccagttagcttattttttgaataagttgttaaccactttatattattattaaatcagtttttttgcttaaaaatacttggttgttgttggttcatatatacatagaaagaaattataaaagtagaggaagagacatcctggtggtgagtataatatatagagttaagtttaaattttattttgaaaataaccaatgaagcacataattagaacaactttgtaatttttaaaaaattaaatgaactgaataacttacctttaaagtaccattttcaataaacaattgaataaaaaatccatctactaaatttgagtcttgcttgacatacagcagaagtccataggagctgaaggtctgaaattctagggagatgttattttgtggatttaaagccacattctgaaattctagataagaatctccataataacgaacacaactgaaatctgtggagtcagaaagaaaatacaatttaggttgaaataaatattcaatacctaggtttcacattattaacatagcatatgttttctctaatgactcatacgtctctttcctgcctctttcaagcccaggcacttctttcctttggaatagtcatggcagttttctcatgatttctttgtatttgatggcttcatgataaaatctcattgtaaggcaaggaaatcaagatgattactcttcaacactgcttttacttagattttatgttacaggttaacagaaaagggcacattttctaaatatgtacttatttcttctttatataagatattgatacaaattatgattaatattgttaataatttaatttgggaggtttgtgagggaatgctagagattattgagaggcatagaaattgttaaccttttgtattaacactctaaattatatgagtttcttaacaactctcaccttctgaatgatattctaattagctgtagattttcagaaaaaaatgaagacactttgagcaaaatactccacagttaaatttcttaaatttgtaaatatgtgattaataaaaccaagttagcttatttttgaataagttgttaactactttatattattattaaatcatttttttttgcttgataaatactggattgattgttcttggctaatgattcctgaaacaatggatttgaatatcgcctttcttccagttcctttcttcttttgttattttcatgacgtccccaacacaagctttctttctcttttaaaactttcgaattatgtattatttataactactagaaaatattatttataaaaccatgtgagttttagtttgctgtctatcacaggataatattcattttcgaatctgtactttaaaacttcaagaaattttatatcctatgtgtgctgtctttatttggaatttttaatgatgctttagaattactcattttgctacattttcaaacttgcaacaatttctaaataaataaccagcaagcctcaaattaatttttttcactggaaataaggttcaaaatagtgccaggaagcatttgcactttatagacataaaagcatgagtatatgtgtgtgtgtttgtgtgtgtgtttaatcaaggactgacttcattagtgaaggacaagttaatgactgaaaaaataacaatgtcctttcaattttgacattctaattttttcagttgttaaatgatagggacgtattttttttccccatgtagcgtttcaatggtgatgttaaaagcataatacaataacattttaaacaacaagaaattgttttaaagatttcaggcatttattttaacaaattgagaataaagtcatgtatcagtttgatttaaaattcaaattgtgaaagagcataaaatgttttcaaaaacaaacattacaagaagaatatacccaatattgatgaaattaaaaaaaattacatacagggggtcttcaaaaagttcacataaaatatgtattatttaaaaactatggatgaatttcactcatcatgacatgtctgaacagaatatatttgagttactaagaaggataagacatctgtttgaaaacagcccctatcggaacatgaattctgctaaaattgaagcaagaacaaatatcaaatttacgatgacgcttgggtgaaagaatggtaaaatcattgatgctttacaaagaaattatgtggacaatgccccaaagaaattcacagtttacaagtgaaaaacttgttttaagaagggacaagactacgttgaagatgaagtccttagtgactgaccatccatatcaattttcaagggaaaaattaatcatattcatgtcctaactgaagaggaccaataattaacaataaaaacaatagccaacactattgacatctcagctggttcaggttacacaactctgaatgaaaaattaaagttgagcaaactttccactcaggggatgtcaaaactgttgtgcccagatcagctgtagacaagaacagagctttcaattgcaattttaaacaaacaagaacaagatcttgaagtatatctttgaagagttgtaacaggagatgatacatggctccactagtatgatattgaacacaaagcacaatcaaaggaatggctatcaagaggtggaagtggtctagtcggagcaaaagtggaccagttaagatcaaacatcattgatatcgtttggctctgtgtccccacccaaatctcattttgtagctcccacaattcccatgtgttgtgggagggacccagtgggatatgactgaatgtttttcctgtgctgttcttgcaatagtgaatgggtctcatgagatctgatgattttaaaaacaagagttgccctgcacaagctatctctgcctgctgccatccatgtaagaggtgacttgctcctccttgccttccaccatgattatgaggcctctccagccatgtggaactgtaagtccaataaacctctttcttttgtaaatcacccagtctcaggtatgtttttatcagcagcatgaaaacagattaatgcagtaaattggtaccagtagagtgggcactgctgaaaagatacctgaaaatgtggaattgactttggaactgggcaacaggcagaggttggaacagtttggagggctcagaagaagacaggaaaatgtgggaaagtttggaattccctagagacttgttgaatggctttgaccaaaatgctgataatgatatggacaatgaaatccaggctaaggtggtctaagacagagattaggaacttgttgggaaatggagcaaaggtgacccttgttatgttttagaaaagagactggaggtattttgcccctgccccagagaattgtagaactttgcacttgaggaacatgatttaggatatctggcagaaaaaatttctaagcagcaaaacattcaagaggtgacttgggtgctgttaaaggcattcagttttataagtgaagcagagcataaaagttcagaaaatttgcaccctgacaatgcgatagaaaagaaaatcccattttctgaggagaaattaaagcctgctgctgatatttgcataagtaatgagaagccaaatgttaatcccccaagataatggggaaaatatctccaaggcatgtcagaggtcttcatggcagcccctctcattacaggcctggaggcctagaaggaaaatgtgattttgtgggccaggctaagggtatttccgctgtgtgcagtctagggatttgatgtcctatgttccagctgttccagccatgactaaaaggggccaaggtacagcttgagccattgcttcagagggtggaagccccaagccttggaagcttccatgtggtgttgagcctgcaggtgcacagaagtcaagaattgagatttgggaacctctgcctagatttcagaagatatatggaaacatctggatgcccaggcaggagtttgctataggggcaatgtcctcatggagaacttctgccacggcagtgcagaagggaaatgttgggtgggagccctgacacagagtccctactggggcactgcctagtggagttgtgagaagaggaccaccattctccagaactcagaatggtagatccactgacggcttgcactgtgcacctggaaaagccacagacactcaacgccagcccacgaaggcagccaggagagaagctgtaccctgcaaagccacagttgtggaggtgcccaagacaatgggaacccacttcttgcatcagtgtgacttggatgtaagacatggagtcaaaggagatcattttggagctttaaaatttgactgccctgctggattttggacttgcatgggacctgtagctacttggttttggccaagttttcccatttggaatggatgtctttacccaatgcctgtagcccctattgtatctaggaagcaattaacttgcttttgcttttacaggctcatagtggggagggacttgccttgtctcagatgagtctttggactgtggacttttgagttaatgctcaaatgagttgagactttggggaactattgggaaggcacaattggttttgaaatgtgaagatatgagttttgggaagggccaggtgtgaaatgataagatttggctctgtgtcctcacccaaatctcatcttgtagcccataattctcacatgttgtaggaggaacctggtgagagatgattgaatcatggggacaggtctttcctgtgctgttcttgtgattatgaatggttcttccaagatctgatagttttaaaaacaagagtttctctctttgcctgctgccatctctctttttctcagcacaatctctctctttgcctgctgccatctatgtaatatgtgacttgctccttgtctttggccatgattgtgaggcctccccagccatgtggaactgtaagtccaataaaactctttcttttgtaaactgcccagtctcagttatgacctcatcagcagcatgaaaatggactaatagagtcattaaaaaagatttctgggggatgctcaagacatttttctttttgactttctggagggccaaagaaggataacatgtccctattattacagtgttttaagaaagttagtcaaagctttagcagaaacatgcccatgaaagcttcaccagagagtactattccaccatgacaatgctcctgcttattcctctcatgaaattaggggtaatttctgagattatcaatagaaaatcattaggcatccaccttatagttctgatttgcctctttctgacttctttttgttttctaatctttatttttcttcagttaataatgtaaaaaggctgcattgacatgggtaaggtcccaggacactcatttccttagagatggactaaatggttggtatcattgcttgtaaaagtgtgttgaccttgatgaggtttatgttgagaaataaagctaatttttaaaatttttatctaataccatttttcacaacatttcgaagtcttttcatattattttatagcttttagaaagaaatatactgcctgacaataaaaaactcaaaaactccttaatattattaagatatgtattttatagactaaattttaaaaaattcagtggctttttcattatgtgactaattatctgtatggaaacccatatatgcattcaattgtaaagtacttgagagtatgctggatttatcattctattccaagaacctagcatgatacatgattctgtcaagcatctgaaagcacatactatagcttggatgtttgtcccctccaaatcccatgtggaaatgtaatccccaatgttgaagttggagccaagtggaaggtgtttggatcactagggctgatcattcatgaatggcttggtgccatcttcacagtaatgagtgagttctcactctgagttcacatgatatatggctgtttaaaagagtgtggtacttcctttctctctcgtttcctctcttgccatgtgaaaccctgcctcccacttcacctccaccatgatttctgagggcctcaccagaagctgaggagatgttggtgctatgctggtacagcctgctgaaccatgaaccaattaaacctctttcttttataaattacccagcctcaggtatctcttgatagcaatacaaaacagactaacacactatctaatagaaaatataattgcttttgtttaaatgtgcttggaaaattatagttaaatatagattttaaaaagtcaggacgatattttgcacacagttttcaatcatatttgtggtgttttctatttaaatatataagtacagattttattttatgcttccctcagcaaaaattttaaacagatgagaataatgattatagcaagcacagaatagctttgtgaagaaaacataaatactgagattattttcagtaataatgggctaaagtaaaataataattctatacatttttattgtctagaattaaataataaacttctgcacttaagtttttaccttcctaaatagaagaaactttatctgaattgtatggattcatattatgattatacctataattttgtatgcttttggtacaaataaccagaaattctaattccaaatagtttcagcaataaagaaatgaaataggttaaataaaaggaagttcaagaatagggtgggttttcagatggatgtatgtttatggaaaagcttaactgacttctcataaaatacctagattactcctgtctctccactctgatattcacaggctgagttttaatatgagacttgcttttcacatgattccaatgtgatggctagtcactccgtttccaaaactgttcttctgtaataggaggaagaaataactttctcaagttaaggagaacctttcctagaagttaactggctagaactgggtgaccaatgaagccctctgttggagatgaggacgggctcagctcccactgagagctatggaccagggttcataatgggcaaaactggtattctgttaggaggaaaacctcaacatctaattccagtatttctccacattcatgaattatttcctgaattatatctgattgtcagattaaagacttaagatacacaatcacatgtccaagctaaagatattaactttcatcttcaacttcctccctgtttctctttatatgcagtagctcttgcctttatttctagaaactcatatggagtttaaggatgagtctagccatttaaaaatttacttgaaacatggttgttgctaggtgggtggttgctagttgccagcttttatttttcacatgtaattatttaagttttcagtacatactaatagccactccccttgcatgagaataacgaaaacttaaaagctgtgtaagagaaaaatcaggaatcaatgaaccttccctctctactgcaacagagtttttttaatagactagaaatataatagaatacatgtattttagaagaaatgaataatagaaactctgaagtatatgtgtgtatatatagaaaatacaccaaatgagtataatatttctctcagattaattatgaatatttactccaacaccacatattacttttaataaaacaaatatatatttttgaaagtgtaaaggaatcttagcttggggcatttttcatttttttttgttttgttttggttagcagatcataaaattctatatcaatttttaaaaatcaagtattttttatagttagtgtttctatatacaagattaaatgtgaaagttggaatattatgagagaataattgaatactaggattttctataaaattgatagtttgataattactctgtagtgatcaggtagcttaagtaaagatatatataatttggtcccatatctggtagttattaccaatatagtataatccatgaataactgcccaaagaaataattatgtattgctctccacagtatatatcattagataaatgttaggaaatattttgcaaccaaaatgtaaaatgatccctttctccaggtttcttgaaagcaatatctaagaaacaataatggaaatgtataatgtatgtgtgtgtgtggggggggggtgctcatgtacatttgcaactttttctgttaagtgaagtattaatttgagaaaaaattttatgtatgacacttaaatataattaatattgaaagatttactatgctgtttattaagaaacctgtatcacatcttgattcttgattttaacagtaagcagatcagcaactgtgtattacccacagatactgtctaaaacttgtgtctctttgtgttatttctctaaagaagagcttgaattttatcattacaaaatctctgcatatttaatactttaaatttctgtgttctacaaattgtgtctaattcaccttaaaatccaactttacataatccattttagctcatcccaattagcttaatacccactaatagagcaggataaagtaggaaaattagcatttatttacttagtatatgataggttttattagaagctttacatatgcttcttgaaattctgattttttttttcctggcaatgtaaagatttatattatatgaaaatgtttcaaaataagttatgaaatatatttgtttctttaataggttcccacaaattcattagtaccttgatcaaaagtcactaatttatataaagcatattttaaagcaagtattaatcataaaatgccaaaaaaagtttacaaaacaatcaataatactgaaattaaaagctagactacagagtttaagatttgcagagactcctcaatgtggctaaaggaaatatataagtagtggcagattatatgaaaatagattattgcaagggaatgtccaggaggactagtcaagtagttgaataactttttttactgaaagcaatcaatgatctttttgaagggaagcaaaacatctataatcataatatttctcttcaccatgaaatggagattgattagggaaaaaattatttaatagcaatccgtaaggatagaaagtaactttctaaaataaaaatcaaatcatgccacttccctgattaaaaacataagtgccggacagtgggtgcaggacagtgggtgcagtgcaccgtgcgtgagcctaagcagggcgaggcattacctcatctgggaagcgcagggggtcagggaattccctttcctagtcaaagaaaggggtgacagatggcacctggaaaatcgggtaactcccaccctaatactgtgcttttccaatgggcttatcaaacggcacaccaggagattatatcccgcaggtggctctgaaggtcctatgcccacggagccttgctgattgctagcacagcagtctgagatcaaactgcaaggtggcagtgagcctgggggaggggcgccagccattgcttgggcttgagtaggtaaacaaagtggcctggaagctggaaatgggtggagcccaccacagctcaaggaggcctgcctgcctctgtaggctccacctctgggggcagggcacagacaaacaaaagacagcaataacctctgcagacttaaatgtccctgtccgatagctttgaagagagtagtggttctcccagtatgcagcttgagatctgagaaccagcagactgcctcctcaagtgggtccctgacccccaagtagcctaactgggaggcaccccccagtaggggcggactgacatctcacacagccgggtactcctctgagacaaaacttccagaggaacgatcaggcagcagcatttgcggttcaccaatatccgctgttctgcatcctccactgctgatactcaggcaaacagggtctggagtggacctccagtaaactccaacagacctgcagctgagggtcctcactgttagaaggaaaactaacaaacagaaaggacatccacaccaaaaacccatctgtatgtcaccatcatcaaagaccagaggtagataaaaccacaaagatggggaaaaaacagagcagaaaaatgggaaactctaaaaatcagagagcatctcctcctccaaaggaacgcagctcctcaccagcaatggaacaaagctggacggagaatgactttgatgagttgagagaggaaggcttcagaagatcaaactactctgagctaaagaaggaagttcaaaccaatggcaaagaagataaaaactttaaaaaaaaattagacgaatggataactagaataaccaatgcagagaagtctttaaaggacttcatggagctgaaaaccatggcacgagaactacgtgatgaatgcacaagcctcagtaaccaatgcaatcaactggaagaaagggtatcagcgatggaagacgaaatgaatgaaatgaagtgtgaagaaaaggttagagaaaaaaaaatacaaagaaatgaacaaagcctccaagacatatgggactacgtgaaaagaccaactctacgtctcattggtgtacctgaaagtgacgaggagaatggaaccaagttggaaaacactctgcaggatattacccaggagaacttccccaatctagcaaggcaggccaacattcaaattcaggaaatacagagaatgccacaaagatactcctcgagaagagcaactccaagacacataattgtcagattcaccaaagttgaaatgaaggaaaaaatattaagggtaaccagagagaaaggttgggttacctacaaagggaagcccatcagactaacagctgatctctccacagaaactctacaagccagaagagagtgggggccaatactcaacattcttaaagaaaagaattttcaacccagaatttcatatccagccaaactaagcttcataagtgaaggagaaataaaatactttacagacaagcaaatgctgagggattttgtcaccaccagacctgccctaaaagagctcctgaaggaagcactaaacatggaaaggaacaaccggtaccagccactgcagaaacatgccaaattgtaaagaccgtcaaggctaggaagaaactgcaccaactaacgagcaaaataagcagctaacatcataatgacaggatcaaattcacacataacaatactaaccttaaatgtaaatgggataaatgctccaattaaaaggcacaacctggcaaattggataaagagtcaagacccatcagtgtgctgtattcaggaaacccatctcgcatgcagagacacacataggctcaaaataaagggatggaagaagatctaccaagcaaacagaagacaaaaaaaaggcaggggttgcaatcctagtctctgataaaacagactttaaaccaacaaagatcaaaagagacaaagaaggccattacataatggtaaagggatcaattcaacaagaagaactaactatcctaaatatatatgcacccaatacaggagcacccagattcgtaaagcaagtccttagttacctacaaagagacttagactcccacacaataataatgggagactttaacaccccactgtcaacattagacagatcaacgagacagaaagttgatgaggatatccaggaattgaactcagctctgcaccaagtagacctaatagacatttacagaactctccaccccaaatcaacagaatatacattctttcagcaccacaccacacctattccaaaattgaccacatacttggaagtaaagcacccctcagcaaatgtaaaagaacagaaatgataacaaactctctctcagaccacagtgcaatcaaactagaactcaggattaagaaactcactcaaaaccactcaactacatggaaactgaacaacctgctcctgaatgactactgggtacataatgaaatgaaggcagaaataaagatgttctttgaaagcaacgagaacaaagacacaacatatcagaatctcagggacacattcaaagcagtgtatagagggaaatttatagcactaaacgcccacaagagaaagcaggaaagatctaaaattgagaccctaacatcaaaattaaaagaactggagaagcaagagcaaacacattcaaaagctagcagaaggcaagaaataactaagatcgagcagaactgaaggaaatagagacacaaaaaacccttcaaaaaagcagtgaatccaggagctggtttttttgaaaagatcaacaaaattgatagactgctagcaagactaataaggaagaaaagagagaagaatcaaatagatgcaataaaaaaatgacaaaggggatatcaccactgatcccacagaaatacaaactaccatcagagaatactataaacacctctatgcaaataaactagaaaatctagaagaaatggataaattccatgacacacacactctcccaagactaaaccaggaagaagttgaatctctgaatagaccaataacaggctgtgaaattcaggcaataattaatagcttaccaaccaaaaaaagtgcaggaccagatggattcacagccgaattctaccagaggtacaaggaggagctggtaccattccttctgaaactattccaatcaatagaaaaagagggaatcctccctaactcattttatgaggccagcatcaacctgataccaaagcctggcaaagacacaacaaaaaaagagaattttagaccaatatccttgacgaacattgatgcaaaaatcctcaataaaatactggcaaaccgaatccagcaacacatcaaaaagcttatccaccatgatcaagcgggcttcatccccgggatgcaaggctggttcaacatacgaaaatcaataaacgtaatccagcatataaacagaaccaacgacaaaaaccacatgattatctcaatagatgcagaaaaggcttttgacaaaattgaacaaccttcatgctaaaaactctcaataaattaggtattgatgggacgtatctcaaaataataagagctatctatgacaaacccacagccaatatcatactgaatggacaaaaactggaagcattccctttgaaatgtggcacaagacagggatgccctctctcaccactcttattcaacatagtgttggaagttctggccagggcaatcaggcaggagaaggaaataaagggcattcaattaggaaaagaggaagtcaaattgtccctgtttgcagacaacatgattatatatctagaaaacccctcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaattaaataaaagaggacagaaacaaatggaagaacattccatgctcatgggtaggaagaatcaatatcgtgaaaatggctatactgccccaggtaatttacagattcaatgtcatctctatcaagctaccaatggctttcttcacagaattggaaaaaactactttcaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatacagaccaatggaacagaatagagccctcagaaataatgccgcatatctacaaccatctgatctttgacaaatctgacaaaaacaagcaatggggaaacgatcccctatttaataaatggtgctgggaaaactggctagccatatgtagaaagctgaaactggatcccttccttataccttatacaaaaattaattcaagatggattaaagacttaaatgttagacctgaaaccataaaaaccctataagaaaacctaggcaataccattcaggacataggcatgggcaaggacttcatgtctaaaacaccaaaagcaatggcaacaaaagccaaagttgacaaatgggatctaattaaactaaagagcttctgcacagcaaaagaaaccaccatcagagtgaacaggcaacctacagaatgggagaaaatttttgcaacctcatctgacaaagggctaatatccagaatctgcaatgaactccaacaaatttacaagaaaaaaacaaacaaccccatcaaaaagtggacgaaggatatgaacagacacttctcaagagaagacatttatgcagccaaaatacacatgaaaaaatgcttatcatcactggccatcagagaaatgcaaatcaaaaccacaatgagataccatctcacaccagttagaatggcgatcattaaaaagtcaggaaagaacaggtgctggagaggatgtggagaaataggaatgcttttacactgttggtgggactgtaaactagttcaaccattgtggaagtcagtgtggcgattcctcagggatctagaactggaaataccatttgaccctgccatcccattactgggtatctacccaaaggattataaatcatgctgctataaagacacatgcacatgtatgtttactgcggcactattcacaatagcaaagacttggaaccaacccaaatgtccaacaatgatagactggattaagaaaatgtgtcacatttacaccatgggatactatgcagccataaaaaatgatgagctcatgtcctttgtaggaacatggatgaagctggaaaccatcattctcagcacactatcacaaggagaaaaaaccaaacaccgcatgttctcactcgtaggtgggaattgaacaatgagaacacatggacacaggaaggggaacatcacacaccggggactgttgtggcgtggggggagtggggagggatagcattaggagatatacctaatgctaaatgacgagttaatgtgtgcagcacaccaacttggcacatatatacatatgtaacaaacccgcacgttgtgcacatgtaccctaaaacttaaagtataataataataaaaaaaaaatttgttaccagttggctatgacaaaactgtttagcattcactctgtatagaacccttccacccctacctttggccttgcaatgtagagtaccaattattctaggataacatacaaaacaatcatccttcctttgttcttctgtattttggctctgtcaggcagtgttcttccatgtacctgaatctgtttctgggctcattatcctattccatttgacagattgtcaaccctcagccaatcaaacacagagttaattggttttttgatgagattttgtatagcataggtcacgttctgcatattgttcttcttcttcagggttgtgttgttttatttttgccctgtgcccttttatataaatattgaaattagctacatatgcaagcatcctattaagttgcataaaaagtcattagaaattaatgtgaattccattgattttactgaaaatgtataagtacacttgacccttgaacaacatgagtttgatctgtgcaggtccacttaaatgctatttttttttcaataaatacattctgtactcccaattggtgggttctgtatctccaacaaaatgccaaccaaaaatacaacatgtatacttgtggtataataaatctatatgtagggttgtgtggggacacttttcatatgtgggggttctactggatttttgtagtgccaactgcattacttaagtatccacagattttggtattggtgtgtgtgggaattttggaaccaatgcccaccacaaagagatatgtagggataactctaatttatatccttgtgatattttatcttcttgtatgtggatacggtagatgtctcccttatatgacgacttctatgacatttttaatgtagtttcgtaatttatcttcataaagagcatgtgcttactttctcaagttaacgtatagaaatcttattaatttgttgccattttaaaatattttataacatatatttaactcattatattgatgtatagacatgcaattcatttacatattgagcaaccttgtcgaactcttctacttctatttatttatttgtgtgtgtgtggagacaggatctcgctatgttacccaggctgatgttgaactcttggactcaggcaatcctccctcctctgcctcacaaagtgttacgattataggcaggcatgagccaccacacccaaacacgtttatttttaataatactatatcatctgtgaataatgagacccttcttttgtttctaattcttaaaatagtttactagtttattccctgcctagaaccttcagaaacaacactgaactgaaataatgacaataagatttcttttcttgttttgatttttcatgtaagacttttaagctttcacatttgagtttaaagttttctgttcttttgttttattattattattttattttattttaagttctgggatctatgtgctgaacatgcaggtatgttacataggtagacatgtgccatggtggtttgctgcacctatcaacccatcatctaggttttaagccctgcatgcattaggtatttgtcctaatgcactccctccccatgtccccaatcctcccgacaagacctggtgtgtgatattcccttccctgtgtctatgtgttctcatttttcaaatcccacttatgagtgagaacatgtggtgtttggttttgtgttcctgtgttattttactgagaatgatggtttctagcttcatccatttccctgcaaaggacatgaagttttcagttttttataagtgataccctttaactcattaaaaaactttccttctattcttagtttgctagaaattttgacagaatttaacattaattacgtttgttcacttactgatatgattatactgtgaacaactttggtattttaatattaacccattattttaccccaggaatatatcaactgttctgatggtatgtacacatatgaatttcatttttaataatttatatttaggatatttgcatctatgttgatgattgacattgcctttgaattttcattgttcatgataccttttctgattttcataccaaagttttatttagcttctttaaacaaatttggtaacacaaatttgtgtaagagttttagttgacccaccactcaaattccatgtcaaacaacaaaattgtggatttcacacatcctaaactaactacaaaaggtttcatttaatgtattgattaagaatcagaatgttatagttgaaaaggactgacttcaagaagacttagttttaatattaatttggtaccttaatttgtgaagtcatttcacttctccactttccttacctttacccataaaactagggtaaaaatttttataagcctgtagttacaacaggtcaattttagctagtcctcttgagtttaattatgttgtttaccaattacatatatgggatcttgaagaaatcttttaacctccttgaatctttcagttttttcatcaataccatggctacaagagggttgttatgttatactatataagaacactagatattagaatttgctccagattgtatttagggaagaaaacattttcttgtaatgaaatagaaagttattgcaacaaaaatttcatttataaagtgggtttttttgcaggcatatgctctaaatttttctgaggcatatatttggaaaagtctgaagcacatggcattaccatattaaacagatctggaaggagccctaaggattccactgtggtacataaaagtctctcatttcccattattaaaaaaacagctcacatttttaactgtttaattgttaaggctataaattttacttataagaataatgcatattatattgtcctttactctttacatagcacttttacatacattacctaattcattctaacttcaatctgaaaagtgtgtaaagccaatgttattatgaccttttttgatgtaggtgtttattgctacaaacttaccccttagaactgcttttgaggtaacccataggtttttgtatgctgtgttttcatttttgtttgtcttaagaacattttaaacttcctttcaatttatttattaactccttagttgtttagaagcatgttaatttgtatgtatttgttaattttccaatatttcttttgttattgatttcacattttataccaccatggtcgaaaatgatacttgatatgattgcagtcttcttacagttttcagactttttgtggttttatatatgatctatcctagagaatgttttatgtttagttgaaaaaatgcatactctgcagatgttaaataaaattttctgtatatgtgtctttaggtccatttgctctagaatacattttaagtttcatgatcattttctgattttatgtttggataatctgttcattgctaaaagtgaggcactgaaattgcctactattatcatattgcagtctctctctcccttcgtatctattgatattttctttatgtgtttagatcctctgatgcttgctgcatatattgttatatcctcttgttgaattgaccactttatcatactatagtgacctcctttgtctttttaacgtcatttttgaattaaaatccattttatccgaaatatggatagctactctttcttttggtttccatttttctgaaatatcttttttcagttcttcattttcaatttgtgggtccttacaagtgaaatgagtctcttgtaggcagcatgtagttgggtcattttttttcccccccatttgtcatgctatgtttttgactggagaatttactccatttacattcagggtaactactgatagataaggacttataactgcagttttctagcttttctataaatcctttcttgttgctttttattttgtttgtgtgtgtgtatctataggattttgctttgtggttaccatggggcttattacataaaaaaattttgtagttataatagattattttaatgaatgacaatgtaactatgatcagaaaaaagaaatctctacactttgactccatttacggcccacattgtaaattcatgatgtcacaagttacattttcttaaattacatataccttcagaaattattgcaccaattatttttgatagtttttcaaacctttagactacagatatatgtgatttacataccacccttacagtattacaatattctgaatttgactgtatacttacttgtactagtcagttttatacttctaaatgtttttgtgttgcttagtaccttttttttagcttgaagaactatctttagcatttcatctaaaacaagtctggtggtgataaactcccttgggctttgtgtgttagaaaagtcttatttctcctttatttctgaaggatggctttgatgggtaagataatcttggttaataatttgttttttttctttttcttcagcactttgactctatcattccacaatctcctggcacataaggttttggctgcaaagtctgcagctaggcatgttgaaactcccttatattttatttgcttcttttctttgatggtcttagcatcctcttattatctctgattttttgagaatatgattatatctttcaatagtcttatttggattgaatctgatttttttaatgggatatttgcatatttctccaggttactaaaaatattagtaaaaacttatggaaagtactactgtatcatcttgttccacccctccatggaaatcctctgatccctatattttttatgctaaataaccgaggcttgtgaaggtaatttgttcaaaatcatggaacttagaaatgggcttcattcatcaaggcacatattttttaacaccagttttatcctgtgtgaacagactgttcattatgttaaacacagtctttgcaatactttaaacattctcatttctaagacatccagtgtggttccttatacgaattccacattgagagagtggtgtaacaattagtattagtgaatgtataaacactgctccacttaccagtgagttccaaaatgtatcgtaagctaggttttgagaattatgtttttaaaaaataatttataagtaactattaaactcatagcaagttcataataatttgaaattaacatgtttaatctttgagatgatttgtataatctttttccttttccttcttctgttgttgaatacgtaaagaatatcataggctatacagagtttcataaataggctggaagtctatgcactatttaaaaggtaatgtgatgagaaaatgtatttctgcagttaaatgagagtatgagaacactggggaatccttattttttcttaaacctttcatctcttgtattagtgttgtctaaagagagagaactaatgggatatacttatatttgaaggggattttattaggagaattaactcacactatcacaaggtgaagtaccacaataggccatctgcaagctgagcagcaaggaagccagtctgagtccccaaaccacaaaagtagggaagccgacagtgcagcctgcagtctgtggttgaaggcctgagagcccctggaaaatcactggtgtaagtccaagaatccaagagctgagtctgatgtttgagggcaggaagcagccagcatgggaaaaagatgaatgctggaagactgagcagtctcttcactccactttcttctgcctgatttattctagctgcactgacagctgattagatagtgccagccagattgagggtgggtctgtctctcacagtccactgactcaaatgttaatttcctttagcaatactctcatagacacacccaagaacaatactttgcatccttcattccaatcaagttgacactcaatattaaccatcacatctcctgaccaagtaatatccagaaaaaaaaaaaaagacaaaaccccaaaaactagtgactcgggatttttctgttgtgccaggactctttcctcaatgacttttattcaaattttggatggagcccattgtttcaatgccaggtccctacattattattttttcttacaatttcaacagatcccattttctaattagaagattggtgatgacaaaatattttttaaaaatatattgaatgagaaactttgtcatctcaatgggcataattataatacactatggcacaaaatgtggataaatattaagtagttatgttatatagccttcagaagccattggatttatgctataatgattatccataatacatttgaaaattaaggacttaacaagatctaaaagttgatcactgatgtgtgttgtttgtttaatctccagtgaaacaaaatacaaatgttactctcagtactattcccatatgcaacataatcaaataatctgtctcaataatgtatgttacaattaacacacattggaaaatctcattcctaattttccagatatgttgctgcttgtttgaagcaatgtttagagagtcacatagattccttatgcttaaaaaagtgaacaattctttactcatatatgatgagatagaattatacattctttgtatttactaatgtagtatctttctaaagtgtattttatttcacaatctatcactttgcttcagaaatgcctatggtctaatggtcctcctcaagctgtctttgaaatcatcagctttaattcttcttaatgttcaggttttctgatagttaagaggaggagtagaggtgttgacagtgatttttcatattttaccttatttctagcaattagcttttaatcaaatgtgattttcaactcttcatctgatttttcaacattgttaaaaattcagcactgatttctactatttaccagcagctggcttcagaggaaggtacagaaaaaaaaaattcattcttctcaaaatttggggatataggtatacagacaaagactatgcaaataaaaaagtacatgtaatattatattgagcatagacacacagaaacatagtgcacaaacacagggcagtccttaatatgactcctgctgatgggagtgcttcctgcaggtgaacatttcccctcaggcaatgttggaggttggaagtttcatgtaaggaatatttatattgagaatagctgcttgttgaaaactctaagaaggcttattgaccactaacattttagtatgccttttggttatctaaaaatctatgattaaaataagttaatgcattaaccacataaatatgattttttctcaattatttgcattatatgacattctttcaaaccattactcttcctggattatattgtggagaaaggaaatgagagaggattgattgactgatggattgattgattgtgagatgcaggaggaaggtttacaagccaaaaaactgcaattcccaacatggagatgagcagtcagggagggcaggtttaggagaaatgactagcaggggtttatatatggtaacagtctggtggtggcattagtggaagattgaggaacaagtacattaaatatagattttgtgttctttagacacatttaaaaaatattttgccttattttctttatactccagtgactgtggaaattccagtggtttaacagaaatgcacatttatattactgaaagctgatcgagagcaataattttcacagtaagaagagtggatctttactcagaagacctagtttgaatgtggactcattactttatagttgtgtaaattttggaaacaatatgataatatgtctatataaaaattgtcattttaaaatattttcaatatgataattttggcaagtttgttttcaggacgcatattttgaaaattaattttattttgattttgaagaaataatttggaactcatactattgaataaaaaggctaagttgtttttcttttattgaaaaaagcaataaatttcccttctagaaacttacagattttatattacttatctatattatacttgtaaatgaatggacagaaaacatttaagaagtaacaatttgtgtataaaatgctttaaaatgtgtttgttaattattagagtttctcaaaactgtaacaagcacttaatatttctatttttcctgttataaaaaacctacttcacaattttattgagaaataatttcattgtgtaacttaaatccttttaattttaaagttgtgtaagatacagatgtattgactaaattaatttaacttggatgacataatgcttagagaataaattgcaatcaaaacgagagatataaaaacagcatttaattaagaaaatatcttgtacaaatttgaagcttcttgtcatctggatgtccttgtacatctcactgggctcagtgggttatgcagaattctctgacatattaaggttaaaaattagtgtgattgtatacaaagactgttggatatgtcagcacatagatggtttggtgaaaaatgtatcaacttgaaaacatctaactagtggaagttttaatccacttttactcatccttctagttatctagtgtcgccacttcctgaggcttttgtggatgctgtgctatcaatcatcatgcttcaccagttttctcactgccaatttcagtttccaaattctcagatctcccaagtctgttaatacttgtttaattgttttttagcttccaagattttgtcttttttctcctcctgtcttattctagtgggttgctagccttaacaaatattttactaattatttgcgggatttcaggagggagtacaggtaaatctatgtaaattatttcattatctttaactggaatgctaattttaattattctatatctttcgtttaaaaagctatcaaaattcttttctacttctctacagaactgctttcaagtatagcttattctcagctttaatttttttttttttttttttttgagatgaagtctcgctctgttgcccaggctggagtgcagtggcgagatctcgggctcactgcaagcttcgcctcccaggttcacgccattctcctgccaaggcctcccaagcagctgggactacaggtgcccgccaccacgcccggctatttattttttggatttttttactagagatggggtttcaccgtgttagccaggatggtctcgatctcctgacctggtgatctgcccctctaggcctcccaaagtgctgggattacaggcgtgagccactgcgcctggcctctcagctttaaaggtacatccaaaatatgtgtggactctgcctcccatatcaggattatattacaattctgacctttggtttgttaacaatataagtttatcaacagatgctaggcctgtagtcagctatccttctagggaaacattctacattatgatatattgaactacttttcatctaaatatacaaatattagttaagcctttgctgccttcaggctgatccttacattctagaattgccttgataataattttcagtaccttatagaatattgtaaagccaatgggagactttgaatatttgatattttaaattttcaaattttgaaagttagggaaaagtgaaaataatgcaattagatgcataacttagtggaaaatataagagcacaagaagatattatgcttcactctataagcatgtcactatgaatgtaaagtcaaataaatgaaatcaaaaatgaaaaagacacattacaaataataccatagaaatataaaggatcataagagatagcaaataagaagattgaatcagtaataatgtgtttcttatcaaacaaaatccccgctgatggcttcactgctaacttctaccaaaaaattaatgaacttataccaattcttatcaaactctcccaaaatattaaagaggagggaatacttccagattcattgcgtgaagctagcattatcccattacccttatatcaaagccagataaggtcacaacaaaaagataaaattacagaccaacgtccttgaaacataagatactcctatatacttctcaacaaaatactagcaaatcaaaattgaacaacacattaaaatcattgttttccatgaacaaatgggatttatcccagggatacaaggatggttcaacctacccaaatctacaattgtgatacattatattaacagaacaaaggacaaaaatcatgtgatcatctcaatagaagcaaaaaaatcatttgacaagactcaacattccttcgtgataaaaaactctcagcaaattacgtatagaaggaatgcatctcaaagcaaaataaactatagatgataaacctacagctaatatcagaatgtgaaaagttataagctctcacattcacatttcttagatcaggaacaagactagggtgctttacatttaacgtaatcctggaagtccaagccaaagtaattagcaaagaaaaaaagataaaaggcagccaaattgaaaaagaaatagttaaattgtccctgtttacaagcaatgtaatcttatatatggaaacactaaagactcaactaaaaagaccattagaactaacaaacaaattcagcaaatttgcaaaatactaaatcaacaaaaattggtaatgtctctatatactaacaacagactatacaaaaaagaagtcaagataactgggtgatataacaaatgtttcctactatgttctgttataaagagaacagattattattgaacttatacaaataactacattgctataaaaatacaaagtactaatactttctgaattctagagagaaaaaatatttcatcttggttcacaaatatatgctttttcaaccaaatgtaaactacagctaccttaagataaaaataaaaatgttttattaaatctggaaaacaaatctttaaagaactagcaatgttttaaataaaactatcatttaaaaataaaacgaaaaataattcaagagaacaattcttgttacaaaataaataaatgaatattaaaataagtaaataagtaaaatacttaggagtaaatttaataaaagagataaaagacctgtacattgaaaacaaaacaacattgacgaaataaactgaagaaacgcaaataaagaaaacgatatcctttgttcatatgtttgaagagtaaacattgtttaaatgttcatactacccaaagtgatctacagattctatgtaatccctgtcaacatctcaatgacattctaacaaaaatagaaaaaaaaattaaaaattttgtgtggagccacaagaaaaatcctggatagccaaagcaaacttcagcaaaaagaacaaagctggaggcagcatactacttgatttcaaaatctgctaccaagctataataatcaagacagcaatagtactggcataaaacagacacacagtccaagagaacagaacagagagtccagaaacaaatatatgcatttaaggccaatgaattttggcaaagatgtcaaggaaagaatgatatcttttataaatggtgttgaggaaagtggttatccacatgcagactaataaaaataaacctttacatcacaccatgtaattaaataaactgaaaagattaaacactgaaatgtaagacctgaaactgtaaaattagttgaagaaaacattgaggaagaagttcatgacattggtctgagaaaagatttttttggatgtgaaccaaaagcataggccaaaaaagtaaaaaaaaaaaagacaaatgagattacatcaaattaaaaatcttctgcgtagcccaggaaataattaccacagtgaagaaacaacctgcagaattggagaaaatatttggaaaccatacatctgttaagagattaatatctaaaatatttaagaaactgaaacaactcagtagcaagaaaacaaatattccaactctaaaaatgagtaaagggcatgaatagactcttcttaaaagaagacaaatggccaacagtatatgaaaagaatactcaagagcactaatcagtagaaaaacataaattgaaaccacaatgaaatactacctcatgcctgttagaatggttattatctaaaagatgaaagataacaagtattcaataagatgtggcaaaaggggacacttgaacattgttgataaggatataaattagaacagccattatggaaaatggtattaggttcctcaagaaaataaaaaatagcactataatataatctagcaatcccactcctgggtatacatccaaaggtaatgaaatgagtatgtcaaaaaagatacctgcacccccatgtttattgcagcattatttgtaatagatatttataaaatcaatctaaatatccatcaatggatgaatggataaagaaaatgtagcacatatacaaaatggaatactattcagccttaaaaaaggaagaacccctgtcatttgcaagacaaaagatgaagttggggagcaccatgtaaagtgaataagccaggcacagaaagacaaatacgacatgatcttacttacatgtggaatctaaacatgttgaactcataagaaacagagagtagaatgttggttagcagggatttgggaggaggttgagaagatattggtcaaaggatatacagtgtcaattagaaggagttagttaaagatatctattgtacaaaatggtgactctagttaataacaatatattaatatattcttgaaaattgcaaagagtgtacattttaagtgttactaccacaaaaattgatatgtattgtgagatgatgtatatattgattggcttgatttagccattttacaatttatagatatttcaaaatattatgttgcacatgatagatatatacaatttgtgtcatttaatatatttaatttaaaattctaaaaaaatctgttaatctgaagacattaaagtataaaaaggaaagaaaagtcagaaacagcgagaagacatttgtataacttataactgacagaagataggtatccaaagttcactacaaacagacaaactaaaacttcaatagtctaataagaataaaagcaattaatccagtcaaataaatgtgtaaaagtcttacaaaaactcttctcaaaagagaaaatgcaaacttctaataacatgggacaaaatgctgatatttattagtattcagggaatgctgatatttattagtattcagagaatgtaattactctgattaagattttttttaaataactatcttattggcaaaaattttgcagtctgaaaattccaggtgtttccaagattttaaaatagctagaacagttatataatgtcagtagggctagaaataggtgatagcatttgaaaaactgatttgacataattaagaaaaatttaatttttttaccctctatgatctagcaagtccaattgtatgcttacatcctgaagaaactcttgcttatatgtactaggaagtatgcaatattcatcaacatggtaaattctaatgagttgatcaaaaagaagaattagggcctggagattgatcagttctgcctgctacagctggcatctgtgcacaacatctggaggaacctgagggaaggaccaccccacttattaccaccactgaagacatccacgcacacattctgggtacatgagaatgagcctgctttcccaccactactgcttgtgtacattactggggacctagccataggcctgctctgcacactgctaccagtatatggaagtatcatccagaggaataagggagtgcccaccccacccacagctggcacctgcatgcaccttttggggacccagggatcagcctactcagcttgccactgccactgctggcacccatctgcatatgccactcaaggggtttggggattggcctgtccagcctgttaatgacactgctgccactcatgggcttcagggttggccggcatctgctactaccaccattaacaacatgtatactacttgggggtcaagggactaattcatgcactcaacccaccactgccactgccagcacccaagcaagctgtctggagacctgagaaccagcctgcccagacccatcaataccactgcccacaccaccaccagtggcccaaagatcagcacatccagcttgttgccatcattacaggtgtccaaggactggactgcctggcatccttgttcccaacaaagccttgtcacagcctccaataataaacacagcctaagctactgaggaactgacaccgctgccactgattacagctaaagaactcacacgaagattacattactgtgtccatttagaatcaacctttcctgaacaacatcataaatacatttttgggaaatgtctttccttatgaacaccaatccaaacaattgcaagaagtgactgtttcatgtttcttgtgtctttacgttgatacacagatatgagaaaccaaaatattatgacaactccaaagtaacaaaataattctctccctttttaaagcttttattttatgttcaggggtacgtgtgcaagtttgttgcaaaggtaaattgcatgtcacaggaacttggtgtacagattatttgatcacacaggtaataaaacatactacccaatatgtattttttgatcctcaccctcctcccaccctccaccttcaagtaggtcctggtgtctgctgttcctttctttgtgtccaaatgtactcaatgtttagctcccacttacaagtgagaacatgtggtatttggttttctgttcccgagttagtttgcttagaataatggcttccaatttcatctttgttgctgtaaaggacattacctcattttttcatggctgtgtagtattccgtggtgtatacatatcatgctttctttatccagtctgccattgatgggcatttacatttattctatgtctttgctattgtgactagtgctgcagtgaacacacatgtgcatgtgtctttttggtaggatgatttatactcctttgggtatatacccaatgttgggatttctgggtcaattctgttttaagttctttgagaaattgccaaactggtttccacaatggctcaaataatttacattctcaacagcagtgtataaattttcttttttctctgcaacctcgcgagcatctgttattttttgactttttaataacagccattttgactggtgtgagacggtatcttattgtgattttgatttgcatttttctaataatctgctaagcaactctaataataaaactaggatgtgggcggcaagccacccaggtgccgaggcaggagaccgagggcaccagctgttccagtataataaaatataaaacaagaatagttataccagatatagatcttagatatgattatatataaatataattaatcattagttagtagtacttactctttattccaatgttataataatcctcgctctataatcgtaaccgaggaaaggccaggccatacagagataggagctgaggggacataatgagaagtgaccagaagacaagagtgcgagccttctgttatgtccagacagggccaccagagggctccttggtctagcggtgacgccagcttctgggaagacgccccttgccaagcggaccgtagtctagggatagcgttagtgtcaaggaaaaacacccgctacttagtggaccgggaaagggagtctccctttccctgggggagtttagagaagactctactcctacacctcttgtggagggcctgacattagtcaggcccacccacagttatccagaggcctaaccgtctccctgtgatgctgtgcttcagtggtcacgctcctagtccgccttcacgttccatcctgtacacctggctctgccttttagataatagtagcaaaattagtgaaagtactaaaagtctctgatatgcaaaaataatgctgtaagctgtttctctctctccctctctctctctgccttggctgccaggcagggaagggccccctatccaatggacacgtgacccacgtgaccttacctatcactggagatggctcacactccttatcctgcccctttgtcttgtatccaataaatatcagcgcagcctggcattcagggccactaccggtctctgcgtcttggtggtagtggtcccccgggcccagttgtcttttctctctttgtcttgtgtctttatttctacgctctcttgtctccacacacagcgaaaaacccatggaccctgtggggctggaccctacactaggaaattctggaaaaataattagaaatagtgatattaaagaaattgtgaggtaacacagaatacagataaacaatagaaaaacaatcagggaaacagttgataatctgaatgagaaattaaaaaacaaaatagatattatttaaaaataactaaatagaaattctagaattgaatgactcattgaatgaaatgaaaaatacaatcaagatcttcaaccacagactagatcggggtgtccaatcttttgccctggtttacactggaagaagaagaattgtcttgggccacacataaaatacactaactatagctaatgagctaaaaaaatgcaaaaagtctcataatgttttaagaaagcttacaaattactgttgggccacatcctaaggcatccaaggctgcatatggcccatgggctgcaagttggacaaacttggactagcttaagcagaagaaaaaatttccaaacttgaagataagtcttttatgctaacactgacaaaaacaaagaaaaaaaggaatacataagaataaaaaaagccaacaggacatatgggacaccataaagagaacaaatatttgaattttgagaattttagaaggagatgagttggacaaaggcatagaaaacctatttaacaaaattatagcttaaaacttcccaaggcttccaagagacatagacatccatacataaaaagctgaaggatccccaaatagactcaacccaaaaagccttcttccaagggacactattgtcatactgtcaaaagtcaaagacaaagggagaactgtataaacagaaagagaaaaaggcatcaagtcacataagggtaggagagactgggaggataaatttaagtaccaaaagaaaaaaattctgcaggtcaagaatattatatccacaagaaaagtatgcccacgttccttactcttatttaacatagcattggaattttaggtagagcaattagacaagaacgaaaaataaaagccatcaagattagaaaagaggaagtcaaattgtctctgtttgcaggtgatataatcctatgtagagaaaagcctaaagactaggccaaaagacacttagaattgatttaaaaagttcagtaaagcccagacacaaaatcaatatacaaaaatcaatagtgtttctatataccaacaacaaagaagctgaaaaattaatcaagaaaataatcctattcacaataactacaaaaatacctaggaataaatttaacaaaggagttaaaagacctctataagggaaacaacaaaacactgatgaaataaattgaaggggccacaagcaaatgaaaggatactcaatgctcatggatcagaagaattaatattttttaaatgaacacacttctaaaagcaatctacaaagccaatgcaatctgtatcacaataccaatgacattcttcacagaactagaaaatagcaatgctacaatttgtatggaatcacaatactccaaataaccaaagcaatattgagcaaaaagaacaaagctggaagcatcacactctttgatgggggagatgaagagagttggctaatatgtacaaacatataattagatagaagacataagttctagtcttcaatagcacagtagggtgactgtagttaacaacttattttatatttcataagagctagaagcaaaaactgaaatgttcccaacacaaaaaaaatttgaggtgatagatatcttaaatactttcatttgatcattacacattgtgtacatgtattacgatatcagagatttcctgtttgctttatagtaattctggaaatgtactgtggattactacacaaaaatgtactataaaaggaaatggaaagaccaaattaaaatacaagtcaaatacagctacaagattctaggtgtccataagccttcacatctggtgatcttgctaatgcaggccaagtaaatatggtcctgctgctgtcactgccatttttatcattttgtttgatagaggtgagaaggagcctctatgggtcagttctcccagttatttgagactgttcttcacgtggcccattacagattgatttatttcagaagtcaacatgggagaagtgtggtgataagaatgcagatcagaagaaaaacacacaatcaaatttggttaatagatttggggtgtttataaaaccaactgtttccccctcattttgacttgaaagatacatatttggccaccttcagaatatcaaactcaggttttacttttctgagaaacacaaaatataactttaagtctgtttgctcatcaatttaatgaggaatttgagaaaccatgtaaatatttcacatataaaatttagaaaaacgatgtattacctcaatagaaggaatttaaatatgatataggcacatcaaagatagagagaaagtatttctcaaataccaatttacaccctgacacttattcataaaaaataatacttaggtgcacttagatgagacacaatacaaagaagttaggggtagaagcagctaaaaatcactgtaatgacatcctttaataatcccacacataccattccttagttgtaaagcatacctttgtgaggagattcaactaaaaacactttgttatcccatgaaagatgaaagactgtacttttacaaactaaagtgagttaaaattgtaatatttagcctgcaattttgccacaagaaattactaattttcagctttgatctttcatttattttgatgaaaaaatatgtttatgatagttactatccagcatttattagtcaacttatactcattaggcaaccaatgaagatttagaagaaaatgagaagtttctgaaataaaagaggaagatatatgtgtaattttataaaactctggggatatttgctttcttataactttatgtatttggtaacattatgagttgaaatataaaagtctaagtttaatcagtaacaatcatgcggtgttctttattaggttaaagagtatagcaaatttagtggcatactaatgttacagcatttatcttaatgtgaaatatttactcaatgatgtagcacacaaaatattattacaagtaaatactttaacatgaataaatagaaataatggtaattggtattcataagtcagtctgcagtcagtaccaactgacacacttaaagactaatgaatgaaaaatttgctaatatgacctttctggattttatgattacagcaacaacatggaaatctttaagccatttacaaagtaaatattagtaaatgataaatacaattatgtcagttaaatttcaacaaaaacggtaaataaaagaccgtgtgtctatttccaaattaaaaatgtgttccattaccttttgatagatgttagaatgatagaagccattaattatgtaatcagtgctacaaattggcacaactagaagcaagatctctgggactcccactttgggactcacggatcaccagccagaatgggtctcacatagtgtcatctgtcgtcaacatgattttagataagactgtagaccgcctatgggaacatgacttagttattggtttcagaaaaattttgtgctggaaaaataagactaaaccaataaataacttcaccttttgtttcaagacattcttatcaagaaacaattatttgctcaactggtcaaaatgagtttacttatcaacaaccttaattatgctcattaattataaattcttatatccccatttttgtccatttttagttccccaacctaaaaggccctcttctttgatcatctgaaccttccctccagagcccggtaaatatcttatttctaactttctcctctgtgacactgcttatattctgtcaataaatgtggtgttttttatccactgtagtgagctataataaacttatttttgttcattatcagacacagatgtttcagtgacttctatatataaatttataacttgttcaactaaggctagcataaatcttcaatgatattttcctattattaaagtataatgaaattacacatatgtgataccatggggggttatttccctgttctagaaacagggtgactaggaaatagcacatatattttctagtagcataaactcaacctttatttttctttgttcataaagattattgcttagaattatagaatgaatatgaaagaacattttaaaaacaactcttcagtccttttggcatcccagaagcttattagttataaatttgcatactcgagatgacaggcaccacagatcataacttttcacttcctgctattaatattgatggccatggtgaattactagttcatcagaattgatttgacatagtaaattttcatgtacagtagactgtttcacaaacctgcatcagaagaaggtctttgttaagatgtagcatggttagtactcaagaagaacaatacagtatatttgttaaacaatctttgtagtcagaaagcctaggttaaatttgctaacctgagaggctttgggtaatttactgaaacttcagttttcctcaactaccaaatgatatagcatttgtgttgtttcagtggtacttttcacttatgttcctctttttggctacagtaaaggagaggaaacacatcattcaggaaaatggacagccacattttctttgaagctgagctgattctcctgggtctcttggccatgaggcaatggccaacgggaaatataggtgagaaaacataaatttacaaatatctttctgttttattttacattataattaagtcagcagaatactatcaagtttgaattaccaaagatatttttgtgttcacaagttcttataactctttcccaatgtctctccttaatttgacaagttttctcatgtggtatcatacactgtatttctgcctcatattatactccacaaataggttctacttcatagtttgctctgaatagtaaatgaaaagaaaaggccgggcgcggtggctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaagaaaaaataccaaatacttaacacagttcctggcacatagaaaacacttcatatcaggtaaatatcatcatgattgtgtcctcggcccaattcttgctctattaaaaaagtcacttaaacacccaaagccttaacttcctcttttttaaaatggtaaaaggaataaaaaaaaatcatttaatttgtatgattgttgtattaaaacattactgttgtgatgttttttaagagacaagctctccattgcccaggggctggagtgcaatagcatgttcatagctcactgtaacctcaaactcctgggctcaagctatcttcccacctcagcctcccaagtagctaaggctacaggtacatgccagcatgctcagttatttttttgaaataacttttgtagaaaccgtgtcttgctatgttgtctaagctggtctgaaactactggcctcgagcgatcttcctcccttggcctcccaaagtgctaggattacaggtgtaagccactgttcccaggtttgttctgacttttctatttttaaaaaaagaaaatcattaggccattcagcccagggagcttttaattagcaatcctggacaacaatagttaattcctcctcactgccatctgtgcatgctgccctcctgtccctggtgcctttacttgtagttaactattcgcatgtctgtctttatattgcatgcttctatagcatgagtcacatttcagatgctccctgaaggtctgctacattaacatgtgaataaataacataaaaagaagtgatgtattaatattattttttgaagtaagctacctgtttctccacttccagatttagagagcatagaaaaagcactttcagaatgataaaatagtacaaactctccccagaagatctctgggtatatccaaggtgatacagttaactctgttgcagagtgaaaaaaatatagaaaatattttttttctttttcaaaaagcctctattaattgaaaaaaggtgatcattttgaatttttctggatcctcactgctcttttcatctcagaagtgccaattatgttagtcatttggctctatattcattattattgccaaagtgatacaagccaatgtcaatttaaaataatttatttccttcaaagatatttaaatatgtcataagggaacacacaagcatattttctaacacttgtataaattttctgatttgtcaataaaaagtatacctcaagctaaaaattaatgagcccaaacatcttacataatactgtgcaaatgacactattcagtttctcatcgacttgatgttgtttagggaagttatagttttatgaaatgcacatgttacatctacctagtagccatattttactattataaaatacagaggaattcatttagtggaatgtaggaatataattctctaatatgacaaaaagaaagaagattatcttccctgtcattttcaaccaattttcaagaaagtccccaaccaatgactcaccaaggccctcacaccagcccccacagttttttcaatgtgaattatgctttcccttcaagggttctacacgtcgtttctcttcagtgactttgtttttgattcttcaatgaaaaataatgttttcttctcttgccaccacctacagatttaatgctgcacttgcatcctctattttgctaataccaatacatatgtactgtttaacctgttggagaataagctacttgagcatagggacataactcatattttatttaaaatcccctccccatcaccttgtagtgttatttattttggaagccttaactttatataattttataattagaagacagcttttgatatactcacttcaaactcatgttttgtgctgtggtcagtaaataatttgccctctgcctcatcctgtctgacgtctgatgtataaatggaattggaagtatgcttccttttctttccacatggcccgttgctgatcacctcctgacccacggccacccttttattcactgctgttgtgtcaaaggagatgtatcttcaatcttctgcttataatttatccatacttttcactagaaatgatggtaaaccatggtattattcataagtgttttggaaatgttacaagataaataggggccaatgagccagctgagaaacactactctactgagatattgcttcaaaaggaaacatgtgtttcatgtttaaaaatacgtggtttgaaaaaaaatctttcaaaattaaagcaatgcagaacatcaaaaatatttcagaaaatatttgtgttgaaatcagtaccctcctatttgttggctcaatgggtcaaacaatccatagtctttccatctcagttttgttatctgtaaaatagacctctgatttttattcctgtcattaccattcatctcactcccagcaaaagcactatgtaccattattatgaacttgctgttatgtgcttgtgtgcatcccttctacttctgtagaaagttttccaccattgtgtccttaatatactgagttttacatcaaaattcaacacagatactgaatttctctgtaaaaccctaccatctattaaaaaaggtgtttaagtgctctgattagctatattcttattaccttttgcatgcaattttattaatatattatgttttcaatcatatttacttttaaaaatgccttttcccccatttgaatgtaaaattttaggggctagaactgtgtttttatgtctttccagctcagaaacttgaataatgtacataatagatgcttactaaaatcagttgaatggatggaaaaaataatttagacaattttaatatttaaatgtttttaaatattaaaattatttctatatttaaaagctctgcaaaaggaaatacattattgccagtatttgtcataattttttcataatattaaatgatccatttgtcacttcatttttttaacttctatttttgtctgttacttctatttgatgactgatatagtaaaaatattaataatactaatatttatatagtctacactgtgtcagataattcaagtgctttataaatattattttatttaatacccataataatcttatgaagtaggcaacattacaatcccaatttaatatgggtaaactatggccttgagaatatatgtattttatctgtttaactctattatttaaaaataatctatagtataataatagtaattgattttatcttaatttaaaaataattttcttatgaatttataaggacagaaaggtatcaaagtaatttcattgaaatagtctattttattttttcagggttttagataaataaaagaatatacagtttatcctctttatatgtaaactagctgaaggcaaccttgttagatagtaatgtaattgtcaagataaggtattcccagaagtttattcaatgtcatatattgtgtagagaaatcacaatgtttaacatttttcttatactatcaaaatcaccaatatagtaaaaaatgtaatgaaagttaatctttaggtaacgtggtatagtaaaaagtgctttgaattaattatcaagagattagcattacagttctttatgtctttctaataacattatggctctcataagctgttgtctgaactatggcaaaaacctgttaaccaacctcaagacccagtcctctcctaggattcttcacactgcagaattactttccccttaacagttttgattacgtcactttactgctccatgatattgcctgctccataaaattcaaactatttagcagaacattcaagacctttcaaagaatgtcactttctaattttgccatttactttacattactgcccattattaccaactcccaccaatctcttactgtaaatgccaactgcactggacaattgactcttgtctgtcacactgggcaatgcatcattccctgaactataaatgcttggctgtttgttttaaatccttttttctccaaatatgaggccactttttttgttcctgaagtttaaccttgccttagtctacagtactattcctatatttagagataatttaaagcattttaaaccagaagattaaactacttctcaacacttttaaacagctgtactgacatgctattagatactgaattatttctgtagatgctgaatttatcaggataggctaggttaaactggagtagcaaaaaacacccaaatctgcatggcataatacaataaagtttatttttttcattttcttatattgcacaaagtgaatgaactgactgttgagagccttagagagttctgaaaatattggagcaacaacaataaaaatagagcaagtctgttgtcaccaaagtgggagtttgaaatgcagcttccaaatgagcattcagattggtgtgaaaatcagtctcatgagtccgttgctatgcctcacatatacacatgcggaaatcatgggcaagctttttcaagcgagtagtaattgttctaaccctatataaaaatgttatttcattcactctctccagttgtagtggtctgctaaataccactagtaactcatgtaatactcattgaagattttttgaagtctgatatcttatacatggaagctggaaattttatttcttatgggtgtgaaccattcatatgtacacctccaggagttatagtaaatatcaattctttatctttaaatttgtcattaaacaactctattaccatatattagtcataccaatggatagctaatatgatttaaaagatgtgctaccaaattttatctcaacttgcaaacaatttaattgtggatattcttgtaaactttaaaatatattttccccacagtaattctcatccttaaaaatgggaagagtgaagaaaaagttaatctttgtgcgatgttagagttcagctaacgttgataagactaaatgaaagtttgcagcctaaggggtgacaaaacataaaatatattccagaattaagcattgattagtaagaagcaaactaaaatgtgcagattaaatgtcagatattgaaattctctgctgtttcattattgttgatagcagtaaacgttataaatctcaaatttaccaggcagaatgtcatgtaatttgtcaaatgcagtttagctaaaatgaggtttgtcgcttacacaatcaacttgttaatttggctggcacttattctactgctgttacataaattctcaactataagctacaacatacattttaatttgctggacatcaggttaaacaaaaaaatatgtattcattcaagttatgttgtagttacactgattattgtcatcagacttttccaagacttttttttcaggtattgattcaaattaaagtcagaatataccacattttcacaaataaccttgatgtctattatcctttactcttttcacaattatagtttttgaaaaagtccaatatttcaggtgaacagttttccttaaatatgacttattttggttctgaatgtatttaatgtgctgtttatttttgccattattataaaaagccactgaaaactcacagctttctctttattcagaatgcaaacagccaaaaaatcatatatatgatatatatatgattacatataatcatatgtgtttgtatatatacatctcttatgtgtatggtgtgtgtgtgtatatatatatatatatatatataattagagagcatagaaaaagcattttcagaatgataaaatagtacaaactcttcccagaatatctctgggtgtatccaaggtgatacagttaactctgttgcagagtgaaaaaaatacagaatttttttttctttttcaaaaagcctctattaattgaagaaaggtgatcattttgaatttctctgaaattcaaagcaaaaaaaattatttttgttttctcacacacacacatacacatatatacatacttaaagaaaacctcttttagagattaatacgaaatttagtataaattcagctcgaattcatgtcatagaatgttagtcctgaaacaaactcagagaacatatttaaatttctcatcttcaaagagaaaacggcctgagaggcctgaattaatgtgatcaaagaatctcggtgttacatagaagatcaaaataagaacccagatctactcaagccaagtgttcattccagtgtatcttcagtgtatgagctcaaaattccaagctattttaaaatacctactttgtgcaaataaaagttagacaaagtgcttaatatctgttctctatatttaaggatttaagtgtgatttaatgttttattagtcaggacatttcagctactaataccaaaaaagaaactcaaacagcatgttaaaagtaagttaatgcatatattcacctgggacaacggaggtgaggtgagctcaggtttggttaactcagccctattctaatgttaccaagtctctttccatagcacatttatcctgaggttaactcaatcagtgactgctagaaacaatcagaattatattttttagctcttactcaatgaaacaaaaaataaattgctttttttcttagaaggtactagcaatggggatttttctacttcattggtctaaggtaacttagcctgtccattcctgatccactcacttacaaggggaatagggtcaatattttggcttatgcagccactggggagtggatgttggggactcaaatgtccattatctatatatcagtttatttataattaggtagcattggccaccatatatgattcatttcaaaatactttgcctatatatgtgtaagttagccagggatttaactttttaagaagatagcttatttttttcaaatatggctctgccatttttattgatatgacaaaagtacttaagttctatgtgcctcagtttactcatcagtttaatggacatagtagtttctatctcacagatttttgaagaaagaatgaatacagtaaatagcttacaatgttgtatgacatatagcaaatgttttatcagtgtaatgtagaacgattattgtattatggttgttgatattgttatcattgtcttattattgatatgacaacacagaaattgtattttagcacaaagatttaagaaaaattctttttgcttacaatttgcatctggtgggaactaacatcttacaaaaagtgttgcaaacagtagctaacaatttttttacctgcagatgactaagtatattttttctatgttacttcctcaatgaacttcttgctacttcctcaaataaagtattttcataggttccaaattagaaataaaagccatagcagtggcagcgtccactgacctcctttattaaacagtgagtgggatcactgaactattctatcaacaaatttatcaagatctactctgttggccactagagctgacctgaatatgatcaagttatgtttcctgtgtctaggacagagaataacaatttttttttctgcaaagggccagatagtaaatatttcaggctttgtgggttatggggttctaacacaaatattaagctctacctctatagtgtgaaaagccatggacaatatgtaaatataataaataggcataaccatgttccaataaaattttacttaccaaaaagtatgtggaacgttctatgaaatgagggtaagacttccctgctgtctccccttcaaggagtaaaacacttaaaccctatggttaaacaaaaatgtggctgaggatatcaggtcaagagtattaaaaactgggaaacgttggaggtgctgaagaattctacattcccaacatcagtggcttctttcatgtgaaaggagttcttttaaattcttccttagctcaagcttctctctcacttctcactagggaagaggaaattatttaactgatttgtaatttcagaattagaatacacctccttttcctacctccttctctctggtgacccccaggaattaaattactctctgcttcttcatagttttgaagaggcaggctctgtttctgaatagggaagcctgccccaatctagtgccaataaccaggtaagtctgattccctgaatagatatttagcaagtcacttgccctcagatgcaagctacattctagtgttagcttcattaataataaaggtgatattttgatctctcatatttctaagccataaatcactacttatctatgatttattttatttcagactttaatagggaagggaggtgctgtttattgtgtgctttctaaaattctaacatgtattgtcttattcatgacacatagacatagattacaatttttcagaggctttttacgaactcagctagtgtttgcaacacttttgtaggtgggcattaagttttaatatggggaaaataactttgatcttggcagtcggcagaggctaaattgagcaattagatgttcttcaattgactttttaaatgtgtctttagactgagtgaaaatcacacaggattttcagcatgttaggacacatcagtttatggtgttcctgtttatagataggccaccttcctgtgtatcttaagggagtggcatgaaggccttacctactttaagcaaaagagattgcctctaatttcagtcagaccatgaataccttcacccaatactggctgtgtacaagcctactaaacaaagtcagattatgttgattcagcaaagttatggggttctgcagagactgcacctcagcaaagggcataagagcaaaaaaaaaaaagtagctgttgcaagctttagtaaaaatgctgctcatgcatgtcagaaagcacaatcatgggcttgcaagtttgaatgaagggcccactccaacgctttaactggcttggttggccttaggtataggcagctatggcttgacattgaactacttaggtttttcttacacagtcatggctgaggctaacatatgatataggaaaaggatggtattcatactggcattaagcatttgtgagtagcataacatttgttactttaaattataagatgaattattcctgtggatgctctagttaagatttacttttaaatcatctgtgcttagaccaaggcagtgttatattaagtaccccaaattccagtgggtacttaggaccgaggaaaattcaaatccttgtcctcaggattaagggccataaaactctccagagactaaatgagttgcaaagataacaaaggtaagaaatacaacacatcttcaaggacatttacggaattagggctctgaggaaaggaaagagagccaggcaagacaagccaaggcctggcctgagttaaatgctattctaataagaggtatccactagatatgattttcaaacaaaaatgtgaagggaataaatacttgattgaacagtagatgcttgtgtcagactcagagcttactgatttaggaatatgaaagaaaaaacaaatatttgggccacaaagtggcccccaaaaaaggaaagaaagggttgagaccaaggaaagaaagtgctgcctctactgtgttagaaataagggtccagcttaaggagcaggttaaattgctaagcacttgctgaattggcctgtaggaaggaagagaagaacagggaaatgttagagaaccctttaggattaagaaaagacaatgtatttagtagcccatgacagaagattgggttttctctaagccattaggaggccaaaacttgaaaaacaacagaagcttcagtttaagactgcattgaggataattctccaactgaaagaaacctaaggatgttaagagaagtttccataggcagtatgtgacagtggactgactatgtatttatttatgtttttgctcaataggcaacaactccttgtttaactattcattgatccaaaccaaggtggtgaaaaaatcactgttcagtgtgtcttttccctttccaaacctaacacccactcaatgtcctgattactaggctctagcagaaatccagagaacatttcctagttttctataatcatttcacttagaaaatcctctcaatgattatagaagattagttctgagccccaagattgctaaccaccaaatgaagcatgtcatatactcagttgaggatgctattagtaaattcctccaaaataaagcacttcagatggactgaatttcatataatgaatccaaaggcaaatatgtattaattattgggcctaagggttattgaagtagactagtgccaatgtttactattcattaatttattagtcaacaaatattcatatttctatattatgattatataaatactgaggatttatatttaaagataatagcagactcagaaagaacccaagagaaaatagacaaaggaaattatatgctggttttaaagaagtaatagctatttaaaaagtattgtttttccactgtaaccttttattgtaatcaaatgtgattaaacctagttacagagaatctcaaaattctgtgaatacagggtttgtaatattagaaataaaaaggttaaatacttaattcctgggacttagactgttttgtgacatggaaagttatgcttaaattggctcaaagtaaagcgagaatacagttatttctgtggctttgcaaaatgacatatcacaatcaattccataatattttagttttaaaaaatatcctctgtgagaaacaaagtatcttacagtatcttgcattgtcttacaactcgctccagagtatctgtcagataacaagagatcaacagctatgatgcaccaacaaaatccaaaagaattcaagggattttgaataataggttatttttaaagaggtagcattttgttagttttacaatcatcatggtgtatataactcattgtcaaattattgatttaacatatttactgctaagtagacacgggcacaattattacagttgatgaattgcttgcacattggcagagcagcaggcatgcggtctgtatgttaaaaatataaacttcaattagaagctatccctggatctgtttctaaggaaaactatccatgtgttccacatgatcaattctggaataaaccaaaagtcaacgtagaataatatagaatcatgaatccccaaggaaccctaaagggtcatctaattcagcctgtggctgccttcacataaatcatccaggcttaatgaactttggaaggcttttaagagagataactagggaaggaggtgaccatattcctagaagtggaatcttctcctgcaaagagcctacagccattctgttacaatttacactaatttattattttttacagttaatacactagaaaatacaggtcactataataaatgacatagctaggataattattctagttcagaatttcagaatattggtccaagcttttttcctcatacaccatcattatagtacaggtaaaaaggaatgcaaagataaggttttctaaacattggctcattaaaaaaatcatttagcatttgtgtgtaaactgatctatagagatttattggcacttaatcaagagagacagtttggagtgctttttcatgctaagcagacataacatttttgaagaaaatcttagaaagagagaatcttattacagccgccactttatatgacagtttattattgccaaaatgtttgttaatgtataaactgcttatacattattcttaacctgaaatcatatagagagagcaaaaagagaaagaaacaaaaaacagctgaaaaatggtaatgatatatgcacttttcagaaatataataccatagaaaactaaaaccatatctaatctatttaggtcatttccttagtacagcaacaataaaataagcataattgggaattaatatccatttaaaatgtatattaaaatattgcttatgtcctaacaaaattatcagtgaagtgtcaatataaatattttagaactaaaagaagataaaaagctgatattaatccttatcttttttcatttattttaaaactataaggatatattaaatgtgggatactatcaataatttcacagttttataatttttatgtgtactttctagtgagtatttacatatgttattttttaaactgtacaatatgcctctgtactagattgtaaaggtgtacctacagcataatattttttaatttatatcaatacctattatttgagtatttactatgtgttagtgctagaagtcaaaaccaatagaaatataaaagtagttctaggcctcaagggatatgaacaattagtcatacctttgtttttctagaataaattttacagaacttaaatctaatgtaatatatgaacccagatcccagttgaacaaaatgtctcaaaccactggatggcaacatgagattttctacatttaattacctatgttatctgtaagttcaacccaattatttgtatagttcatacttgattaaatttggttttaaatacatgaaactgttaagttgttttgacctattttcaaaaaaggatggaagatttttaggtaatacaatttaaaaaaataatctcttctgataattcaatattaataaattcaccagaagaattttcaaatacccttaatttggccaaattctaagctagaagtaggaagtcaagcaaatataatagcaagtataattgcttggctcagccaaacttggacttcagaatcactccagatataacaatcatacaattgcatgctcactggcagattctctccttttacctggaaagtgctcataaaatcaaaaagagatgtaattgtttacaaagtgctattgtggttggcaccatgggacacccagtttactgtgttgtaatagactattgttaaaatgaaattaaacagatgagtattcactatttattatttataagacactctgccatatgcaaatgcaaatagataattggccaagaaattatttcaaaacaaagtctgggaaaattctcatgtataaataactttagaacaaagaagactaactatgtttataataaaaataaaatagagtacacatgaattaattaaaacaaattatctgcttaaatattcttcagtgaaaagtaaacgtagcagaggcaacatgtagatagcatgctaaagttacaagactttgtcatcgtatccatggaaaagtatataggctttggaaatatgcttctaatattcaacctttctgtgcttctttgtaataggagaataaaatccagagttgttaggagaagtaacaagttaatactcgtaaagtgatttgtatggtgccaggcacatagtaaacctttaggaattatttgatattatttaatctatttctatatgatctgatactttgtttcttacttagcacagtagagcacatttttcattatgttatggtaatgctttagttggagaagaatgatgaaaaaatgctgtctcatagaaagacaaaagaactatgaagaacccagctttctgttctttagttttcagtgctcacatactgcttttttatggagagatttattagagattagagaacttgcaatgtaagaaaatatgttcacaggttttactgaaatttataatatatcattgtacatagaccatagaaatataaaatctaacttcaaaatactttttgctaagtggattttaactgtggttaaggggctttcaaattcaaatttgtaaaacactagtctctagtggtcagacaattgagcttttcttttttgtatacacatgtgtacttgtggtgtgttaagtgtacatatcaatatgcataatattttcacgatgtaaataaatccatttactagttattcaaaatagaaaaaagtatgccaatattggaaatataaaaatttactatagattttatattaaaatatcaatataaatattttaattaatataaaaattttaatataaaaatattttatgttaaaatattaaattttaatataaaatattcagttttaatataaaatctactaatttcttatttttgttttaggtacttgttaatgcaatgtttcttctatcagcttagactgatagaatattgacattagataaattgaaattctgatttttttaaaataacgtacttcatcaaaaggcataacatgaaccatttgtttcctcattaaaatgttaaggagttggcatctaacattacatatttttatatacttctggttacatattgtggagccctttacaaaggttgtcttctttctgaattcatgattaatctttagaggacacatgcttcatgaagaggcctcacaaatgaataacgtaatgatagtgactcaagcacactttggcacagtctgaaaaggcagtcacccagcaaagcaattaatgtcagaactaatttagttctcagcgaattttattaatgattagaatgtttattcatttaaaaaactctgtctctctatagcatgaattgaaactgtgaattaagaagtgaacaataggtatccttccttttcatgaaagtggaaatctagggttcagaccgaattgcaatgtagggaacctgggccatataagactattgccccgaataacaatataatacactaaaactgaaaatgaatggtcaacagttaataaatattgagcatctaccatataccaagcacaataccatatgttttataagatttcctcaagtaaaatattttcttttagtgactagttataaaatatgtcatggtagttaaaagatagaaggtaatgtctaactgtttaattttgtcatacaaatcaatattttacaatacacattaaaagcaatttttatcatcaataacagaggcaaactcttataactcagagtccaaatatttatgcttttaatttatttgtaattaatgatgacagaaacctctggtttgtggtatgtgtatctctccagcattcaaattaagatgtgaatgcttcaagtcagattacaaggaataataatataaggccttttaaaattcaacgcagtgcaataaaatgtgtagtattacaagaaatgaagtaactagacagacgaaagattcataaatattgaaaaagcaaaggaactttttaaatttttttcagtatattaatgactaaaatgttgggaactgagattagcattaaccacagacaaatggacagtgcttggaagaataaaaatgtattttaaaacttctatataaagcatcagtttttactatgcataaaaccacacttttttgttttaatcatgcatattatgtggtagaactattaaaagagaggaaacctttaaatacatcaacaccacagacactaaaatcaacagaaaattttaagttttaaaaattgcacaaagtctacagaaacccagtaatttatcctaccaatgaactaattatttattaggttgaaatgaccaacattaactaatatttggaggaaaaggatggggtggataataataagaagaagaatatcatccaatatgaagagcttttaatgggatctatgtaattgtttggagacaactatatccacaagcttataaagcaatttaaatgttaaacctaaatttagaaaaaatattatgtttgcacataaagctttgttaccctaaaatgaaaagtaacaaaataaaccacaactccttatttaactatggaatatttctgaccatcttatcttagaaaaaaaaatctttaaactcctcaaaatatatatttacttgatagaaattagatttttcaaattattatctccttgagtatcaggcaagtttcaattctaatagacattttcaaattttcagaaatatttttactgaacccagagaatactaagaaaatatttgaaatttttatttaaactttatgcaaataatagctaacaaaaaatatttatttacatttctttgtgccagtactggtctagacactttttacggtctcaactttaacggctaatgtaatattcataaactatcttataaaataagtaccattatcctctctttgcagatgagtaaactgaggcacagagagtgctaaaatatattgcctgagataacacatatagtgtttcaaagacataactcacaagcagagcttatacccttaaactcttataagctatgttataaaggtgactttgtactgcaggtttcttataaaagtaaattattcttctctctgttaatgtcataatgcaagaaaataagataaacattaataatcattaagcatacacttaaatagcatgtgctattccttgttctaaacactttacatatattaatccctttaatgccaagagattttaatcatagaacttcaagcctggaatgtacagcacccttattttatgagaatgctatagccaagagaaaacaagcaacacccagaaaattgttaactttgacaattgaagaaatttgaagtaatttttgtattacttattgtactatgcatataacctatatcttttttcaataataaatcaatttattagttacataaaagagtatgtaattgctacatcagaaatgagaaagtgggaaatgtgaaaggtaaattgtcaaaagttcataaatataattaaataggatcaatgtctgaagtccatgtattcataaccaaattctaatgatttctgctgagtattattcaatacttaacatacatttgtagacatttttgtttcacagtcatttttaagaacgtgttgtatgtctaaaactatgctaggcaattttgacacagattaaaatatgcccctttgcttacatatggagccatctgaagtcccagttcatgctggtcctgtttttttgttgttgttgttgttgttgttttctatttagcctttgtcttgaatgagagtgtcctaatttggatgttgcccccacacacaccaaaagattctggattttagtcatgacgaagacaaggaattatgtaattaaccttcttaaatattagtttgaagaatatacaagatgctgggtgtgtggagaagaacaattaactctacccagggagttacttcggagatctacagctggaatggaggattaaaaatggaatgggaatccatcaggtggttaaagtgatgatagacatgaggaagtaatgtagagagaagcaaataaattagtacagatagcatttagcagagatacagtaaaaggagagactagtctgggtcaaactgaatgtttcagtcagtgccttctctgctttaagcacagttctagaggctaaagatacaatggtgaaatggagagaatttcttcttccttctgctaatgtcataatgcaagtaaattcgaaagcattgaaaggagactgaacacaaaatatgaataaactagaatagaacacctggagcaatcttaagttgtaattcctattaaaaatattttgccatgttaattcatctatgtctagagaaataactggagcattgaggaaaaaaagtaggagaggcatttctttcttttcatttataatttttatttctgattcagaagcctttattatctaataataaacagctaataaagtagcaaactacagcagacatgactctaaacaagaaggaatataaaaaccaaatagcagagctgcaaatcaaaatgattaaatataagaaatcatctagcaagactttccagagcccataaaaagggaaaatctgctcacatctagaaaagggaggcaggattataaataagaacaggcaaaagccaaactattgactaaattgcaagtaaacaaaaagaaacagtcactttatgatagaaatgtagaacatttggctaaatggaacaatgaatgcttcgttaaaaggaaatgttattaagtactttacatatagatgatcaattttcagaatttttctaacctcctgcagtctttctatatcagtaggtccccttcagtttctaagaatgttctcctcccttttgtaaaatgatttacaaggccaagttctgtattccattgtattctttttttttaattatactttaagttctagcgtacatgtgcacaacgtgcaggtttgttacacatgtatacatgcgcctatcttaactgagttagttctcaacattcagactggactcaacatcacaacatgggtgactggaataactccccttctccttacacttaagtttactatttctcctcaattaagaactgccaagaggtactgggatgaaagtagatttttccttcttttcagaaccatcttctccccaatacatgggtcccatacttgggaccaggatatacaggaactccaattgtcaaagggactaaggggtcctgaaggaaggtattatttcagcttattttgtgagctgcatggccaacagtatcttcactagaacatagtagagttggataattgtcttattcacacagtgctagaaaaactcacatcacaaggatgatttcctgcattatatgtgtaaaattcaacttctgaactgaatatatttctgtccatgctatcctcattgtctcaagaggggaaattgcctctcatctggtctcttgggtctgatttcatttatcctcaaaccattctccacagagcagctaaagttatttttaatgcaatctgattatggcacttggattattaaaatttaatgagttcattactttctatagaataaagtccaaataccttagatatattctcagactttcaccacctactttctctgaggcatctttcctgattttccaggcaaaatgtattgcacccaggactgtacccttcatatactgtgtacagttgtttgtttctctcactattctttatttctgccattctacaagttcctaatatctactcctttctctcacacttagcacgtaatgacatccaaataaactgttattagttcaatggattaatgagtgagtgagtgagtaaatgcacacacctgtctcggacaatggcttggttctgcatggaacttttggtcttttcatatttgtagttccacttggtgtaacagtggattgaaaaaaccactactcttaacattggaatatgtgaccttaaattctggtaccattttatacctcatgaatgttatattctttggcttctctgggcccattttccagtctatgaaatacagtttcttacagaagagttataagcatcaaatatgattaatgtatgcagaagcttctcaatagcttaggtaaatgtgtaaatatctaaggtaccactgttaattgttataaatatctatatgataatacaataatcaccactattgattattataaataggtaccactcttgattattctgttactacttaaaaactgataaattcctgtgatttataattactgtgatatgtaagattattattatcacatgtaaggtagcagaagtagccaagcctacttctctcagtagactgaataaatgtttatattattttaatgctaagataataaagaacagattgccctactcaccctggttggggctagagttggccatatgtgatacatacatgttggtgggaatgtaatatccatggatattactacatacatgttggtgggaatgtaatatccatggagccaggagtcaggtcagacaacaactcggcaactagcttcttgttatatacgctttttagtcacatatcctaaagtcatatcctaagtgaggatctcaacttggacttggaagatgacaataacttggaatcacctgtccttcaatagccaggaaagttggttcttgaattagggcttaaagaatcaaaatgatttggatagaatgaaatggaagctaaagggcattccagaccagaataactcttaaatgagtgagaccaatagaaaaaaacttaatgagaaatcgagcaaattagacgtgtgctgtgcttggtggcttcagcattcctttcttactttgtgtaactgatggcttttgttgtggaaacagtgtaacagatggagtcaatttgaacaaatcaaaatgagcaatgtagacaagacatagagtaagacgttaaaccttttatttcccttaactatcttttgttatttgtatttttctttttattttgtatgctatgaatcactaatgattctctagttttaattaataaacaattctaaatacatctgtcatttcaatgaacttaattaaatttccattggaagatttaataatatattttctgagtattaaatgatatcagatttttattttctcttcaatcattgttttgaaaacatattaccctgaaaaacacatacaaaagtgctgtattttaaaaatttactcttcttaacatatttttcctactagaagaggcaacatttactttcattatttaatatgaattcatgtactcatttatttaacactcattttaatcaagatatgcaaaggtgagtaaaatatgggctttgaggctagggtgtccacagctaggaaaatatatattatttaaataaagaggaaatttctgattaattctttgctttcttaacctgataccatggaatatttataaatactgaatattaagtaggaaactttgatttgcttaatattgagaaagtagcacaattagcaagttatctcttttgaattaaaaattacaactggattatagtttagtgatgaaaaatccaacaaaactaccatgtttctcttgactttcatttagttgtctgaaatgaatagtggccttgcttgtttatactgtaaacctagtagttaatttttaaggcacaagggctctgacttaattttctttgcttcattccactgataagaagaatgtctctgtgtcaaagtcattttatattttttattgtcattgtctcattctattatataagcagatattaattctaagtatatctttcttcttaagtagagttcagtcttgtttctgcctccactttgccatccattacatattttcttttggtattatctttgaaaattattcagaaaccattttagatatctattattctttttgttactgttttgagataaattataatgttaaatgttataattataagctttcatgtcaaacacattctttaaactttgcggatgctaatcattttcttttaaaattatgccacatgattattagtttcaaatttttagtttcaaaagcaacaagtttatatttttgtcttggattggattctctattttacaaattataaagttgtccacataatttagttgtctcctgtttgttgtatattgtaaaggatttatgccatagtataaaaataatgaattatggaagtgaattattttattatcctaatattgtgattttatcattcttcttcacttccactaaattctgagtaatgcctcaaatcccagtttaattaaatatatattgaagacctactactatttgccagaaaccataggagatgtagtaacagacacaatgcaagtataaaagacttcaaaatactatttgttttgggagcacacattctacaaagttattctacttgcacatagtgtacaacagaagacaaaattttatctgtgactgctttgcaaactcagaaggctgaggccttgcatagtcaagaagggctctgactgtaatctttgctcaagccaatttaaaagaagcattctgcattcaaaatacataattatccttaaacatttagttgatgatctgactctagaagaatagatagaatttggatatcttacatggttgaagaatttcataatgcattccaggcaagtaaatgaacatgagcccagaagcagatgggcacagtgtgattgcaagaacaagaaacccactgacaagagcaggattagcaaaagggcaggggacataattgataaaatagaagaaaagtataggggaagaggtattagaattagattatactgaaaagtgtaggtagaggggtgatatactaaactgatgtgtatgtaaaatctcatgggtgagtgtgacagactcacgggcaaaccagttcggaaggtatcccattaacccaggcatgttacaataacaacccagattgagatttggaaatgtggatataaaagagtgattaatgatgctgttttgattatttgttttcagaaataataaatcttggtaactatcttgacaaaaggaaggaagaagaaagatgaatcagagccattgtacatttttgagcctgggtgaacaaaaataatggtaatgacatgcatacaggcaagggcactgggaagtgagcttattaagagtctgggtatagatggagtgaaaggtaaggaaaaccaaacacaccaagttttcaaacttccatcttgggtatagttagagttaatgataaagtatattaaaaccagactcactttatttagacactttcattctctattttgatttgtggaagttttctacaatctctgttctctaagagcatcaatcagtatatttcatataaatagctattgttagtatcctttaagttatttattgctctaagtgattcatatatttaacttgtttaatgctcacaataccctatagagagttactaaattattattatacaattttatagatgagaacagggaagtacagaaaatcaaatagcttagcgaaggtaacaaagctaataggtcctgaaaacaatttttggaacccaagaatcttctgctcttatctactggtatgtagattgattccttcatgccaaatagtcggtttagtataaacaagtcacatcttctctacctcttttagctcttatatactcatttttttttttaatttaagttctgggatacatgtgcagaacatgcaggtttgttacataggtaaacatgtgccatggtagtttgctgcacccatcaacccatcatctaggttttaggccccacatgcgttaggtatttgccctaatgccctccctcccctttccccccacccaccaacaggccctggtgtgtgatgttcccctccctgtgtccatgtgttctcattgttcaactcccacttataagtgagaatatgtggtgtttggttcctgtgttagtttgctgaggatgatggtttccagcttcatccatgtccctgcaaaggacataaactcatccttttttatggttgcatagtattccatgtgtatatgtgccacattttctttatccagtctatcattagtgggcactgggttggttccaagtcttgcaatcataaatcatgctgcaataaacacgtgtgcatgtgtatttatagtagaatgatttataatcctttgggtatatacccagtaataagattgttgggcgaaatggtatttctggttctagatccttgaggaatcgccacactgtcttccacattggttgaactaatttacactcccaccaacaatgtaaaaacattcgtatttctccacatctttgccagcatctgttatttccggacattttaatggtcaccattctaactggcgtgagatggtatctcattatgaaccatcaaaataagcatagaagataaggacatttaaaatctggtgattatatgtatagctaactttatttcccaaaactcctcccaccaaatctgctctccaaacacggagactgtgtcatgttattttatgtctcttggcttttcacatattaattcaaccgaacagaaaattcccctggctaactagaaactgctaatcagcttttatgcttgtaaagcatactgtggttgtcaacaactgtctgggcctgattttgttttcatttgttttaaatctagacttttggagtcttgctgctatggcatgcctgtgcaattgagtgtactaaagaaattcaggagtgagacttttgcactgttttagtgtgtcctggcttaattatttttttatttttattttttggacaagccagaatgatctgctcatatcctacctcttatctgtcttttttttaggctgctttcttctttgtacttaaagctcttagtacctcctgcaaatccacctggcctcagagtgctttatagttccttagttgcttccccttatcaaaatgttcatgtctctgattttgagaactgtaacataacaataagttatgttaataagataaacaaatccctgctcctgagtaaatgagataatgtgctatttcttatagtttgatcatttctgcttaactctgaaatgccgtgctcattgaagaggcctttggaaagttataatgataccagaaatagtcattttggtctactgcaaggtaacttttgatggggacattactacaagtagacaagtaacactctgtttttgataaagagggcttaaaaatcaagtaaaggaaacaaatttatatggggtataaaaatttgttatgatgaaaatacattgaataaaatgataaaaaataagtacatagaactgttagctaaatgtaatcatttttttcagattccctcccctgccccagaatatcctgtatacagatccagttattttttaaaaatcttttcaggtatctttattttagtatttaacagctcaaaataccacaaggtaaatggaatagacatccattctcttgttttacttatgttgaatacagtttatagaaaaggcaatattttattaattttaaaggaccataattttcctgcttcatggtacgtatctgtttgctcttagacaagttcctaggaacaacaattttatgtttgctccaggtacacaacatctataatataaatataaagctgcatttaagctgacattcagtcatcaaatttcctcattttaaaaggctaaatcacacattcaaacaatgtgcatttctgagaaaaaaaaattgtgtaggtatggcaaaatttttttgtgtcaattaaataccaatggtgttcaaaatgtctccaacatgcatatcaaaaggaaattgtgttaattatactgattaaccctagtttattatgtttcaccaagtaagtcctcctagaaaggaattagtggaagatgcataaacattttaaattcaaatgcagagtgtggtaaattgttaccacagagacttaaatggattattttatgttctcagagcatccatcaggaaaaaaactgttttagaaaaccaatgtgattgtgtcaagatgatgggactaaattgaccatggcaaggtttagtcagtgtttttcctgttttcattattgattgcataacattgattatgttaactgtgcagagctccaatttacttattacgtttgctaaaataacagattggcattggcacaatttctttttatttgaggtttttaggtacattctacttgtcattattttgggagagttttttttttttttttttaagaaacctagaattcctcttccccatcttaaattctagggtttttttttaactttttatttactaatttcattgcttgggaatttagaaaaacccagtcattgatatcctctgattaagtaccttatttcctaagaaaaaaaaggaatagcatagggcgtattgtcttttctataaacagtattcagcataagtgaaacaagagaacaaatgtctattccatttaccttgtggtattttgagctgtcaaatactaaaataagtaatgatatctgaaaatatttaaaaaaataacaaatcattaggatagattcaacataaaaagcagaaacaaaaaacgttatggcttctttctgtgatgcagttccatattttatactattttaaatatgtatgtatgtatatacatacacatatatatgtatctatatatctctgatcattgaaaataaaacaaggttctgagaacatcctcattaaaaaaagattaaactattaatcagggatagtgagtacctattaactgaagatgccattttgggaaagaaggcatagcccatgatctagggtttcttgcttcaagctgctactcggaaatacccaaactttggataaaagaagttttgacaaattttaaggacgtaaaaccagataagtatcattagtcactaatgagaagattatgaggataaatgcaaaggcctgggttttccaggagtgtgtatgcagtgacttaacattatcaaaaatgggcaagtgagcttccctggcataaatggataagaaagcaaaagtctaacagggacctcacctctaccatgtatgaccatgtatgaccatgaggacattagcaccagactgtcagggtgccagagtggctcctgcatgtactagttctggaacttgggcaaattacttaatcattgtgcctcaattgcctcatttacagagtagtgataatataacaccgatctcatagggctgtcataaatgtcaaatgagtaaatgcatgctaagtacttatagcagtgccatacaagcagtagctgtaattattacatttgtgtttcttttatatttgggttaatggctcccttatagtgagggtgggtatacaagaaagagtgacaagactaaaggtttaaaagaaatggcagaaccagacagcaggctggttttttttttgttttgttttgttttgttttgttttttttgccggagtctccctctgtcgcccaggctggagctcagtggcgcgatctcgactcactgcaagctccgcctccggggttctcgtcattctcctgcctcagcctcccgagtagctaggactcccggctaattttttgtacttttagtagagacggggtttcaccgtattagccaggatggtctcgatctcctgacctcgtgatccgcccgcctcggcctcccaaaagtgctgggattacaggcgtgagccactgcgctcggccggaggctggtgtttttttaaggttaatcatcaatttattctatgttagcaatgcactcattttcaaaacaatatttttctatttatgtatctatcttccttttaaacagtacacatttaagttttatataaggaataaattcattttatttgtttttctctgctattgacagttttgttttttttttaatcttgtgctggactcctgcaggaaaactaacataaatccatccatcaacagtatttgaaacaattaaaaattatattgtttaaaattaaatctgtttaaaatagatgtctgatatttgtacatcataggaatttaaaattatttcaagaacaatggtagccaggaatactcttatagcacatcaaagcatagtttctcatggcataagtctgagctattttagccccttatcagcaatgcaagttcttaacgaactgatagtttttagatgagcttaacttccttcctcttgccaaatatgttgttgccatagctatctcctttacagcagtgatgttattttattagcatgagcttaaaaaattcagttatttctgtctgtcaagacacaacatacacattctctcaaaatttgcaattttctttttttacatgctttacttaatttaatagtcaatatgaaatcgttttacaaagtaagccagtttcttcacatatctatggaaacatttggcagttaaattctcctggcaggtacactagccagttcaaagacagagagtccttgggatgtattttctattgctgaggaagctggcttgatttgaaggaaaaaaaaatccaagtcaaatcatcctttcagagttttatgttataaaattctgggggatctgaatcaaaggttacttattcttaggtaaatgtgatgatgctttttgagaaaaatcttgtttttaagcttttttaaaactgcttccgtggaattaaagtgttctggtgattgttaacgataatttctcaggaagggtttcatgggtttataggtaactcccctaggcaggtatctgagatcaaatctacagattcagctccctaactcttgtaatgcagtgtccaaactgatagtttggctacccaaacatttgtcctgaaacagcagcatggggcactaatgccagaaagtcccacaaccaagagaatggccttgactccgaaccatcaaaaactcagtaatatttaagagaggaagttgagggctgataaggtttggctctgtgtccacacctaaatatcatcaaattgtaatccctacatatcaggggaggggcctggtgggaggtaattggaccctgggggaggatttctcccttgctgtactcatgatagtcagtgagttctcacaagatctgatggtttaaaagtgtgtggcacatcccccttggctctctctctctcctgctccaccacggtaagatgtgacttgcttcaccttcaccttccacaatgattgtatgtttcctgagggctcccagtgatgcttctgtacagcctgtggatctgtgagtcaactaaacctattttcttcataaattacacagtctcaagtagttccctataacagtgtgagaggagactaaaagaagggccttgacatccatcccttcctcctgatacattgagttctagccttatagctgattagatctctgaaatggtacattcttgaaattcattatctcagccctcagaatgatcatcatccttgcttttataattattccctcaagttttagaggacttttataaaattaggatatttgaaaatcaccctaacattttaggaaaacttaccaatgacacttctgttatgatgatgaatggcccaaatataagaacccatctgacaatgttttgctagaatttagcatgaagaaaaaatacttttgttgaagagtcactgctcattctttgttcatttatttatcaaagaaatattggccgactaccatgggggccagagtctgttctggatgctggacattcactactgctgtcagaaaactcactgtcaagtcacagaaagatataggaaaagctgacgctatgaggagccagggaagactggagactcaggaagaagtctatagcaagaagtggcatttggcaaggtgtttcatcataagtaaatatttgtatgtagaagaacaggaaagggccttagggacagatattagagctttggcaacagcacagatgtgaaaagtaaacagtgagaaaagttatgtgcagttgagagagagaagttccatgtggctagtaagaaacactagcaggagctgaggttgaaaaggatctctcagggtaggtcgtaaaaaacttgggatgctaagctccacagtaagttttactctgtggatgaggaagggtccataatgaacttaaatttaaggcgaacaacatggtcagatttatgagatgaactgtttgtgaattttataatggaatagactgttattgtgctttgaaaattcctgtattaccaggatgtagaacagattcaaacaaatagcatatgcttaattactatctgttgagtcgaatgcttagttatgaggctgcaagagtctaagggtagagatacagaataatgttggagttcagatatattttaccattgattcctcttttggatattgacattcccataactttttccttttcctgaaggctaggcaattcagagctatgcaataattatatgtgttcctcacagttggcatgcatgcttcttcctttttgtggcttttattttctgtttccattatattgatgttaactcttttgtagcttttatcataggccacctcaaatatgttttggaaatatgttgagtgtaaatgaacccatatttatttggaaacttttaggttaacactgctttcgtatttcaggcctattcacatggaaatgaccttaaaagatgctcacagccaccggctcaccctcaatgatgcgccccctagaggaggcctgcagcccactcaggcaggctgccagtcttattttggaagacggcaatggcaaaatgcattctccttgttatgtccacttgtctttttatttttttgtggtttcagaaatatacaagcattgagttgtcatgtacagggaaattgtctaaatgcagctttaaaaaaatgatatacatatcaattaaactctttaaccttctgggatttcttcccaactttaagaatctaaatattaaaggtaatctatggacaattcagtctgcaccatgaactataatcacataaaaacttcaattatcaacacttatgatctgaacttgctttttggtacaatagaaataataataacctaaagtgttatttggcattgttgaaggcacctcagtatgctgatatgcttgagaatcacagctatgcaggagcctacggcaggttgaaataagtgacagctttgaaatcaggaaatgtggtcctttcaacatcaccttcgcacctcattcacagtataattgggaaagtcatgcaatctcctgaaaatcttacttcctcatctgttagacagaaattattctttcatagaattatgaaaattgaaaaaatgtgtataaaagtatcccaatacagtatactgtataaaattgtattttaaaactgatgtaagtgaattatagaaattctggttatgggacattgcatttaacatagtcagtaaatttactgtaaaattaatattttcattatgaaagagacatatattttaccactctatgcccactattcatctatcctgaattaaacttggctgaaaaagttaaatttaaaaaaaagtttggtttgaagagcaagtatttcctaaatgtgatagcttaatgataacactgagttagttctaatctaacattaaaggaagaaacatgtacacttacgctttggatgggacaaatttttgttattcacatttgaaattcactttagttttagcacaataaaatttaataatttattagtccctcatagcactctgctgagaagtgaatgtcttgtcaaaggatcagttcaaagtagctttacttcctacgtttaactaatttaaaactgccttacctaggccgggcatggtggcccacgcatgcaatcccagcacgttgggaggccgaggcaggcgtatcacgaggtcaggagatggagaccatcctggctaacacggtgaaaccccgtctctactaaaaatacaaattagtcggctgtggtggcaagcggctgtagtcccagctactggggaggctgaggcaggaaaatggcgggaacccgggaggcggagcttgtagtgagctaagatcgcgccgctgcactccaacctgggcgataaagcgaggctgtgtcttaaaaaaaaaaaaaaaaactgacttacctaataaatactaaagtagtcctccctccagtttcagttttttttttttttttgagatggagtctcgctctggaatatgaaaaatctttagaattttataaaaatctgatactgcaaatattattacaaaaagttcaattaaattaaacatttttgtggtaacatggtactgacaaccatcatcttgttatcaaaatatatttgaaaataaatcaacctctaaaggattttttaatagtagaaataatataaattttttttattgttatactttaaattctagggtacatgtgcacaacttcatgtcctttgtagggacatggatgaagctggaaaccaacattctcagcaaactattgcaaggatataaaattgttgtttaagcagactacctgtttaaaagaggatgagagaagaaaatgaagtcttcatggctctgttatataatcagggtgaagcaataatttaaataactcaacaacatttataaaaactcaggtagttttaaaaattgtccattccctatatatgcataatgtaacatagaaggggctattcatcatataaggcatcttttgaaagctgaagagggaatgaagtgcatttttatttcaaatgacaaccataataagagactgcatcatattgttgttttttaaatgaatacaacttggttcctagatatataataagaatcaactgggtaaagctagaactaaacaattttaaaggcataagaatctctcaagtcgggaaaaacaaatatttggaaacttggagggaggaagagatcccactctttcttcatccccacatttatttaaaaattccactggttaattctctaaggaattctcttagggtttggcttccatgacaataagctctctttgtttagttttagtttctttcaaaaaatgacaagctaataccacagataaagaggtcagaaagaatggactcacaggcaagtacactttttaagtaaagtgacaaagcaataccaagggctttgacacttgagacggttcctgagtggaacgacaaggtgttctgtaattttactgaagttgatgagattatgctttctactactttggtagtttgggtgtctgacattgtgaatgtttgcatattttcacgttagcagagatacaagtattaggaaacaatgaaactggaatataataacaatcaagtgttctattgcctcttctaaaacatttgtttaaatgaagaaagtagcaggcatgtggccaaaaaactatacatgtatacactaaagaaatgttccaacaaataagaaaattggtcttgttgctttcagttattctgtgttgatcaaaacggggaaataatgtccgtttaaagctaaataaaatataaattccaaataaagccatgcagagtaactcaaacagtatttccctagggtcaagaattatgggttcttttcacaatgttaaatatgcagttgtttgtattctgggtctgtttctccaaccttaaaatgaattgtttaagaacgagctctaatttttcttcaagccctaagatcatatgactaaggagaaatgatatccgcatgcctggcatgagttctgcttttctaagtatttattattattattattattattattattattattattattgggcttggactcaagtgcctgttgcatttgttatcttaggcttatagtggttttcaatcttgttggtctcaggactctcctatgctcttaaaaattattgaggactccgaagagctttggtttatgtgaattacattacagtacattaaagcttaagtgatcaccaatgttaagtatcacttgccagttgctacctaagctctccagtaacctttggtctcatcagttttagcatgattcaaactgatcttcgaagaaagggagctaatttccttactgtatcattaggttaaagactgtgacttcagctgcttatgtttatgcttttagccagatctagtatctttctctgggttattctttaggcaggtttttgctaacttcgttaaacagatcaacaaaatattatttctcctgtgtctactatgtaaattatctctacctcctcttactaaaagaggatggaactttttgttcacatattttgaaagaagaaaaatgttagttttaaattttaattttaaattacaaaaattacaattttacaaacacagagctgtgacaagtccctattttaatacttttaaaaggcattatagttattccttcatctttaaattttatatttaaaaatgttttccaggctgtgtaaagtttgaaggcactgtatttgctgaaacagtcaaattttatcttggcagtaattgcttctttacgacttgtctgcctgacagtgtagtagatgatctcttgatatgtagtctgaggttgcagactcctaaagctgtctgtggctactcacagaattcctcgcacctactccaccactgcttctgtgaaattatatgttccttaaagtgtgtcatgtaattgtccttagttcttcctttgctcatggtctttgtgagaacaaacttcaaatgtattcaatggaattgatgtggctaggaaaatgtatagactgccgtcattgctacattaaaataataatcaatttcaattctacggggtacacattaatggatatggtttggtgtgcggtaatttccctgtagtgaaagagtatttttctattatgtatatcaaggggcctgagtctttcttaggagcaactctctatcatacaaaataatcatgaacagatggcttttgttctgttttagaatggcaacaattatgtgtgtgatattttcaatagcgtgcagtatagaaaggaaaagaaaaatataattgcaaacttttgttagtgctacttttggagcaatataggcaagaactaagccaattcatgaagatggttgtatgttaattcctctctcccacacaaattttagtgagggcattatttcttacaataaatattgggaatcaatctctttcatattgattttattattttgttctcccaaatgccataatgcatattcaaatctactcagtaggcaatttagtctagcagcaaatggttgcatattggtagtgataatttaaaggctgctttaagaaaaagtggagaagacaaactcaaattatttagatctaaaaaaacacaaaaggtagaatatcataaaatgatacaacatctgaatgaaatttcatggacaggctatttttggtgtaaatgttcataattaattttcagcagctatattgcttttggaaataatgaatatgtactttatcatgaatatttatgaagtgatatgaaagattaaaattattagcaaaaatgttgaaaatatttttaattccttttttctaaaaacttttaatactatcgcacattgtttttttaatgtcatgctaaaaattttgtttcttatatgatatatgcagctctttaaaattgtaagaaattattcatgaatgcatttaacttctgccttaagaagataaaggtacgtcaagagattgtacaatacttaaaaatgcagactttattaaaaacacaactatctctaaaaaatcaaaaatacctctgtataaaacgtgatttaaaggttgactattagtgcgctgcacaaaaaatgaattgctgtaaattgttttaaaatcataaattatatttaaaatttaaatatgtacacttgcataatcccaaaatattggtcaactacttggtaaaatcaggtggaaaattaatcagattttcaatttttccttagtcatgtagttagagaatctgtgcatctctcacatatgtgttagcggaaagaaaccagtaaagattatctctagaatatgttagaacctgcactgtttctctccggcaatgcctgagacaattccacggagttgatagtctttgtatcccaacagccacttggcttcccacctggggccacgcttaagagatccagaccccatccttccttgggtggagcttcagcttcatctgttctgtccttctctcctcctatgccctttcctaattctgaatagcaaagatgggagaaattggtggttgatttcaaagatctgaactatattatatagtaggcaaagatttctttataaataaaaaaaatcactaaaatcaatgataattgtttatataacactatttgcttcatccagttaaggttgcagtgtagttgaccctgaagagaaggccaccacaactctctctctacatatatatatatcatatatatatatgatatatatatcatatgtatcatatatatgatatatatgtttatatttacatttatataagttgaatatatgatccaaatggaggaattcttcatattaaaaatagtttgtttgcttccttacttatctgttaatatgtcccttaggaggaaatcgcaagatgatttaggacaaagagcagtatacaatcaaaaagatctgggaaataaactgtgttcttgaggcttcaatttaatgcatttagtgtggtacctaataaatgaatatccattatgatactatcactgtgtggtttggccacatttatgttgtgccactgagtagagatggaaggatgtacgcaactctgcatcccagtgactccagaacacgaacactgctttagttagtctccctgactttgctccttctgtacatcctctcagagatagggtgttttctgagagaacaaagaaaggcatataccgtggatggctgctattcctgcctatccagtgtctatttctccttttctcttaaaaacatctgaattttgtttgtgtgatttagccattagatactaaattttgggggggggtgttaaaatgtgtcacttctcctgaacttagttttgaaaatcagatgctagcttcctaaaatgtgcatctttaggtaaagaacatataaattaagaaatatttggaagagactcatgggaatggcagtatctgaagagaccatcaatagttcctgctaattgttctcaacttttctataccttgtcctttctgaaacctcttcagctttttccctcaatatccttctgataaatactccttttaattatatgtgcatgtgtatatatacacatttatgcacacatacatacatgcatatatacacacatatacacatacatatgtgtgtacatgtgatatgtttgtacatttaataaattacccagagttgggttccactggttaatgaagacctgtatttataataaaattctgaagagttagaatatatttcattatgtaggagaagcgtcactgcaaagcatcaccaacaaatcatgttgaaagagacaggaggagatgtggaaagaatagtaccagccaaaatacgcaatctatttcataggtaggcaataaatactgcagtagggttaagcaaaattaggctgaggaaagagcacttattttgacaatgaagacggtaatcatcagagaaaatcctgtaccctgatggcccaggggaagggggagggggccatctatactgccatggattaaggtgaggaaggaagaggttaataaagagagaagagaaaatcagccttgggaaagagagttgaagattacaatatgattaatctgtgttatttgaggaaagtgggaaaaaaaggcaaagaaagaaatgaaagatttgacacctcataataggaagaataaataataaaagagattaaaagagaagaaaacaaagcacaggtgattttcctagaggaaatagtaaacacagaagtaaggaaatgcaaagagcttaaatttacagcctgtacaattttttagaacacaatggtttttagtgttcagcattttccaaagtcaggcataagatgattctaaaaaagcaataaaacactctgttttatgtactctccatctttatacttgcacattgttttatttttaatttttttctgaaaaataaagagagtttgaaaaagcaatgaatatataattcctagtactgtgttgcattgattttacttaaaggaaaaaaaaaagaaacttaagtaggattgacccaagtatccaaacatagtacattttttctacttatacttctatataaacagtttgatacagatttgcgatcaggttcttataaatctaaaattgatcaggtaattcaatttaatttaattataaaatagctaggtagacattttcataatagataattaaaaattcataaaagagtacataattgaattaaaaatggattagctatatttgagatgctgtgtcctatactcacaaaatttataaattggcaaaagtgtcattgttaaacgtactgtttttcttttatcaaaaaaccctgttgctgttcattggacagtttacttttatactttaaactgacattctatgaaaaaatatgaaatgataaactagtatgttaagcagagagaaaagtattaatttacttttgaattctgagacctataaacttgtagtatctattaactgcatgagatcttgaacaggaaatagaaaatattttactgtccctacaacaaatgattaagtgctaaatgggtaatggataatgggcagctaatggataacactaagaaaattcctcatgccaaggcaagaaagaacgactttaaatcatcaggaacatttgaagtatcaatatttatagaatttttacaggaacaattaagagagatatagagtgcaaaatgtgagtaaatgtattaactcagtgaatattataattagtgtaaaattttggtgtgcctggactggaggaaaacaattttgattaacatgaagaaaaattataattgtcaatggcggcccaatcttgtggaactttagatctaatgagaaagactatagatttcattctatctttgtaaaagaggaagaattaagatcttagaacagaaagcagtatgaccactgctgtactatggaaagaacattcttacaagaaagtgtagcatgaatggaccagaggcagtgaggtcaaggagggggtcaataatgtagaaataattacgatgccttttaatatatccttcattgaatcattcttcatctgcattgatatcacactatgtctctgattagacatagtgtgtctaatgagaatggctcattgtctgagctcccctattgattgtgatcttctctccggccaggacataatttatgtaattatgatttatgattatgtgccctagacctacctcaggtaaaggttaattaaatatgtaaaaccaagtgtgagtgaatatcaagatgtcagaagatagaaatcattaggatattagttatcagtgtaggataatgaatttcagtgctaattaggaattgcaggagaaaacaataacagacagattgaaaattaggagactacatggttccatcgatcttaaaagaacaaacacttgccttttatttattcaggacagccgggccatggccttgtgacctaagcatggtcatttgaataatccagcagaagactttatattttaatggaacactacaaaggcataaggtttgagaaattattaatagcaactacaatgtccacctgtgtccagctgttataaggggagtaatgacatccccagttaattttctcttgtcaaagttttgcctttatctgggtattcttgaaaaaaacagattcttcaggactcctcctgtgagcagtattctgtgagcaactgtttaccaagtcaggttcaacctaaccctgtctaatatagcatcataattgtcaaaggaagggctacagagagaggagaatttgaaattcaaactccggatatgttgacagcattaaagaggtgggaggaccagaaaagtagaaaagggaacaaagatgagtaagaaaagcataagggtggaaatttttattcacaaaagcaaagcagtatcaaaaattttgccttgcacattataaacgtgtaagactcttctgtcttataattatatttatgcaatttttctctattgtcataatttttttgttgaatttattttccacacaggtctatagaatttatagctcaactgtgacttccactgttgattttctactagtagttcagttacttgtaccttgaaaataaaatttgatagcaaatttgtgtaaactagtgattagtgagcataatgtattttgactgtacattttgtaataatataggcaaaatacactattttttacattttatatggattaagaataattttatgcttctcaattgattagtaaaatataaccttactttctgtaagaataagaaaatatcttgactaagcctacagatttatttgtaaaagtaagtaaaagggaaggttttaagtatcataatgattatgtatttaatttgtaaatatctatttaattttaagtaagttatttattttttcttattttttgctaaaaaaattgttatggacacctgtcattaaatgttagtactattaaaaccttatgatctcaatttttctattttagtcattttggtattttcaaatggaaatagaccctaatttatgtgattatcaagtggcaaaaagtttaaaagttgatattaatatattgatcaatttttattggtatgtacatgttgcatgagatacatatatatatttgtatatgtgtacctacaaatgtcattatgtttgtgacaaaatctttaggcaatgctgataatgttaattactaaatttccacttaatataattttttaaagaaattaatacatttttaaaatgaaggcataaaataatcctgttgttatttaaataaaaaaaaaccttaactctggctgtaactatgctttatggcaatacccaaatatcttgagaacagcaatattgaaagttttatatgctaataagaatgtaatttacatttatagccgaactttaagtaattcccatataattttattgtatattaactaggttttcccattcatatatgtgcattaaattccagcttttaaaagtcacctaagatgtaattaatttataataattacatcaaacattctgaatttatactttccatgttgctaaatgaatctctaaacattaaatcaagtattgaagatcaaagacaactcatggacacatagagggggaacaacacacactggaccttttttggagggtggaaggtgagaggagggagagaaccaggaaaaagtaactaacagataccaggcttaatacctgtaggatgaaataatctctacaaaaaacagctatgggggaacaacacacactggaccttttttggagagtggaaggtggaaggagggagaggaccaggaaaagtaactaatgggtaccaggcttaatacctggaggatgaaataatctctacaaaaaacagctatgacacaagtttacccgtgtaacaaatctgcacctgtacccctgaacttaaaataaaagttaaataaatttttcaaaataatattttttttaaatcacaaaattgattgagctgtctacctacaaacagaactgtgtaatgggtaaacaaataatgaatcatcttaaaattacatacttcacttgaagttgagtctgaagttgagtcagtcctagaatggcagacctccacagtcctaaacccttttctctgcacagttacagtcctagattctgttacagtagagcactgagggaaataaacatcttcacatttgtacttggttaaatggaattaaaatggtttcatagatgtttagtctaataaaatttgtttttttctatgaactatttaatttcattaattttatattttactttgatatcagatctagctccaaagtaatgtagaaaaacgtttttaatttaattgtagaaaaaatatagggttaaatatcaaaacttatttggaactctatacaaaacatattatataaatatatgtaattgcattatcaatttatgttgatggcaaagtcatgctttgttaaagatatctcttaatactagcacagcataaatatctgtgaaaagaatactctttcaggtttattggagaaacgttaaaaatattcactttttcatttataagattatatactgtcatatcttgaaagtcattaatttggagttatcctggtctaagtaatatagtacaagaatagtttttctgggtttagtaatgagcagatagggccaaataattatgaatagaacctcacaaattagatacccaaaataaggcacccagatttctagtgagtaccagaacaaagatgtctgtgttggcacagaggcagacagcttgagggatgtctaactgtacactgtaggataatttgccaggagagaattttgggaagattttggtaaataagcaataggcagtgggtagtaaagccatacctgtgggaagtaaaaatgtatggcaataactgggtagggtagaaaataaaaaatggtttggcagtaattgaaacttcagtaaccaaactacaagcatatcaatcagcacaattttccagttggtaaaaaagattaaaaacatcaagagttgttggagaacaagcggacaagagcctaggtagcagaacaagggcaaagtggagagctcagttaggaatgcttccttccatttatcttgccaagggaaaggatcttcatgttcatgtgaggcatgtgaaagcctctgattaattacttctcatattgaaacttaaagggctctcagaatagaaaataaaaaaattacttttactagtatactctagcacacatgttcttctaataatagaactgtacatgtacacattattggagcacctcaaaacttccccagaaaagtatctacaagccaactcatattaaatctttgtttctttttacgtggcaaacatgaaaataacttacttggcaaagcacatttagccctttgctcttttccagctgatgttgcctatgtttcattcaggtgtcctccaaaggttacttgccttttctttgtaatctagccatttcattaacagaagcaaagatgcaaaagtgccctacaaggctggcctcatttcaaacgtttacatgctatttacaatctcccatatgtgctggaaagctgatgtttaacagcttaaaaacattatccaaatttttgatgctgtcagtgtaacaaagtgacaaattcctaaagaaattattaaacctctctctcattctctatgcagtctaagaaatagacccaattgattttggatgtaaaaaacaaaaacaaaacataacaccttacctgctaataaaaccttcagactagttcagactccttctgtacccttttatcctatggctggtctccgtcatgtaatctagcccgggctggatcttagtggatgctgctcatgacattttctgctttctcatgcatactctgagtctatgtctgatttcataccgtaagttgaaatgtatggtatgtatatgtactgctgaagaactctcttgtaagctaagtttccccctttaccatataattataaacaaagtatattttatccttaaaaatagtctttagttgataatcacatttaaatgtgacctaaagtcgctattgacccgacgggaatgatatggtttggctgcgtccccaccgaaatctcatcttgaattgtagctcccataatctccgtgtgtcatgggaggaaagaagtagagataattgaatcatgtgagcagtttcccccatcctgttcttgtgatagtaaactctaatgagctctgacgggtttataaggggccccccccttctcagggaactcattcttcgccttgctgctgccatgtgaagaaagacgtgtttgcttccctttttgccataattgtaagtttcctgaggcctccccaggcatgctgaactgtgaatcaattaaacctctttcctttataaatcacccagtctccagtatgtcttttttagcagtgtgagaacggactactacagggaataagaacaaattttactgtggagaaaataaaaccagaagcagctagagaactgaagcacatgtactttagttattaaatcctgaatgcagagcctccaggaaggttgctgtggaagaggctatgatactgggtaggtgtttgagtgagcaatagtagtagtaggacaaggctaaggaaaatgctctcatcctccaggagatgagaaagagtggctcacctttagaagagtagaaaagaccaggagaacggcacctgcgagggattatgagtggccaacatccatcaataaaatgctttgacatgagtggtgctgggagtttcttgaggaaaaaaaggacaggggactttagattgttttgtgtaagtcgttgtaagtctttgatatagagatttgcctgctcctaatttgaggatacacaaaacacgcagaagcataaatgttgaatgaagaggagaaaacacattttcctcggtaaagagataaagaggaaagaaatcctagtgggcttttaaatgcctttatgtgtacctgtgactttgtgtacctcacttttagctgagatgcctcaaaatagctgtcaattatctttaaaaaacagaggaaggcactcaatgacttttgaaggctttggaaaaacggtggctataaacaagttttgtgccccttgtccacccaccaattggaggatgtgaaaaggttaacatcagagagaccacaggagtttgaaacttgaagaatatctttagagagtattgtctgtgttctgtgagtaccttaaactatggaagagggatagtgttccatccccatagcaaaccaaactggggaggaagggatgtcaaaaaaccattcactgtgtttcctgtatctgttggaatttttataaaagggtggataaatgtctaactcacatctagaaatataaagggtaagaaacagtgactgaaactactaccatatgcaaaatgaaaagagggttgaatttagcaagaaaccgtacttctaccagaagcatggtccaacattatgtgattcttctggacccaataggaaactctaaaacagagagaaaggaggagaaacaggtttgtgctgtcctagatcctggctaagaggttcactggttcacttgcagggttaatgagaccctatcaaagagtttctgtaaacttctgtgtggaggttgtcagctggctagggtgttctcaacccattttgagaactgctggtgagactcactaatggaggagggaatgttccttaagaaaccacaaaaatgctcctatgagtcagctttgtctcatcacaaatgagtcagaaacacactttagagttatgtctgtaaagtaagactttttttctgtcatattaattgtttttctactattaccaactatagaagggccagagatcaggtaacactaggtaaacaaaaataaaataatccagccaagcattttttcccattatagacttcttctctgtagggggcctgagctacagaagggggaacttgattttgagtggggtttgcattttgattataatattgagttgtatataaatattaatgaattaatactgtagaggataaatttacttcagaacatttttatgacttgagaatgacaaaaaaaaattctgtttcattctagtgggtgagagactggatatgcacattgagtcaggagaaaagatttagtacaacattttaaaatttttttccctgaaatttttacttgtccagtgaaccacttagctttgctacggggtactgtaaacttcatagcacatacaaaattatttacttcaatatcatttcttggaacttaaaactctcagaactctggtgtatcagttaggatttgatcaggaaaagagaagccacgaggtaagaaagagtccaatcccagaaattatgggtattaaaagaaaaactttaacaaattaacttagccaagttatttgagcagagatacaattcatgaatcagaaagttccctaaaccattaaaggatcagagaccctcatccagcaatgcggacaggcaatatttattgacagaaaacgaagtgacatacaggaatagcctgattagttacagctcaacatttgccttatctgaacatgtctgagtagttttcagcctgtgactgacttaaagctaagttgctatggttggcctagactttgttacttgttacaagaatacactctcaagttgcagtttgcttacatattaggttaggttacagtttgctatgtacagaggcagatttaagccaaatttaatttagtttatcagaaaaattgaatgtcatggaagtgatggagaagtgaaagtcaggtatctcagctgcatctggtgggtttcaaaagcttgcccagaagtcactgggaattttttgactcatgaggggctaccacagattatttcagtctgcaacaccaacagaagtaattcttaagaagcaccatcttgctatctcagctacttagagtactaaagtggatgattcaaggagcttgcccatagatatgcttgaagctgcaagaattacggctgctccttctattctgccttccaaactgcacaagtgcctcattgacagactctaacacagaactacaaagggcagaaaactcaaagaaaggttcttcttgaaaagggtgacaatgattccaagttcccaaccaataatgcagcacatctaatttggcacttcttattttgtcccttttcccttatgactttttttgtagtaacatattttactattttactgctattatgttgctcttgaagtcaggagtcatagtgattcaatcacttgttcacttatccatgcagcatataatgagagctttgactatttttcagtctctcaggctctgagcacaaggagtgataagatgcaactacccagaagtatagtcgtatcattcacacttatttgcaatgagaaacagtcaagtgtttactgagagtccatgaatgaataaacatataaatacacatttttcatatgtggacagtaagcagtcctttatctctaggacaacagaatgttgtatctaaaggaagactttaagaagatatttgaagacgaggtgctgccattgatgtgttaaatgtacaaactaaaaaattgggaacataaattgaagtatgcggtgcttttcttgtgctacacaaaaacgagtgttcaatttcagttggtaatgcttattatatgaagttttgaaacatagtttcattttatgtattttttagggcagatatcaccatatatcacacatagaagcatatatgaaacatgcttatcactcagggaattatgaattgaataagccataccaagttcttaccacctctaactagtgttagaatgtagaaaagaacataaactgagacttaaaggggcagtggagtggggtgggaagaaattctcaaagtccaacctgcatccagagtaagtaagtttgttagatgaagggaatcctaggtggtgttcgaagacaaattgaatgtatctgtatggtcttttgtgaaaccagtttgataaacaatttcctgataatcccaaggcctcctgaaatctctcaagcatatgaaattggggaatccgggggcaagactgagcaggaggtgtatggcccccagtaatagctctcatctacattatgtagctctgactgactctgagctgaattactgttttcttcacatattcaggtctttttgttttcaaatatactcgatcgctgaaggttaaaaatgtaaagcacaatttgtaaataaaacagatgtcaaaggaaagtacaaaatatcattaagtgtatctgaatgccaagttctccaggtgacagcaatgtgaagtgcacagttaaagatgaaaagaaaatagctcagttatttgggtgatcaaaagaatatctggatgattaattacatatttgaaacttgaagacatttcttttgtttcattttcttttgtcttttcaaaagaaaaaaatgtcaagggttgatatgtcattttagttaaggtttatgagctgttttttttttccccctacaggtgaaatcattaacagttttagcatttaaacagagctatttgagcttacaactaaatcctcttggcatgaaagctcttgttttgctactcatggttttagtcttcctagaagctgattgattaaaaccaatgtgctcagagaattcaaaataagaaagaatacaagtaagaataacttttgacaatgtaggctaagtcagccagtttgtttcatttatgtcgcctttcttcttcacactttttacctgattaaatcccattttcactttgtgtttatttgtttcaatttgattagagtttctgaaatgaatacttagattcaaataactatccataaagccatgtgactgtaggattttaattcatatattagtactcgcatacacaattattaacaaatcaggaaatttctacatttcccttgaagcaagatactgtatatttagtaaaattccttgataaatacttggaatggaagacacaacacccatgtggtaaaagttttctggttccaaggttttagcaaggaggacataaactattctgtgtaaaaagaggaggatgaaaatttgtttgcttcttgagagaggaatgggtgtgataaaagataataaagaaagaaaggactcaggaaaatgaagagatgatttgaataggccaagtggaactccctgaatgatgaatatccaaaattcagatttagaatggtggtaagattcttctacttgatatttgtcatgttcaatcaaagcacttcctccttcctccctcccatctgaaatctttagaaaaaccatccatttaaaaagtttagccaaaatactgaaattgaaattttatctatataaataagagattttgatgattgaataattgtttggttatttctccttttagtatttataacttctgattttccagtctatggttttacattttgtatttttgtactttttacttatcatccaggaaacatgctgaaataaatatggagctaaagatcacacatattaacagcttaactctctgagatatcaccataaccaatgctaataacttatcttctttcaatttgtagataagaaatacatgcttttgtccatatacacacagaacaaatattctttgatatatagatatatttttttgccatgatgatcttaatttttacatataaaatgtttgtaaaataattccacatgtttgaactcagctataaatttaaaatccattcaaagttaaaaactttaagataaaaattaaaatgtcttataaatttgtttaaattccttatagatgctggatatgataactttgacaggggcatagtttgcaaatattttctttctgtaggttgtctatttcctctgtagatagtttcttttgctgtgcgtaagctcttaagtttaattagatcccatttgtcaatttttgcatttgttgcaattgcacttggcatctttgtcatgaaatctttgtctgttcctatgtccagaatagtattgcctaggttgtcttctagggtttttatagttttgggttttccatttaagttttactccatcttgtgttgatttttgtgtatggtaaggggtctagtttcaatcttctgcatatggctagccagttatcccatcaccatttattgtatagggagtcctttcctcattgcttgcttttgtcaactttgccaaagatcagatggttgcaagtgtgtggccttatttttgggctctctattctgttccattggtctatgggtctattatggtaccaccacttaaaagtgggcaaaacacataaacagacacttttcaaaagaagacatacacatggccaacaagcatatgaagaaaaactcaatacccccaattattagagaagtgcatatcaaaaccactatgagatatcgtctcacagcagtcagaatgctattaataaaaagtcaaaaaacaacagatgctggtgaggttgtgaagtaaagggaaactcatatactgttggtgggagtgtaaattagttcaactattgtggaaagcagtatggcaattcctcaaagagctaaaagcagaaccactattggatccagaaatttcattgctgggtatatacccaaaggaatctaaatcattccaccatgagggcacatgcacacaaatgttcattgcagcactattcacaagagcaagacatgaaatcaacctaaatgcccatcaatgacagaccggataaagaatacatggtacatatacacaatggaataccattcagccattaaaaagaatgaaatcatgtctttgtgggaacatggatggtgctggaggccattatccttagcaaactaacgcagggacagaaaaccaaataccacatgttctcacttataaatgggagctgaataatgagaactgatagacacaaaaggggggcaatagacactggggactacttgagggtggagggtgggaggaaggagaggatcagaaaaaataatacttggtactgggcttagtacctgggtgatgaaataatctgcatagcaatcccctgtgatatgagtttacctatacaacaaacctgcaagtatactcctgaacctaaattaaaagcttaaaaataaaaataaaaataaaaaacagtgacaacaccaaagactgatgaggatgcagggaaattaaatcagtcatacacttctggtaggcatgtaaacaggtacagtcactctgtaaaacagtttgccaatttcttaaaaaactaaccatgcaactaccatatgatccagaaattgtactcctgggcattcaaacccagagaaatgaaaatttgtgttcacacaaccacctgtacacaatctttatggtagttttatttgtaatagcaaaaaaatactggaaaaaaaacctctaatatcatctgtagactattactcaacaaataaatggaacaaactattaatagaagtgataacctagataaatattcagaaaattatgctaagtgaaaaaagcaaatcctaaaaggttacatattgtataattccatttatatactgtttttgaaattataaaattatagaaatcgagaacagaatagtgattgccagggtttaaggagagagctaggggtgggaggaaaatgattgtgactatgaaaggtcaacaggagggatcctcgtggtgataggaatgttttctttattagctttatcaatgtcaatatactggctgacattctactatagtactgcataacattaccacctggggaaattggttaaagactatgttgaatctctgtatcatctcttacaattgtgtgtgaatcacaattatctcaaagtaaaaaagtttaatttaaaacaatattttaaaattaaatagacctaatttattcatttaaaaaaattatatattttttccagacttaaaatatagattatgaccaaattgttacatattgaccatttaacataggttgtaccatctctgttacattattatgtatgtatacaatatgactacatttcaatagtttttaaattttgttttctgaatttcatcacttctgaaattttaccacactgcctgatcatctttggaaatagggaaaaagagaaagtagattaggagtgagatgtgaaggcaatggatattattgacatttctattcttctgtttaggtttctaaatcaattgaaggaattaaatgacatataatcaagtatttaatggcctgagacttggaggcatgtttcccaaaatccagacttatgtgccactatttattagtaaagattcttcttaaagcaaggctaatactgagttgcataattgtgttgacttacgtactgttaaattctaagtgatccaacaggttatatttcagactaccatctatacaaaacagagcacagagagcagattccatactgtggatcatagttttagaatatttagtaatcctttgagtaaagaaaaaaaattcttaaaacatttctttctggtgacattttgaagccttttgcaggagataaatagaaatatctagattaaaaggaaataactacaacaagttcaaagctaaatatagagatttactgaatatttccacagtcaacaaatgttttcacatttgaaacagaaacatatttaatgagagctcctgggcttaatatatggccaaagttctattgcctgttttaaataacaaccaaaacaggaatagaaaaatggaaatgagtaaagcaaaatggaagttgatatgccaggcctaagggccttcttctgttcctttatattcaatgcttttaataaaaagagaaaatgcctgcatgtcaacttttgcaaataaaaatatatgggtttttagcagtcctaccagtaggatttcagaggcattcttatttctctgaccatatacattctgaaacactttattgttcacacgactatccttgatatcttgatatcttaggtaaacaagctgtttttctttctctaaaacaaagcaatgtttttgaactatgggtacaattcaatgaaatatgaccgaaataaatgcttagggtaaattaagaaagaaacttttgtttattattttaatatttcctacatacaaaaataacatatagtaagcacatcttattttatatatgatatttaataaggaaccataaataaaaaataaaatttaaaggaaacccaaagtatatgttttttgttatacaacattttacctatagctccaatagaaaatatagaaatttttgaaaattttaaatgtaaagacaagggaaaaagagaaatcacaggagagtaccaatttacttaaaagttatcatttagagaaaaacattccgtttgcttaaaaattgagaattatttcatttggagcatcattacacaagacagacttctatatataagtatatcacatatatatggatgtaagtatacatagactcacagaaccactgtcccaggttctgtagaaaattaggtcatatggtgaaatatgaattcaattacaacatgtcagcaatttgaatgactctaagaaataatctggaatacatttttccaaagtttgaaaattgattgcggtatatttcatgttcctccaggttttcacttttaccactctctttcatgcattgacaggtattcttgttttattcctcccagaatctcctcccctatatcatttatctaccagggacttctcagtcctcttttcacttccgcatcactgcatgttcctttatctccttttctgttacaatctcttattacatagtctcctttatggctctcaattccagggttcttctattcttttttctccctcatgaccttacccacttctttagagccagtagcctagtagggggctctgtccagatgttccacgtggattcaaattcatatggtaacatttaaccattatttctctcctggaatgtgttttgctttgaatcttttatcttaatttatgtcaaacattgaactagtcattcatgtcaaaaatcttatttttctattcccattacttatttagtaccaagtgctttcactttgaacactgtcttaaaaatgtctcctcccaccaatctcagccaccttaatcagccctcagcaactctaattactcctgggtaatttaatgaggaaatagctgctaccagccactttttattttgtcttcttcagtccatttgtgtattgccactctacagagccttctagaataacagtctggtcatgttacagatttggtgaaaatcttacaacgctgctttatcaaatctgttctattgaaaaattgttctatcatcaaaaagatatggaaatttgtgttaaacaataaataattttcttatattacaatgtttctaagaaatggaatatgttttctctttcctagagcaagacatacaatggtatacagagttttttgaatctattagatcctaaaacggtttatatgtatcctcccataaaacactacacagaaccagtgttccctagggcacattttggaaaacttaggtcaggattaaatctgacatgctttgtatgtacaaagaaggctctgaacaaagtaatccatgcctaactctttgtgtcctactcatgtacatcattcaatggcctggcctcaacaaactttgtagttctccaagtatgccacaactctctttttcttctttggttaaaatgcttgacttcctattagcagtctgttgaatgtctgtgtattatgatataccaattcatacacaatcttcattcttgatcatatcttgatatattcctccctctagtgaaagtggtcattatcccatttgtaccattctcccagacttaattgtgaagatgagaacgagattaatcatctttttcatccatatactctagtggagtcccaagaacattgacattaaataaatgctttttcattaagtaaatgactgaagtctagttcaacatttaatggacatctcttatgtgtcaccaactataagaattgaatgatgcttttcttatgagtataattatagtacatattttatgagattgttttggtaattaaaatgaatgactgtaaaacatttagaacactgcttgatcagtgctatatgagtttttgttaaaataaaatttaagaaaaggaatactagagctcagctgtcaagtagcttataaatctaaagcagaaaataagtttgcagacttgctgattgtgccaagcagaacacgttaaaataaagttttgaaatgtatgaaatgaagatggagaaataaattccagcagaaagaattgagatggaaactcagaatccaatgttagtgaagaaaaagattctgtaagtagaaagccagcttcagagtggctggtcacttgaaatttgtgcatgggtatttctcctattgatgaggagaagcaagaagtattcaaccttaattgtcccagtcattttcatatgcagtccatgtttaatgttgaactaaattctagtatttattttacttaagtcatatgtaaaacagtctttttagtatagtgatttttagtaaagtggctgcttcagtataattatctaacactgataagtaaaataagtaaacaattatttttttaaactttaaccaaatgcttgtttcagacacttagataataatttaaaagtactaaaatatctagaattttcattaaatatttaatgaacaagagacttagtaagtgaaaagagtagatgttaatataacttaagtctaataaaatatctttatttctctattcctctttctagacagatactcttacatgtttatatctgcaggacatgtgttcctagagttatgaaatatattaaaattttgtttggtgataaatattttccagaaataataaaattagaaaataaacatatatgcaataattttaccaattttacaattataggattgatttaataacttggagatttataacatgatattactgtgaggttttctttatttttctaagttaaaaagcatcacttgatataaaaatattaactaatgacttcgtttttgtgtttggctgttttttacccttctagtgacaagctactagggatataacaactctttattgttaagcttctaataatcttgaaaaacatctcctggctagggaggaaggaatctaaaaatgtctcattaaaataatcatttggtaacttttttttaaattttcttcaaaatcaagcagaattacagcacacagactccaaaagctaaacgtgagtacatcctttccagatctaattaatccacaatttgtcacaagaaatttattctacttatattcattttctgaacaatctccgccactttcgggttcttctgacaccccacctctaacctttgatatgccggtaaaattggagagattgccacactattttgtgattaagggcaatttcaaaagaaattgagttctcatgctatagagcaagaacttacctaaagtagtcaagaaacaagagaaaccagaaattgttttacatgagacagatctcatatttttaaatatagtgtaccactttcttaataagtaaaattaaaagaaaaatgtaacttaggatacagaaagtcctaaaggaccattactccctcctaagaataacaacaaaatataaaagttaccagctcaaagaattagctaatggttgcttttatccctagcagagaaacaggagaggattttgtagtacgcctgggatatattgtgttatgtattaataaaattgatgaaaaattgagttttgttttttgttttttttttttgagatggagtctcgctctgttgcccacctggagtgcagtggcgtgatctcggctcactgcaagctccgcctcccggattcacgccattctcctgcctcagcctcccgaatatctgggactgcaagtgcccgccaccacgcctggtttattttattttattttattttattttattttattttattttattttattttttgtatttttagtagagacagggtttcaccgtgttagccaggatggtcttgatctcctgatctcgtgatccacccgcctcagcctcccaaagtactgggattacaggcgtgagccaccacgtctggccaataaaattaaattttaaactaacaattaaaattttaatacattcagaaatattcatgcagggactgtggtggattacaatatcaaggcacccttgctatggtgtaagtctacccattcgaaactctttcccatgggccttcattgagcacactgaaagtatagagtctgggagtcacaccagtgggttgaaaaaaattctttcaagtcctctgggcctttattgcatccattgctgcagtctcaaataggtggacataaagcatgagaggtaagacaattctaccaggcaaccagggtttttatgcaattgtctccagcagctgtccaaagtctagaaacaggcttcaggacaggcaaatatctcttgaggttcagaaagtctggcaggactagacagcaataaaattttccagtaacccacaaagtcatcacccaggctacaaagcagagaatgatgttctagagtttggaaagttgacagctatctgcaaaatatttaaaaaattgggattttaatcttgctcagatcccaagtcttgctgaagacgtcataatctcattctcaaaatacttgaaagctgtgatcaattaactcgaaaccaaactgagaaccagtctacctgcagattaggttaaatcaggctccctcagtttggcaaactaggaaaattacaggaaacatttaaaatattctaggccgggcgcggtggctcacgcctgtaatcccagcactttgggaggcggaggcgagcggatcacgaggtcaggagatcgagaccatcctggctaacatggtgaaaccccgtctctactaaaaatacaaaaaattagctgggcgtggtggcaggcgcccgtagtcccagctactcgggaggctgaggcaggagaaaggcgtgaacccgggaggtggagtttgcagtgagctgagattgcgccactgcattccagcctgggtgacggagtgagactccgtctcaaaaataaataaataaattaaattaaattaaatattctgaggagaaaattttatttactacaatgtttgtgattctttcccacacaacgttcaacatataataaaaaattatgagtctcttgaaggtacaataaaatatgacccatggtctaaagaagaaacagtcagttggagcaaccccctattttggattcagttgctggaatcatcttatagggattcttaaataactgtgagtactatgctaaaagatctaaagaaaaaaaggggacaatatgtgcaaagacaaggtatgtcaacagagattgaaactataaaattaattctgatagacaagctagaaacttaaaacaattcatattagaaatgaagaatgtatttgaagggttcaaagattaaaagccatggagaagataagtgaatctgaaggctttccatagtaatcgtctaaatcaacataaagagaaaacttatttaaaaagatcagagcatatgatgcctgtagaataatgacaaatagcttctcacacataattagagctagagatggagaagtaaaaaagagtggaacaaaagaactacttgaagaagtatgtagtaatcattttctaaaattgatgaaaagcataaatctatagttctgagaagccagcaaactacaaacaagataaagtcaaagaatcaattatctatgtacattaaaattaaactgcttagaagcaaagaaaaccagaaaaaataaaagcagcagggttgatatatcacatcatgacatcaatgataagaatgacaattgacttaagaaacactggggctaggagacactggaacgaaatctttaaaatgctggaaaaactctgttaaggattctttacctgtatctatgtttttcaaaaagaaagaagaaataacacttttaggcaaaataaaagctgagataatttgtcttcggcatatttataatataaaaattactaaaaatacttgtttaagctaatgtaaaattatatcagacaaaaatccagaactccagaaaaaactaagaacccaaaaaagtaaatatatcattaaacataaaggacatttttcataacacatatatacacaaacataactacatatgcacatgcatatgcatatgtatttaacataattttaaagatggttgattggttaaagcaaacataacaatgtattatagggtttatatcacatgcagaagtaaaatatgtgacaagaggacatagagagataagaatatacaaaactaatctatggtattagaaatcataaagttgttggggcaggggtgggttaattagaaaagtggacaagagaacttttgctataatgggaatattttctattttgctttttgtgtaaatgggcatataaaattgtcaaaaatcatcaaacctaaacccttagatctctacatttagagatctaaatttagatctctaaattataaaaataatattaaaaataaaaattgaatgcatacgaatttagcatgatgaccatatttattttcttctttcttgttttggtttcaaggcatttaaattagctactaaactttttttttaatttgaatttttacttttcttggttttctttaccaaattttctaaaatgagtctgtgttatcagagaacataaatataaatctgttctatgtgaaacgaacaaatgaataaaataatagcattgcctcagcaggaagaaatcttgtttctcaataagatctttcagtttacattaatcattcaataaataagccaaagtaagccaaaaatcttagatttcatttttttctgtatttttctttttcccttttgctttcattctgcttctctgatgattatgtactttcttgtcattgctcttctttcctctttctcttttcatttgacttctaatctttggcctgaaaatacttttttcatctggttttatcaactaatactaaaatttggctgttccaattaattattttgcaactttgttagccctaattctgaaacaacaacattttctctcaatacattgcttaattcaacacattctgaggaatttaacaccatctttttttttttttccaatggacaatcatcagggaattagccaataatgagctagtgatattggcaaactgacatacagtatgactgttcaggcctttgcagacatccaatttgcacacaaaggtgcatgcacacacacatacatacacatacacataacacctatatttttctcaatgaatctcctttttgggtgtatctactaaacttcctctttggtcttgcctgtccttgttcattgtcttagtttgagatgcagctcattctacttagttttatgcttgcatctgacctactgattatcttgccttcccaacctttatgtgagttggcatttttagtctccctttctttgcactctaaactcaccaactcccaaattctctgggaatgttctttgaccgatattgaacaaaaattctttttaagtctgagaataagaattttttaaatctgactttaaggccttagaatactactgtttctcttaccttctgattaatatactcctgaaataattatgaaatcataaatgaacaaatctcattatgtcaaaccaggcattaagtaactcaagttgaagaacagaataacatgtatttaggatactaagttgtcataccaaaattaccttgggtctacaatcacaaaattaaaatcagccaggcacagtggctcacgcctataatcacagcagtttgggaggctgaagcaggaggactgcttgagcccaggagtttgagaccatcttgggcaacatagtgagactttgtttctaccaaaaaaaaaaaaaaaatcagccagtgtggtggtgtgtgcctgtactcccagctacttgggaggctgaggtaggaggaatgttgagcctgggaggtcgaggctgcagtgagccatgattgtgcccgctgctcttcagcttgggcaacagagccagaccctgtctcaaaataaaaaaaaaagaaaaaaattcaattaaattcattaaaacattgacggattaaaatgatttttctgtagcttttaagggagtatgctatcttaagtagttaaccatttttttgtcattttaacttatttaaatgtcaatattaagttcaagaacattgatataaaatatcatcttaaccttagattaagacttgcattattatattaatcattttacaacttacttctttaaggcttagttttatttttaattcattgttttattagactctgatgagaatatgaatttttaaaaagtttgttttctaataccatatatcaactatatgttattaaacataattttagcatctatttttatataaatatgtcaaaaatcacatgaaaaagcaaattatagtgtgtattttcattcatatctttttgataaaaaaactatattaactaatgataaataatttattattctgtatgaataaacttcttttatctgaagtcctcttacctgcttcgggaaaacaaatgtaagggaaaaaacaagtaaaacaaatggaacaaaaggggaaaataaaaaagatcttcctaataaactatgtaacagagatcattcaccttaactgtcagcaggaattccagaataagtcatttattcagtgatggtaacttcacaacattatgacgacaattacaggtactctctattacatggtttaacattgaacctcaacttgagttgagtcagtgcactggagtagcaaaataaataactgtgacattttgaaatgtctgcatatcaccaatatatgcattgatttttcattttaaaagtctaccctttttccaaattaatctttatattttctccccaaaatttgggtaatgcatagggctacatcctacttgcttgaaaagtgaatggaaccattcatatagttataagaatctctacaaatagaaaagaaaatttagtaaaagagagataaatagcatttaccatttggcttataatgtaaatatcatgcaatgtccttagttgaagacctgtacttattaacaaaatatatatatataaaattatatttatttctttacatacataaaaatatctattttttaaataagtataaatctttagccaatcagattatatgatttttaatttaatagaccactttgtccaagaatcttttttccctcaattaatatacatttgtttatgtattagagctaaatttatgtgtctctttgtaaaatttatttattttgttttttttttattatactttaagttttagggtacatgtgcacaatgtgcaggttagttacatatgtatacatgtgccatgctggtgcgctgcacccactaactcgtcatctagcattaggtataactcccaatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctaccattgttggacatttgggttggttccaagtcttgtaaaatttattttgttgaacacatggataaatcaatacattctgactttttaaaaagtccattttgttgattcctatttctttgacagtaaaacatatatttttattcatatggcttttctctcaaaatttatcgccctaatatttaactttgccttctatagctgctcaaagttacttattagacttccacttaacacataatctctcttgtagagtacacttaagtattttttagagacttcatgatgagtacttggttgtccctaagtttttctgacaattttgttattttaactttcatttcttgttcttaaccctcttaaatgaaacttcctatttgtgatagacttattcttttgttcttgactttccattgcaaccacctctggggtaatatttttaaaagaatgtttagaaatcaaataggagtttagctaactatgaatgagaacatattttcattacatgtttgaggaatagattttttactgggtaagagatctcaggcacaattctggctaactaaaatattggctttagctacataaggtaagacatttaataagtgtcaggtctataccatagatgtcatgattaaacaagctactaagtgtatagctaggatgcattaaaaaattgttcgggaaatttttggcagaagaatattatccagaatcagatttatgaggatgcagtaaaagattaagattttggctggtgctcatggtaatacggtctaagggaaccaaggttttatttaagcttgaggtatgttgatgtactacctaatggttatcaaatttttgtttccaggaataaatgatttagacaaattagttcataattcattaggagaaaaatatattgcttaaaatctattgataactaaagttgaataacttttaataactttgatttctgaattgatcattggtattttctttctggagccagaaataggcaaattctataattggtaaggtatgcatatttagtcttttataaagatggctttcaaggttattcaaaaccatatagtgtttttgcttttcataatatctatgcccttaaatcattttctgtatgcttatttgagattgttccttctattaggtcaagattttataaatttcaaggactattatcctgctatagtacagaatacatttgaaaggccagtggtgatagtgttttccacccagataacaatactaataaattatttactaagtgcacttattgtgtccaaggactgcaataaatgctcagcatgcatctcctttaactatcataaaaaaatctataatgggttttaattatgaccacattacagatctttttaaatgaggcttagacaacttaaattcccattatcaaatggctagtaagcgtagaactaggattataaaacagatccatttgaactcaaaatccatgttctttctactccaccaggaataacatatctagtaattgcgctgctaaccttttatgatgctcatccccgctgagcccagatgtgctctaaattagtgctcttatgttcaaatcaatcacccgagaatcttgttaaaacacagactgtcatataaatgtggaatcatacagtaattgtcttttgtgactggcttatttcacttagcataatgacctcaagttctgtgcatgttgcagttgttgtttaatgggtacagattttcacttttgcaagatgaagaagttttggagagtggctgcatgacaatgtgaatatacttaacactacagaacttcacacttaaaaattaagttagtaaattttgtgttatatgtattttaccacaggttttaaaagtagactcttagtggggtacagaggctcctgtctgtaatatgagtattttgggaggcccaggtaggaggatcgcttgagaacaggagtttatgccagcctgggaaacctagcaataccctgtctctagaaaaataaaaataaaataaaataatcatctgggtgtggcagtgcacatctgtaggcctagttactcgggaggctgaggtgggaggatagcctgagcccgggagattgaggctgcagagatgattataccactgcactccagcttgggcaactgagtgagaccctgtcttaaagaagccagaaaaacaaaacaaaaaatggaatcttatttgctgggtctgggatgagcccaaggtgatgctgatgccactggttcataagcaccctctgccatgcaagggtatagatatttttctccagggtgacctctaagaaaccactgccatttgatttgaattggcatgtaagatattaataaaacatattgagtttttgctatctactatactttctttccaactaacatgcatgtcctcattcacactagtaggacaggtgagcaaaaagtgcccattgcttctgatgcccttcaatttcctagacagttcagattctaagaatgtctttggccttggaagcatttttgtcttaaacttctgaaataattgtgtcctgaaataccttttgtgatatttgttgaaaagtttcctcctactctgagagctgagaagagaggaaccatttccaagctgctgctacatatcaaagagcctgtcttttcagcttcactgacaagtggaatgattttccggagtctgagaaaatatcaggcaaaatcttttccagataaaaaagctgctgtcagctgcctgcagctgaggaagcaactttaaatcctgtggggagaatttctattgcaacctcaatcccagattccagcttctgtcttacatccttttttggcttgactctgctcaaggagctcaccaaactaaggaaaagaaagttagcaggacctacgggtctcaccttcacactgccaatctcaaagttttctcttgaggaaaccatggtaacagacgcctgttcagagaagcaatgtaaggtgattatttacacataacctattgtgctttgtagccccaccctcacatgataaagccaatagaaattgatgctgaggtccaagtacagatttttttttttttttttttttttttgagatggagtctaggtctgtcacccaggctggagtgcagtgacacaatctcggctcactgcaacctctgcttcccaggttcaagcaattcaccagcctcagcctcctgagtagctgggatcacaggcatgcaccgccacacccaggtaattttttgtatttttagcagatacggggttttgccatgttggccaggctggtctcgaactccttacctcaggtgacccacacgcctcggcctcccaaagtgctgggattacaggcatgagccatcatgcccagcctacaggttcttctaatacctaattgaagtgtcctgacatgacaattttatattacatggcaatgtgctatggcaataatatcttctgatttgggaagtgaatatgatacaaagagaattaacaggaaagcagagaatcaagagatgccttctactatgaaaattattcccagagctgcactgaccttgaaactcacctgttgctccacggcggctgagttaatttttctttactttcccatgtgtcttcccaatatatttgcattcattggaataatcctgagttctcttgatttcttgcaaattgaaaatgcctaaacacagaattagttttgcccattgatcaagccttaataaatcttacagattctggccttgaccaaggctatgatctccactccatcagtgactggcctgagctggctctggaggggtccggccaggcctcttactaagttatctttatagttttcatggcacctgtactcaggggcagctctgttttgtatttagaaatacctcattttcaagaaagatatctgttttcattattcctattatagtcccagcagcctttaaaaaaatgtgcttagccagtcaaaatgataatcttgagatttttctaactttacctttttctcctacttatttgcttagagaaaagagtggtcatctacctctccaaactgtatgccaccactactgtgctcttaactaatatttctgatttgtcagttaggaattccttcctctctgtttcatttttttttcagaagcctccaacataccatgttttctattctttcttcacgtattactaaagtatattttcccttcccttccatatttgctattctttcaactttgccattcaccttcctaatccactgatatttcaggaaaggttctttttccatttctgctatttattaccatgtggcttacttcatcctactgagacatcatttctacatttgtaaatggggattaaaaatgcctgcatttcctactttgcaaggatttgtgagaatgaaagatggtaatacaatggaagtgttttgtagttataaagttttacatattatctagagaactatcttgctttcattttatacggtcagaaacaagatattaaataaggaagtgctctcagaaagaaagacctttgcatttaaaaatgtggttcatcatttatatttatttagtcacacaccattttaaaaagtgtcattacttttttatctgtatgatatatattatttttggacctgaactcacagtttgttaaaatgcaaagataaatagaaatcagaaagctctgaatattagttgtcaaaaataataaaatagttcacctctgaattttgatgagcaaatcaacaagttcagttttccatcaagaaagaaaaatagctgtctcattcaaatacattttttaatttatattatattaatattgctgtcacagtgaccattatgacttcaagtaatctatgtaaacatcatctaacaaaatgtacctgagaactgtgtttcatgcttaccaatttattattctgcctatttggaagttctattattactagcatacatagtttatatacttcttcccttagggaggaaaaacctctcaattatactgtttattagctaagacaagaactctagcatttacctgaatataaagcttttggatagaggagacatatagtttagtgggaattttgggcacctaagatttattgccagatattcttgttaacttatttggtctacagtgattgtgaaagtaggtttttgagccttgtcccctttgtcattccaaaactgagattaaagcaatgctcaattttacatttaagatgaataaagtatgattataaaataacacatataaaatgaccaaaaattaataattaattgtctgatgtggaccattcaagcacatcagacacctaacaattaggatagatgagcatctttcatgaaaggaaagttagcatctatatttttaaggaggcatatgataataaggactacagagcaattactttgagagtgcttctactgtcacattttagaagaggttctaatgcaagatttctgtttcatttcttatttttaattttaccaagaaactcttgaatttgcaattgtataccacaaataaatgcattaggtacaagtgcctcaatgtcctaggaaattgatgtcttagttcaaaaggaaatgctgttacagctttataattgagtcatataatttccatggttgagtagatgttggctttcaccggtccttgtcctttaaagtccaccacctgacacatcaccacaaagaacaggtaatttattattttttattgccattaatttatagctttaagtttcaaaggagaattataagttaccacaatatctggagctttttaagttttgtattcccctttgactgcttaggataatctaaatcaccagagattagaaaagaatcatgaaataatgttcaaattacggaaaaacagactttaaaaaacagtattaaaatggaggtaaattatcttagtggattatttatttctgacagatttgcctatattgtagttaaagaaattggcttttttccttgatttataatgattttatttatagaaaaaatataatgggacaaattttctttggatctaaaatttttcttaaaattcaaaattcaaatgatagttgtggtattataaatttggattctattttatttaaaatgttgccacctctgaaaatggcttaaaggctctatcacaaaatgtttgctagtaaaattaatacaatacaatctagctgtattaacacagagcaccaatcaactttaccaaacactatttgcaaataaacatttgtaatcaagaattttggagacttaaaatccatctcacttacacactagttattgaactttgaggtccagagaagaaaataatttatcagtttcctatcctgtgatgtgagaataataacaggcatatcatagaaacttgtgaggattatccctcttacattcatacgaaaactaaagtctagagaggctaagagatcttaaggtatcacaaagagaaacttgtaggtttagtattcaaactttatatgccctgctctaaaatgctacattttccttgataagcacataatcacatacagagtttcagattatttaatttcttattcatagaaagaatatgttggatgtataaaacatatttcttaggaattattatctacaaaacgggttttaaaatactgttaactccaatcacttaacagtttgagttgttttggatggttcaccagtccctataactcttgcagcttactgccatttgggtttctcagacaaaaccacagccttctactcgatttgagaatttttctttttaacctgtacactcgctaagagaatacaatttggaataagttgacagaaatagctataatagtatatgtagttgcacactgactgtttcagtcaaggcacaatcagggaaagaaagtgttgcaattaagtgaattcagatcaaagatttggttaagatggtaaagaaggagctgaggaccagtcagaacacagtaaaggaacatacatattaggaactgcaggaaaccatctagcactcctagactggagagagaaaggaaaattgtggtgtcacttgaagtagcaccagtccctgaacagaagctggagatggagacatggaggacatgtagtcactttaagaatacccttcaaaaaatcaatgaatccagcagctggttttttgaaaagatcaacaaaattgatagaccactaggaagactaataaagaagaaaagagagaagaatcaaatagacacaataaaaaatgataaaggggatatcaccaccaatcccacaaatatacaaactaccgtcagagaatactataaaaacctctatgcaaataaaccagaaaacctagaagaaatggacaaattcttcaacacatacaccctcccaagactaaaccaggaagaagttgaatctctgaatagaccaataacaggctctgaaattgaggccataattaatagcttaccaagaaaaaaagtccaggaccagatggattcacagccaaattctaccagaggtacaagtaggagctggtacgattccttctgaaactattccaatcaatagaaaaggagggattcctccctaactcattttatgaggccagcatcatcctgataccaaagcctagcagagacacaacaaagaaagagaattttagaccaatatccctgatgaacatcaatgcaaaaatcctcaataaaatactggtaaaccaaatccagcagcacatcaaaaagcttatccaccatgatcaagtgggcttcatccctgggatgcaaggctggttcaacatacgcaaatcaataaacataatccaggatataaacagaaccaacgacaaaaaccatacgattatctcaatagatgcagaaaaggcctttgacaaaattcaacgacccttcatgctaaaaactctcaataaattaggtattgatgggacgtatctcaaaataataagagctatctatgacaaacccacagccaatatcataccgaatgagcaaaaactggaggcattccctttgaaaactggcacaagacagggatgccctctctaaccactcctattcaacgtagtgttggaagttctggccagggcaatcagacaggagaaggaaataaagggtattcagttaggaaaagaggaaatcaaaatgttcttgtttgcagatgacatgactgtatatctagaaaaccccatcgtctcagcccaaaatctcctcaagctgataggcaacttcagcaaagtctcaggatacaaaatcaatgtgcaaaaatcacaagcattcttatacaccagtaacagacacacaaagagccaaatcatgagtgaactcccattcacaattgtttcaaagagaataaaatacctgggaatccaacttacaagggacgtgaaggacctcttcaaggagaactataaaccactgctcaatgaaataaaagaggatacaaacaaatggaagaacattccatgctcatgggtaggaaaaatcaatatcgtgaaaatggccatactgcccaaggtaatttatagattcaatgccatccccatcaagttaacaatgactttcttcacagaattggaaaaaactactttaaagttcatatggaaacaaaaatgagcccgcattgccaagtcaatcctaagccaaaagaacaaagctggaggcatcacgctacctgacttcaaactatactacaagggtacagtaaccaaaacagcatggtactggtaccaaaacagagatatagaccaatggaacagaacagagccctcagaaataaggccgcatatctacaaccatctgatctttgacaaacctgacaaaaacaagaaatggggaaatgattccctatttaataaatggtgctgggaaaactggctagccatatgtagaaagctgaaactggatccgttccttacaccttatacaaaaattaattcacgtggattaaagacttaaatgttagacctaaaaccataaaaaccctagaagaaaacctgggcaataccattcaggacataggcatgggcaaggacttcatgtctaaaacaccaaaagcaatgacaacaaaagccaaaattgacaaatgggatctaattaaactaaagagcttctgcccagcaaaagaaaccaccatcagaatgaacaggcaacctacagaatgggagaaagtttttgcaatctactcatctgacaaagggctaatatccagaacctacaatgaactccaacaaatttacaacaaaaaaacaaacaaccccatcaaaaagtgggcaaaggatatgaacagacacttctcaaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacatttttacactgttggtgctgtgtccagaattggtgggttcttggtctcactgacttcaagaatgaagccacggaacctcgcggtgagtgttacagttcttaaaggtggcatgtctggagtttgttccctctgatgttcggacgtattcggaatttcttccttctggtgggtttgtggtcttgctggctcaggagtgaagctgcagacctttgcggtgagtgttacagctcataaaggcagtgtggacccaaagagtgagcagcagcaagatttattgcaaagagtgaaagaacaaagcttccacagtgtggaaggggacccgagtgggttgccactgctggctctggcagactgcttttattctcttatctggccccacccacatcctgctgattggtccattttacagagagccgactgctccattttacagagagctgattggtccgttttgacagggtgctgactggtgcgtttgcaatccctgagctagacacaaaagttatccacctccccactagattaggtagatacagagtgttgacgcaaaggttctccaagtacccaccagagtagctagatacagagtgtcgattggtgcattcacaaaccctgagctagacacaggttgctgattggtgtgtttacaaaccttgagctagatacagagtgccaattggtgtatttacaatcccttagctagacataaaggttctccaagttgccaccaaactcaggagcccagctggcttcacccagtggatcccatactggggctgcaggtggagttgcctaccagtcctgcaccatgcaccctcactcctcagcccttgggtggtcgatgggactgggcgctgtggagcagggggcggcgttggtcggggcggctcgggctgcgcaggagcccatggcagtggggaggctcaggcatggcgggctacaggtcccaagccctgccctgcaaggaggcagctaaggcccggcaagaagtccagcacagcagctgctggcccaggtgctaagcccctcactgcccagtgccagcagggctggccggcagctccaagtgcgggaccagccaagcccatgcccacccagaactcgtgctgcagccctggttcccgcctgcgcctgtccctccacacctccctggaagctgatagagccggctccagcctcggccagcccaggaaggggctcccaccatgcagcagagggctgaagggctcctcaagtgctgccaaagtgggagccaaggcagaggaggcaccaagagcaagcgagggctgcgagggctgtcagcacgctgtcacctctcagtgggactgtaaactagttcaaccattgtggaagtcagtgtggcgattcctcagggatctagaactagaattaccatttgacccagcaattacattactgggtatatacccaaaggattataaatcatgctgctataaagacacatgaaaacgtatgtttattgcggcactattcacagtagcaaagacttagaaccaacccaaatgtccaacaatggtagactggattaagaaaatgtgacacatatacaccatggaatgctattcagtcataaaaaaggatgagttcatgtgcttcgtggggacatggatgaagcaggaaaccatcattctcagcaaacaatcacaaggacaaaaaaccaaacaccgcatgttctcactcataggtgggaattgaacaatgagaacacatggacacaggaaggggaacatcacacactggggcctgttgtggggtgtggggaggggggaggagtagcattaggagatatacctaatgttaaatgacgagttaatgggtgcagcacaccaacatggcacatgtatacatatgtaacaaacctgcacgttgtgcacatgtaccctaaaacttaaagtataataaaaaaaaaagaaagaatagctgctaaggcagagtaagaggagaaacatctgagctccttcctcccaactgttgcccatctctagaggctgactcagctggaattcaggtaatgtgggatccaaggaacagcgtctacagtgctcagccttcttaatatatgatcattactctacaagctatggcatgtttgatttgagaagcactcaaatcaccttattcattttatcaaattcggttctttcttctgactaagtactaggtactcaatagctacaaaaactatcctccaaaggcagaaacagcatcttacacttagttattggggataaccatgataatattccctcaaagcagattctcacacacagatactcatccactcagtacgtaaaacctgaccttcactctgcctcaccgtatcataagcaaaggatctcaagtgaagaaacaaaaactgacatgttcctggaagatgccaatggtactgctataattatttgtcaaagaatgcaactaatatttttagaatttgtccatgtcatgattctcaattttttagttgatttttgtgtcacgtttctttttctatcacaattttaataataagcagcccttccaaccacctccacaggaggaagattaactgtgagatggttaaggaaaggcaatgctaatcaatgatgtggccaattctttctgcaacagttatacacattgttatattccgggataaacttctcctgcccactcataaatttttatttccttctcctctggttttatggttaaattaatgaaaaataaaacttttcagaaggtagctgactcttcatgtgatttcaaacttaccaacaggaaatatccaatatacactccttacgccttcctacagcacatgaaatcttttttttttttttttttatactttaagttttacggtacatgtgcaaaacgtgcaggtttgttacatatgtatacatgtgccatgttggtgtgctgcacccattaactcgtcatttaacattaggtatatctcctaatgctatccctccctcctccccctaccccacaacaggccctggtgtgtgatgttccccttcctgtgtccatgtattctcattgttcagttcccacctatgagggagaacatgcggtgtttggttttttgtccttgcgatagtttgctgagaatgatggtttcccgcttcatccatgtccccacgaagcacatgaaatcatccttttttatggctgcatagtattccatggtgtatatgtgccacattttcttaatcgagtctatcattgttagacatttgggttggttccaagtctttgctattgtgaatagtggcgcaataaacatacatgtgcatgtgtctttatagcagcatgatttataatcctttgggtatatacccagtaatgggattgctgggtcaaatggtatttctacttctagatccctgaggaatcgccactctgacttccataatggttgaacttgtttacagacccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagccaatatcatactgaatgagcaaaaactggaagcattccctttcaaaactggcacaagacagatgccctctctcaccactcttattcaacataatgttggaagttctggctagggcaatcaggcaggagaaggaaataaagggtattcaattaggaaaagaggaagtcaaattgtccctgttttcagatgacatgattgtatatctagaaaaccccatcgtctcagcccaaaatctccttaagctgataggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggatctcttcaaggagaaatctttgtttttaatattgcttttaattctaatagtaattacttgaactggccagaaacagaaattcctcaagtgcttagcagaaaagcctagctatagtagcttcacactttttctatttttaggcaattacaaatatattttgaatttggaaaataacatataatttaaatgatatacacacgcatatatacacacacatatatacacatatatgtatatacatatatgtgtatatacatatatacacacatatatacatatatacacacatatatatatatacatatatatatgcagtaacttcctaataagtttatttaaatttatctgattttaggtgaataaaaaataaaggtttggagagtacctttttaaatgtcagaggaatccaacaaccaattgtacaagtgaggggcagaaggagtctttgatttgaggatacctagtagctgttgttgcacatctgatcactttgcctattcttcttactacctgggtgtcaaatcaattcagaaaaataatctggaaactgtaaaccaaaaataaaattctaagcacccccaatcaactgaagagacccctcatctcagccaagtgcattcttttttttttttttttttgagatggagtcctgctgtgttgcccaggctagagtgcagtggtgcaatcttgactcactgcaacctctgcctcctgggttcaagctattctcctgactcagcctcctgagtaccaaggaccacaagcacccgccaccatgcccagctgatttttgtatttttagtagagacagggtttcgctaaaactagtgaaaagcattttcctttatagaaaaaattttcacacactaacttccacagtggttgaactagtttacagtcccaccaacagtgtaaaagtgttcctatttctccacatcctctccagcacctgttgtttcctgactttttaatgatcgccattctaactgatatgagatggtatctcattgtggttttgatatgcatttagctatcgatgacaaatccacagcgatattgggcaggctggtctcaaactcctgacttcacgtgattcacccaccttggcctcccaaagcactgagattacaggcatgagccactgcacatggccatcagccaagtgcattctaaagtaaaccagaaaccctagttcaggccatgataggaataggtggtcagacatgcctcattatacctccctcctgttggattaatttgggcacagctggccagcattaacactaaaacagaaaccttaagacggacagaacagactctttgtagcaataagatacctacatgacagcaggttctgaaagaaattgaagtattaatattttactcccaaacatatttatttgacatattttgaaatggccccgcaaagctgtctcttgtcggggaaaatctacattctgtagagaatccttttccctttccaggtgtttttactgatccggagtgaattaacaaagagtctggcacctgttaaagtttgacaagaaacatttacaatgtcttctctccgaagcctgctacctggagccttcatctgcataataagaacccgggtctctaaaacccctgatcttaacccagacagtcccttctgttgattcctgatctttagatgcactctttcaactaattgccaattagaaaatctttgaatttggcctggcaaggtggctcacacctgtagtcccaggactttgggaggccgaagctgacagatcatgaggtcaggagtttgaggccagcctggccaacatggtgaaccccccccaccatctctactaaacataaaaaaattagccaggcatggtggcgcatgcctgtaatcccagctacttgggaggctgagacaggaacatcacttgaactggggaggcagaggttgctgtgagcagagatcacgccattgcactccagcctgggcaacaagtgagactccattcccccccgccccctcccccccaaaaaaagaaaaagaaaatctttgaattcagctatgacccagaagttccctccctacccacttcaagttgtcccgactttctgtacagattcaatcaatgtacatcttgcatgtattgattgatgtcttatgtctccctaaaatgtataaaaccaagctgtagcccaaccaccttgggcacatgttctcaggatctcacggagctgtgtcatggggccaaggtcacttgtattttgctcagaataaatctccaaatattttacagagtttgactctttttgtcaacaaaatgtaaagcattaaaagaaattagccagcaatatacttaattatcatgagcatagtaagcgattttagttttcctttcatcacttattaatatcttacatcaaatttatttttacactgacaggattatatcccttctttaaagctttctatttatagtatgcaatgtaatatggaggttactacctacttcaagcatagaaggcccatcctttatactccacaggcttgtagcacatttatatctgagaattactagtgaaaagcttcctttaacagttttagaaatgaaaatcaagaacatctgtgacttttgtttgacccccccccccccataggcagttacaaggcaaatgtgcatactcctctagcaatcactatagcaacaagcaagtaattgctttaaatagcataaggtgcctttgctgaaatcatttcaagtatcctgagttaactctgtgtcaacaaagcactcataggtcttggattctttaatgggggttcttttaaaaaagaaaattacagctttgtaattggtcatttaaaatttcagaaaaatgtagatacaccaaagaaaatgtattctccaactatgaagaaataattggcaaaatagtatcattttcatattcctaataatttttcctatacatatactgtatgtgtttatttatatttcttatttcttactataagactttaagccagtgcttgtgttacctgttttcattgccttcttacaattatcttatacagatatattataaaataaactcacttttaaaatattttctgtgataagattatgaaatggcatccaaagggaatcacacacaggattttttattttatttctgaaaaatatttgtaggttcaatttaattatcatatattgaaaggtgcttagtgcttttttgcatcagacaaggtgaaaaattcaactttcaaatggctatagtccctggcttcttattttcatcttagcaaaataaaacaacaccctacttatgaattgaaattgtaatgccattccattttctgctataccatagaaataactctaaatactaaaatgtataaagtggaaaatgctgatagtattccaatttgtttcattttcaatttgaagaaaaaggatatgtgtctcctggggtgaagaaatgagtcaattaggtatagaagaaggggcatgactatatcaagcttacactaaaaatgctgaataacaatgacaaattagataattattaataagtagataattccaaccctaaaaaacaaaagaccttgcatggttaatatacaaatgacttttagaaacataaacataaatggaagccaaggaaacaatcaactgagtgaagaaacaacttgtggaataggaaaaaatatttgcaaatcatattttcaataagggattgttattgaaaatgcataagaaacttgaataatttaacaataaggaaacaaatgacccaatcaaaaaatgggaaagatctgaatagacatttctcaaaagaagacatacaaatggacaatatatgaaaaaatgtttaatgccactattcttcagaaaaatgaaaattaaaaccactcctcagctcctcacagctgttagaatggctactatcaaaaagacaaaaagtagcaagtgttggagagaatgtggagaacagggaatccttggacattattaatgagaatgtaaacaattataggcattataaaaatatggaaattcctcaaaaaattaaaaatagcactaccatatgctccagcaatccctctacaaagtatatatccaaaggaaaggaaatcagtacgtcaaaaagatatacttcctttcatgtttactgcaacactactcacaatagacaagatatggaatcaacctaggtgtccattaacagatgaatggataaacagtcatataaatatgtatatctagtataaacacacaccacttataaagaagggaaatcctattatttcctacaacatggatgaacctggaggacactatgttaagtgaaattaggcacagaaagacagatatcacacagttttacttatattttgaatctttgaaggggtagagaggagaaaggtggttatcagggaattaatgggggggtagagaagtgaggagatgttggacaaaggataccaaatttaattcatgtagaagaaataaagatacctaatgtatgacacagcgactatagttaatgcattgtattcttgaaaattgctaagagagattattttgagtgttattaccacaaaaaatgtgaggtaatgcatgtgttaattatcttgactaagccattccacaatgtagaaatatttcaaactacatcatgttgtacacaacaaaaataaacaatttgtaatataaaaaataaatttaaaaaatatatgtacaaaaaggaaatacagatggcaaatatgcatgtgaaaagatagtcaaagttattataataatgaaaatgatcaaatcagggtaattgggatatgctaggaacatttaaatcacacattacatgaatgtattaaattatcacatgtatattgaaaatatgtacacctattatatcatttcttctgaaagtgaaatctaaaatactgtacacaccacaaggatagcaaaaattaaaacaagaacaaaagcagacattaaaaactgctgaaaagtaaaatctaaaataatactgaaaacaccactagaatagcaaaaattaaaagaacaaaaacagacaataaaaagtgctgacaaggatgtagagaagccagaactctcacataatgctagtgagaatgcaatggtacagtcattttggaagacaatttaaaagtttcttttgtattcaaacatacacttaccaacaactgataaattttacttttgtatttactcatgataaataaaaatatttgtcttcacagagacgtatgcataaatgtttatagcaatgttattcaaaattgacgagaactgaaactaaatttttattatgtggagaatagattaaaaattaaggtatattcagacaatagaatattatttaacaatcaaaatgaatgaactatgggtacatgcagcagtaaagataattctcagaagcaatgtggtaagtgaaggaagctagacacagagggtctgtggtgtatcgtcccatgtacatgatatttgaggagagaaaagcctatcaggataaaaatactatcagtggtttctgagggtccagagtttgagtgggggttattgactacacaaaggcatgagggaactttttcagaaaatggacatattctatattttgattatatgtaaactatacatctatctaaattaatcaaattatatatatacaagggttgaattatactgtataaacttatatctcaataaacttaattttagaaaacttctcaggaagataaaggaggaaataatatccatgaaacaagaacaaggcactgaggaacaagaataggcagctgtgaaacagaggtgagggagaagaaatatttgaagtaaaatttacaaaaccttttcagaattggagacatagatcttcatattggcctgttatcactgaaaaccaaggacaattaaaactaaatagataaaaagaatcactgtagtaaaatagcagaacctgaagaataaaaatacatttttcaatatgactgttaacaaagagaggtaatattgacaattttacattaatgttacttagaaaaggaatattttctaagttaagagaaaaagtaactacaatatgcaattatttgttccactaagctgacaataagtagaaaaataacaatacctttttaagtacataaaacaattttactatcaaatggatttttctaaaacaactcctaaagaattcagtttgcctagaagagaaatacaaatagaagtagtgaagttgataccagaagcaagatttggaaaacacacacagatacacacacacacatacacacacacacacacacacacacacacacacacattttattaaataaatgaatatcaagatctcaggatgagtttaggaaagcttggaaaatttgtgattacaagtttggtgactgggcatatttgtatatttttaaactccattcaagatttatttggttcttttcaatgttaaaatatatgaaaactacttcattctccaaaacatgttatttttgatattctaagagaaaattactgaattgtcaatcttatttcccaagtaagattcttttttcttttctttaaagtaatggtgttggttattttcaattacaataatgttgtatggtctagtcattctagaaatatatttttaaaaaggttaaaaacagagcaaattataatcaccttcataaaataaaccacagtgatatatggacaaatataaaaatgtattaactattaactttattactaaaagtttaacggtaaattatataaatttgacattataggaaagaagcagtaatttattataggggtcagcaaacaatggcctatgggctaaatctagcctgcttccaatctcggtcaataaagttttgtcagaacacaatcagattcatttatttttgtattgtccatggctgctttcatactacaatgtatgtcagaactgagtagtttcaacagaaacattctggtttgcaaatcctaaaacatttactatctgttcttttacagacctgtcagcctctgcactgctcatataggcaccataggaacatttgtgatactacagacactttcaactaacttaaaaagagaaaggtgccctttctttttagtagtataggataaaaggaaagaattctctttaacttttgaactggcaatgatagaatttaagagatgcaaccctgaaaactaaaattgtacattggttgaataaaatattttctaaatatgtatttttatacttcaatttaagattgttgctctgactaaatatttttataatattttaatcatgagcattctgctttacaaaaccatttcttaaaaatactcttatacttttgctgtagagtaattttcagtcaggggaaatttggcaacatctgtagacattgttcattggcataattctagtggaggaagaaaaacatgctactggcatctagagcaaaaggtcagttgctctgctaaacattacaatgcataggacggaccacacaaccaagaactcttcaccccaaaatgtcaatagttctgaggttgataaattttcctatagagatatggtaaaacaaaagaaagcaaagtaaagcagaacagaacaacaacaacaaaaaaaacacaaactaattagatttcaagataaaaaagattatttcagaattcccatctccaggccagcttttattgtgtatacaccaattgcagcatctttctgaagaaaaataaggaggctctttacagcagacatcatgtaataaacagtatacactcacaaggatcataagtttgggaactttttaggaagttcctaaaaataatttccctgcaaggaaaatttgctgttagtatgttgatattgttttctgtagaattcagtgttaaggtgtcactttttcaaggactctttttttaacatggccttgttgctatttcatcttttttgaaaccactctatgatcacatgacaaggcagtttcaaagtttttgcatgttaatgcagtgtgtctttgactaaggaagaaagataagagtgtcccacaatataacttgttaactaatagttacatgcagtttttaaatatttttgtttgtttgatcttacaatttccagtaccaaaaattttcacaaaaattagaattatgacatggtctaatctccctaattctgttcatgttattcctcaatttttgcaaaccttttctctaaaaaataaatgtaataacatttcttcctaaagtcattattatttatctaccttaacatttgtaatgaccataaactatttaacattttcttttctttccttctttgtatgtgtgtgtgtgtgcatgtgtgtgtgtgtgtgtgtgtgtgtgtgtgtgtgcttttagagacctagtcttgctctgttgcccaggctggagtgcagtggaaggatcatagctcactgcagttttgaagtcctcgtctcaagggatccttccactttaacatgtcataacacttcttgattagcattaagtactgcagcatttcttgttgcaatgtcaattatttattcatatgttaaagagctgataaaaatcaatacaaagttacatttttttgtggcgattgttgatatatattcattaaacaaattcatatatttccctaaagttttcctatatgatgtatgtttgaacaggattttgcaactatcattaaaaagaatgcagtatttcaacagtaatattgattctttgttaaaaatttagacacaattgtattacataaagattaaacaacttagaatttttgaaaatgcatacacattttatatactactcttttttaaaaaaaaattttcattccattccaggggtacatgtgcaggtttgttatataggtaaactcgtgtcacaggggtttgttgtacagattatttcatcacccagatattaagcctagtacccaagagttatttttttctgctccccttcctccttgtaccctctaccctcaggtgggacccagtgtgtgttgttctcctctttgagtccacgtgttctcgtcatctagctcccacttataagtgagaacattcacgtaccactcataatctatccttttacttcaagaaaaattatgaaaagttagcataaaatttgtgtacatcattgttcttgtatttctgtatcttattccattattttcatttggcaagatatttttcatcatttttatagttcataccaaaatatactaattttttacatatatgttaaattatattttcctagttttactttatgttaaatttaactttatgactaatccttatgatgtgtagaaatttattttttatggtcaattgtagaaatcttaggctttataatttttacttgtgcatacaaaaattttcttctctgtcaagattatatatattggccttattttcttttgcatctattatagataatctgaattaattttcacaataattataagttaggtgtttttcttaaagaaaacactggctttaaagaaaagttccattatgtatgaattcaaatgattttctcaaatatacactttcaattcgcttattctctcaatttcccatggaaacagcaaggttcataaaatatagaaaaccatctcactattatgcctaattcatcagacttcaaaaacatacctgaaggtcagcgctctgaaatacataggtaggtacacagtgtcctacataatttcatgaaatgcctcattgtatttaccgataataaaaattttcctcaaaaaaatttaaaaaataaagtttgttatataaaaataggtgcagtgaggggagtgtctgatttctccaaactttgtctaaactagagataagagagtatttgtactaatgagataagtgcagacgataaagaatagcatagtctgagacgtataagaaataacaaaacctggcagagacacagcaaaaaaagaaaacttcaggccagtatttttgatgcacattgatgcaagtatccttaaaaaatacttgaaaaccaaatctagcagcacatcaaaaagttaattcaacatgatcaagcaggcttcatccctgggatgcaaggttggttcaacatacacaaatcaataaatgtgattcatcacgtaaacagaactaaagacaaaaaccacacgattatcttaacagatgcagaaatccaacatccctaaatgttaaaaactttcaataaatcaggtattgaaggaatatacttcaaaatagtaagagtcatctatgacaaacccacagccaacattatatatactgaatgggcaaaagctggaaacattccccttgaaagccagcacaaaaatgccctctcttaccacttctattcaacatagtattgaaagtcctagccagaaaaataaggcaagagaaagaaataaagggaatccaaatagtaaaagagaaagtcaaactatctctgtttgcagacaacatgattctatatctagaaaaccccatagtctccacccaaaagctcattgaactgataagcaacttcagaaaagtttcaggatacaaaatcgatgtacaaaagtcattagcattcctgtacaccaacaacagacaaaccaagaaccatatcagataggcaatcccattcacagttggcacaaaaggaataaaatacctgggaatacagcaaaccagggagatgaaagatctctgtttacaatgagaattacaaaaggctgttcaaataaatctgagaagacacaaatggaaaaacctcccatgctcatggatagtaagaatcaatatcattaaaatggttatactacccaaagcaatttacagatgtaatactatgactatcaaactaccaatggcattcttcccaaaactattaaattggctatagtacccaaagcaatttacagatttaatactatgactatcaaactaccaatggcattttttcacaaaactattataaaattcacatggaaccaaaaaaaaaaaaaaaaaaagagctccaatcctaagcaaaaagaacaaaactggaagcattctattacctgactttatactacaaggcaacagtaaccaaaacagcatggtactagtgcaaaaacaggcacatagaccaatggaaacacattcttatttgttcttttattcaaaacaatattaattgaatgacttcaaagtatcaggccttcttagagactacatttattagcagaattctattcatcatcaggatttttttttttaggattaagctcttcttcacttttgacatttatcattatcttattcttttccttattaattctggaatttctaaaatatattattagtcaaatctgatgtttcctagaagtctacaaaaatatttttaatggccaatattttgttcaatctacttagtaaaaatgttcatatctttaattcagtggaaagtacatttttaaatagaagcttagaggaaaaataatagactgagtctacagattatagaacctaaagtttaaaagtattcaagaatatgtggaaacccattaacttttaaatattcaataatactgctattatggaaaaaatttggttttctcatttaatgatggttgagtggaattatcctgtatctggcttagagtgaggaaagcaattatcccatttttactgtaatttttcctctgcccctaatttattagagagagaaagagatctgaactgggaagatttaagatttttcatctgaaaaaaatagaagattgttatagatgaattctaaactgttatctttaatattctatatgtttatgctatgtttaataattaatatcagtattaataatactggtaacacaatttttagtatataattcacattctttcatttaaaacaatacttactatgtctttctttctgccagatacttttctgagtagctattaactggattttcatagatgaatgattttcatttggttgcagacaaatgaattattctctataaattgcataactgtcaatggtaaaactcagtattctgacaataaattcatgcaatatgcaaatgcattaataattgacttaatggttgtgaataatgcaaatattttacctttaagtacattcattaatagtaaaacaatagtaaattggaaataggtattgaagtaggtacttagttttagagatgaaattaataatttatataatcaaaatgactaatttggttggctaggaaaggtcaatgaccacctaagttctcacattttctgggttattactggaacatattttctctggacttagagctcattaaagatgcatagtctaaagttctgacattcaatattttttctctgattcagagaactagtttacagcgttctttttattttttcttttttgaagcagatgaaaaaagaattcttggtctttaaagaacatcagagagccttttcaaacaaacacgagtataatcattaataattaagctgtatagagaaatctcatgtattcaaaattctgacaccaaatttgacttaagaatttaaagggattctcacaatcttattactataattgatgcacagagggtactcattatgtctactaaatctgaaccagatcctgatgtctaaaaatacttgtcaaattgcatgttatataagccatcattgtaattaactcatttattcaacaaatcttatgaaatatcgactatacacttttgctgagcatcaaggctaccatacttgggaataaaaaagacatagtctcttttctcaaggaattgacagtctaatgaaatattcatagactaatcaaacagtcacaagtaatgtcaaatattaactacatagattataaaatgaatgtacaaggtattatacatcagaataaaaaaaggaataaaatattctcaaagtaaatttaaagcttagaaaaccaaaaatatctaccagtttttatttttaaaatttataattttctatttatttcttataaatattttaaaattatcagaagtattacatttattatctcaatatggattcaacatttagttcatcctgctttcaaaaaaacaaatgtcatatcttagctattgtgaataatgttgcaatgagcatgggtaaatagctgtttaacacactgatttcatttcttttggacatatacccacgagtgggattgctggatcacatagtaatgctgtttttaagtttctgaggaacctccatactgttggtcataatggctgtaccaatttacatttctaccaacagtgtgcaagggtttccttttctccatatcctcatcaacacgtatcttttgtcctttttttttttttttttttttttttttgagacggagtttccctctgtcgccaggttggagtgcagtggcgtggatctcggctcactgcaacctctgcctcccgggttcaagcaattctcctgcctcagcctcccaagtagttgggactacaggtgcacaccaccacgcccagctatttttttattattatttttaatagagaaggggtttcaccatgttagccaggatggtctccctctcttgacctcgtgatccgtccacctccgcctcccaaagtgctgggattacaggcgtgagccaccatgcccagccttttttaaatcatactttagtctggaatatatgtgcagaatgtacaggtttgttacataggtatacatgtgctggaaaccatcattctcagcaaactgacacaggaacagaaaaccaaacaccgcatgttctcactcataagtgggaattgaaaaatgagaacacatggacacagggagggaaacatcacacactggggcctgtaggttggggtgggggtcgggggctaggggagggatagcattaggagaaatacctaatgtagatgacagattgtcgttttaataaccattcaaacaggtgtgtggtgataccttactttggttttgatgtatactacctgattttagtatgttgaacattttttatacacctgttgccatttgtgtgtcttcttttgagaaatgtgtattcagatcctttgcgtaaattttttttctgttgatttatttgactttcttatgtattttggatgttatcttcttatcagatgtgtggtttgcagttattttctcccattccctagattgtctctttattgaagccttccttttctgtgcagaaacgttttagttttatgtaatcccatttgtctattttcagtttcatttcatgcaatctcatctatttttgcttttgttgcttgtgttttttgatgccatatccgagaaatatcactatccagaccaaagtcagaagtgttttttttctgtttatttcttagtagtttcacagtttcagatcttacatttaagtcttaaattcattttgagttgatttttatacgatgtgaggtggtaatatcaatttatagatgaatgaagaaaatgtggtacataatggaatactagtttttttaaaaagagaaaatactgccattttgacaacatggattaacttggaggacattatacaaagtggaataatagacacagacaaaaccatatgatttcacttacatgtatagtataaaaaaattgaactcatagaaacagaaaatagaatggtggttgccacaagctgggaggtaggggaaaatggggagatgttggtcaaatgatataaagtttgagttgtgtagattaaataagttcaaaagatctaatacgtggcatgatggttatagttgataatactgtattgtatacttgaaatttgctaagagtatataacttacatgttgttaccacaaatatgcatataaaaggtaactatatacagtgatggatatattaatttgcttaattgtggtaatcattttattgtatatgtatatcaaaacataacattatataccttaaatagatacaatacaattctttaaaattatacctcaataaagttgggaagaaaagaaaaagaaatcatacaaattaaaaaaaaaaaaaacaccaagcattcaaagtacaaattagtgcaatatatatataactgtgtgtgtgcaagaaatctggtttcacaaatgtaagagaaatcctaaatacatggctttctatattatttcaaaaatttttatctcttttcaagctataggtggcttttcattatgatattctatataaggaggaaagaagacttatgcacaattattctctgatgagatagtggtttagtttaccttatctcactaataaactgtagacaaacaaatggaacaaagtatactatctctctgtattctttcttgtatacaggaaagaaaaattgacaccctgggagcagacatgtatttaaaacctgtatttgacagtgactaggtgcatgattctgagaaagtttacaaacagtgcctctgctggtaaaaattgcaaaataaatggtagttactcttattgtcatcattaaaattatcatcagtatcatcattgatgttaataataagcaatgtttacttcagcaaatctggataaaatgcagaattgataagaatgggcacttaattcgcatttcttactacaacagtgcaggggatatgtcctaggcactacacatttatctaatatttaacaatggaatatattatttaaattggctatttacacatattttatgctttacaccagtccacctaaggcttgaagttggtgagaagtatttaatactagattaaaatcatgtattaaaagaaaacatgtagggaaattacaaagcatttgatcctgtgcatgattaaggataacaccaatttgattctaatatatatatatttttaagacagagtctcactctattgcccaggctggaatgtagtgccatgattttggctcgctgaaacctccacctccacagttcacatgattctcctgcctcagcctcccaagcagctgggattacaggtgtccaccaccatgcccagctaatgttttgagtttttaatagagacagggtttcaccatgttggccaggctggtcttgaactcctgacctcaggtgatccacctgcctcagcatcccaaagtgctgggattacaggcatgagccactccacccggccttaattctaatctttcaagatatttttaaaaatacacttcagtgtaacccttatttttttaagctaggactaaaagaaaaaaaaaaattcctaccaaaaatgcaataacgcattttagaaaccagtatttgtcaacatctctcaatacggagtgagagtatacatcaaaacaaaatttagtataatacattttataaagtcaacacatgattcaataataaacatctatctgttaaactgacactctctaagtgtaaatttaattctctatattgaaaagaatgggtttcttgccattaatttatctatttgatgacttaatgtgtattaaacaaatagttgttgaagacattctaggtgtcaagcatggtattatatatcacacacacaaataaatataagaattgtatccttttgcaagaaattcactgtccagtgaaaggagagttaaataagaaaataaacataatgcaatactggaaagaatgaaggaatcacttggtagcacaatatgcttacacctaagaaaaatggaagtagaagaaaaagctgtctgaagagtgatatctgaaagaagtctcaagtgatttatttggaaaactatttctaaaaactagaatttagttaagaattataaagaaaattataacatatggtaagaattttgcataaaaatgtaatttacaaaagcggtatcttaagagcaataaaaaataaattatcttccttttccagccataatgttataatagagaccagatttaaccttctgctctaaacaactagaaaactgaccagtacaactaaaacaagggttttatgttttggacaacagactagaaatgacagtgaactctttgattaccccatcatactgtctggagaaagtctctggtcttctgcacagattgtgggaacacaaatggaacatggcattctccatgagtagagaagatagatttgagaattcaggaaggccaaaataaatagaattttctgtgtacagtaccagagaaaagtgagttgcagaggtctccagaaatctgcagaggattagccttaagtcttcaactgaacactgatcataataattatgtgaggaaactatggggtttggaaaaaaccaccagaaaagaacagacccaacagaaaactgataagaatggaaagcatatagctgagaaatgtgagcagaggaaagtaagacccatgatggacaagaaggcctaggaaacagagctagtgaaggaagatgaacatgaaaaagagaccagaaattaacatctaaagggaggagaaaaatcagtgagcatagtgccaagacctttccctagtcaaacgtaatagtttaaaatacagcttctctctctgggcagcgcatctctgaaagaaaggcagcagccccagtcagggacttacagataaaattcccatctccctgggacagagcacttaagggaaggggcagctgtgggcagcttcagcagacttaaatgttcctgcctgctgactctgaagagagaagcggatctcccagcacagcgcttgagctctgctaagggtcagactgcctgctcaagtgggtccctgaccccagtgactcctgactgggagacacctcccagcaggggtcgacagacacctcatacaagagagctccagctggcatctggcgggtgcctctttagacgaagcttccagaggaaggaacaggcaacaatctttgttgttctgcagcctccgctggtgatacctaggcgaagagggtctggagtggacctccagcaaactccagcagacatgcagcagaggagactgaatgtgagaaggaaaactaacaaacagaaaggaatagcatcaacatcaacaaaaaggacgcccacacagaaaccccatccaaaggtcaccagcatcaaagactaagggtagacaaatccacaaagatggaaaagaaaaaaaaaaaaaaaaaacagcaaaaaaaggctgaaaatccaaaaaccagaactcctgttctccaaaggatcagaactccttgccaggaaggtcacaaaactgacggagaatgacttagatgaactgacagaagtagccttcggaaggtgggtaataacaaattcttcagagctaaaggagcatattctaacccaatgaaaggaagctaagaaccttgaaaaaaggttagcgggattgctaattagaataaccagtttagagaagaacataaatgacctaatggagctgaaaaacacagcacaagaacttcatgaagcatacacaagtaccaatagctgaatcaatcaagcagaagaaaggatatcacagattgaagaacaacttaatgaaataaagcatgaagacaagattagagaaaaaagaatgaaaaggagccgggcgtggtggctcacgcctgtaatcccagcactttgggaggcggaggtgggggggtcacgaggtcaggagatcaagaccatcctggctaacacggtgaaaccccgtctccactaaaaatacaagaaattagccaggcgtggtggtgggaacctgtggtcccagctactcgtgaggctgaggcaggagaattgcgtgaacccgggaggcggagcttgcagtgagcagagatcctgccactgaactccagcctgggcgacagagtgagactccatttcaaaaaaaaaagaatgaaaaggaacagacaaagcctccaagaaatatggaactatgtggaaagaccaaaacttcgtttaactggtgtacctgaaagtgagggggagaatggaaccaagagaatggaaaacactcttcgggatattatccagaacttcccctggcaagacagtccaacattcaaattcaggaaatacggagaacagcacaaagatactccttgagaagagtaaccccaagtagaataatcctcaaatttcccaaggatgaaatgaaggaaaaaaatgttaagatcagccagagagaaaggttgggttaccccataagggaagcccatcagactaacaatggatgtctctgaagaaaccctacaagccagaagagagtgggggccaatattcaacattcttaaagaaaataatttcaacccagaatttcatatccagccaaactaagcttcacaagtgaaggagaaataaaatccttttcagacaagcaaatgctgagagattttgtcacccccaggcctgccttaccagagctcctgaaggaagcactaaatatagaaaggaacaaccgttaccagccactgcaaaaacataccaaattgtaaaaaccatcgacactatgaagaaactgcatcaactaacaggcaaaataaccagctagcatcataatgacaggatcaaattcacacataacaatattaaccttaaatgtaaatgggctaaatgcctcaattgaaagatacagactggaaaattggataaagagtgaagacccatgggtgtgcggtattcaggagaactgtctcacgtgtataggctcaaaataaagagatggagaaatatttaccgagcaaattgaaagcaaaaaaaagcagggattgcaatcctaatctctgataaaatagactttaaaccaacaaagatcaaaaaagacaaataagggcattatgtcatgctaaagggatcaatgcaactagaagagctaactatgctaaatatatgtatacacccaatacaggagcaccagatccataaagcaagttcttagagacctaaaaagagacttagactcccatacaataatggtgggagattttaacaccccaatggcaatattagatcaacaagacagaaaattaacaaggatattcatgacttgaactcagctctggaccaagcagacctaacagacatctacagaactctccaccccagatcaacagaatatacattcttctcactcccacatcacacttattctaaaattgaccatataattagaagtgaaacactcctcagcaagtggaaaacaacgaatatcacaacaaacagtctctcagaccacagtgcaatcaaattagaactcaggattaagaaactcactcaaaaccacacaactacatggaaactgaacaaattgctcctgaatgacacactagttaaataacaaaattaaggcagaaataaagaagttatttgaaaccaatgagaacaaagacacaatgtaccagcatctctgggacactccttagtgtttagagggaaatttataccactaaatggccacaggagaaagcagaaaagatctaaaatcaataccctaacatcacaattaaaagaactagaaagtaagagcaaacaaattcaaaaaccagcagaagacaagaaataactaagatcagagcagaactgaaggaatttgagacacgaaaaacctttcaaaaaatcaatgaatccaggagctgttgtttttgaaaatattaacaaaatagatatatcactagccagactaataaagaagaaaaaacagaagaatcaaatagacacaataaaaaatagtaaaggggatatcaccactgatcccacagaaatacaaactaccatcagagaatgctataaacgtctctatgcaaataaactataaaatctagaagaaagggataaatccaggacacatacaccctcccaagactaaaccaggaagaagtcaaatccctgaatagaccaataacaagttctgaaattgaggcagtaattaatagcctacaacgaaaaaatgcccaggatcagatcgattcacaggtaaattctaccagaggttcaaagaggagctggtgccattccttctgaaactattgcaaacaatagaaaaagagggactcctccctaactcatattatgaggccagcatcatcctgatatcaaaatctggcagacacaacaacaacaacaacaaaatttcatcaggccaatatccctgatgaacatcaatgcaaaaatcctcaagaaaataccggcaaactgaatccagcagcacatcaaaaagcttatccacccagttggcttcatccctgggatgcaaggctggttcaacatatgcaaatcaaaaaacataatccatcacataaacagaaccaataacaaaaactgcatgattatttaaatagatgaagaaaagacctacgataaaattcaacaccacttcatggtaaaaactctcaataaactaggtattgatggaacgtatctcaaaataataagagctatttatgacaaacccacagccaatatcatagtgaatgggcaaaagctggacgcattccctttgaaaaccagtaaaagacaaagatggtctctctcaccaagttctggccagggcaatcaggcaagagaaagaaataaagggcattcaaatagggagagaggaagtcaaattgtctgtgtcaaatttgcaaatcaagtcaaattgcagatgacatgattgtatatttagaaaaccccattgtctcagcccaaaatctccttaagctgattagcaaatttggcaaatactcaggatacaaaatcaatgtgcaaaaatcacaagcattcctataccccaataacagacagagagccaaatcatgagtgaactcccattcacaattgctacaaagataataaaatacctaggaatccaacttacaaggtatgtgaaggacctcttcaaggagaagtacaaaccactgctcaaggaaataagagaggatgtaaacaaatggaaaaacattccatgctcatagacagaaagaataaatattgtgaaaatggccataatgcccaaagtaatttatagattcaatgctgtccctgtaaagctactgttgactttctttacaaaattagaaaaaaaactactttaaatttcatatggaaccaaaatagagcctgtatagccaagacaatcctaagaaaaatgaacaaagatggaggcatcatgctacctgacttcaaactatgctacaaggctaccattaccaaaacagcatgggactggcaccaaaacagacatacagaccaatggaacagaatagaggcctcagcaataacaccacacatctacaaccatctgatctttgacaaacctggcaaaaacaagcaatggggaaaggattccctatttaataaatggtattgggaaaactggctaggcatatgcagaaagctgaaactggatcctttccttacaccttatacaaaaatttactccaaatggattaaagacttaaacgtaagtcctaaagccataaaaaccctagaagaaaacctaggcaatcaataccattcagcacataggtatgggcaaagacttcatgactaaaacaccaaaaacaatgacaacaaaagccaaaatttgcaaatgggatctaattaaactaaagagcttcagcacagcaaaagaaactatcatcagagtgaacaggtaacctacaaaatgggagaaaagttttccattcaatccatctgacaaaaggctaaaattcagagtctacaagaaacttaaacaaatttacaagaaaaaatcaatcccgtcaaaaagtgggcaaaggatatgagcagacacttctcaaaagaagacatttatgcaggcaacaaacatatgaaaaaaaagctcatcatcagtggtcattagaggaatgcaaatcaaaaccacaatgagatgccatctcacgccagttagaatggcgatcattaaaaagtcaggaaacaacagatgctggcgaagttgtggagaaacaggaatgcttttacactgttggtgggcgtgtaaattagttcaatcattgtggaagacagtgtggcaattcctcaaggatctagaaccagaaataccatttgacccagcaattccattactggttatatactcaaaggattataaataattctactataaagacacatacacatgtatgtttattgcaggactattcacaatagcaaagacttgaaaccaacccaaatgcccatcaatgatagactggacaaagaaaatgtggcacatatataccacggaatactatgcagccataaaaaaggatgagttcatgtcctttgcaggggcatggatgaagctggaaaccatcattctcagcaaactaacacaggaacggaaaatcaaacaccacatgttctcactcataagtgggagttgaacaatgggaacacagggacacagggagacgaacatcacacaccagggcctattggtgggtgggggcaaggggagggatatcattaggagaaatacctaatgtagatgacaggttgatggttgcagcaaaccaccacagcacttgtatacctatgtaataaaactgtacgttctgcacctgtatcctagaacttaaactattacaaaaatcaattagttaaaaaaatattttcagttaagctgtggttgaatacaagaaccaaccacttccccatgtaatattgataagcatggaatgcatgaatcatagagtctcagggtaagaagatttgctccaaagctaccttgagtcaattaatgggattcagctggaaacaaagaaaaacctcgagggagaagtaccagttctaataaaatgctcacagttaaaacaaaaataaacaaaaactgatatattcatttcttatgtttttaaagttcaaccaaacataaaattgggggcataattcctgtggggttaataaaataagtacatttcttcagccagttgatgaaaaatatgtaatttcatttacagcccctgttggttttaaaaacgaagtgtttttcaagtatacacaatgatacttatatgccttcaggtataaatattaaatgatctaaaagaacacaattttgctttattgatttcagctgtcaaaatgataaaatacaactttatttccttctattacagaaagctggtcaggctttttagagagtgatagaggcactagtatcaaaagaagagagaaagtacatagagaagataaaaatgcatccaatgtctaaccaaaatggtaaactacttagggaaacttcacccagaataagagtgtgattgaaaatcaaacagaaaagtatagcacctagtcataatcttaaatcaaaagagttattcttatcatctgatgtttccaaattatacacagaattttatccacatgaaaatatggattgaattttcatgtcttgtttcttcaggattaaaatcctttttagaaagtaaaacatgaaattttcaaagaaaagggaaaataaagagcatgttaaaaaaagaagacattattggaatacaaaagttaatgtggtttctacacttgaagtttcttagaattgaaaacatagaaaggaggggttagatattgcataacctcaagttgttaaagcaggatgaggagtaaggctcttaggaaggaagagacagcttcatggcagaagcaaggagtccagggaaggtggtaagaactgcctcagagcatcagcgagctagtgaaacattaaaacgtataaatagcaattaataagatctagagaagcattggaagcccctggctaaagtatggtcaggtacacagaaccacaacagaggcaagaatgtgaccatgtttagaaatcaaatgtcagaatatggtaaattagtcagcagtaagtgaagaagtcaaaggtatggtacatagtattaaaattcaggacaagcaccaagtttaggtttcaagtactctaagcttaaggaactagacaggtagtaaatgagttgtgacagcagtttataaactaaagagagtatatggaattaaatttaaaaactgaaaatttggggacaggctaacatttaggtggcactgtgacagcaatttatatagataaattcatataatcctcaaaatgactgcacaaaattagtggtagccctatattatagatgagcaaactgaggctatgtcatagaacttttctaaagacaaagagctagtaagttatagaatggaaattctgagatttattcaccttccaagcttctgtcatattaccaggcactgaaattgaacaactgaagacctttaaaaatcttggaaaatgcataaggactttgagctaacatttgctttagtgtggtagcatttacatcatccttgactagccagtgaaaaacctgtagtaagtgatctgagaacagtgagagttcgccaaaatcatgtaagcaacattgtgacttggcgatcagtgcgtttcctacttgttctttggaagtaacttccacaatccatctttttggagaatgagactcatttgtaatgaatatatgcccaaccccaggtttttagaacgttaaagaagtgaagtgactttaaaagtcctaagtattcttcagatgagaaaattgagattaagacaggttaatatacttaaaattttaaaaataacatctgtccagggccagagggggaaaaataccaaacgaacatgttgagagtgtctttgttcacttgttcccacttagatatttatggggaaaggtctttagaagactgaagaatatcaacacatctatggtgctatgtatatttattcatgaaatttttgtctgaatcacaaaaatcttgtatttcttttaagctttcaaacaaaataattttatttaaaaatagtttcttatttaagaaaattactaaattatgaagaatataagcaattgtttttcatgatgtatcagccttgtgcttaatttgccattaggaggaaacaataatctctaagaaagctaatttagtattgtagctttttaaaatggattggattatattcccccagtgacatgttaaagtctcaacttccaataactcagaatgtgatgttatttataaatagagttattagagatgtaattagttaaggtgagattgagactgaatccattatgactggtgttcttctaaaaaggtgatgtgaagacacacggggagaatacatgtaacgggaggcagacattggagtgatgcagctacaagtcaagaaacatcaaagcttgaccaccaccaaggaagctaggagggggcatggagggattctcccctgtaggtttctgaggaagcatgaccctgctgatactgttttttagtacagctagactccagaattgtgagacaataaatctctgctgttttgagacaatcagtttctggtattttattgtggcagacctagaagactaatatgttacattgttcatcaaaatatattcactattccagcattggtgtcacaattaagacttagagtaaatataatcaaatgtcatgtcttcaacatccaccatcctctttaaatattttattttatagttctgtattttctaatcattacctctgctctctctctcaatcgttcaaattatatttaagtctttccactccattttgactttgttacataaaaatgcaccctacacacacacactcacacacacacacagacatatgcatagagtatttcagttaaaaatcactatgatcagggcattcatagcttatgttattaaatattatagttaagtagagttcctcaattcaacgtgaagatacaaatcaatttccaagaatgagtatagatgcacaacactaaacatatattttagaatcaacacgacttatcaactcttggcagatgcagaaatcagaggttctttctgtgcctcagggttgtaataaggaatgtcattatacacttatcagagtttcgctttataatagagctgttgttagagacagttttatagctgataaaaatttctgataagcctacttgtagcgtgtctaaaaattggtttgcattattttcctttatttgtccttagagggtggcttaagatgcttctctctgcttcacaaaattgattatcaaaataaaaataatccaatgcatcagaaaattacattgactcaaccttcaaaacatatccagaatctgaccatttctcaagctttcatgctgacagactagactgagccatggccatttctagcctggattagggcattagcctcttaactattctccctttgtgtattcctgcccaaacctcacacacactgatctgttctccatagtatagccagagtggtcactcaaataatttcacttctctgcttaaacccctggaataagtctttatttccactcagaatacaaaacaaggtcttaaaattgcctaaaattatcagaatctcctctcccccattatatatgtgacttcatcctccacaagtctctaccttgcttgcctgctcttccacactgtcgcccctgatgatcccagaaaatgtcaatacatgcctacattaacacagtactggctttttgctctgtgggcttttcttctcccctatagctacacagctagctctcatcctcttcaagttgtcttcgtcaaagagatcaatcctgatggtagaatgtaacagtgttgtcactcactcttcaacccagaacttgtgacaccccacacttgttctacttctactttttcttttatcacattctctttctctctctctttgtgtgtgtgtgtgtgtgtgtgtggtgtgtgtgtgtgttttatgcttagtgtttattatctgtctctctccactagaagttaagctccagagggcataaaatttctgtcttgttttcttgtttagcaatgtatcactaactatggagtccaggacatggtgtattcacaataaaatatgctgctagtgaaacatggttattatggaagaacacattttatgataatcactattacacttaggcgataacactgttgaggggtttaagtaatatcttaattactgacattaaataccatttcaaaatattgctgattgatgcctattaaagtgacaacttgtcatactgcaccacatgcttcaagtataaatagatttgggaggcaacagaaatatcttttcattaattttctatgtacaagtgacttacattagtaaacagaatttaaaaagtctctggagaagcaagttcttctcctcattcgcagaattaggtatgttggtcctacccatgggcgaaagaatgtgtctcaggtctttattcctgttttgatccctgctcccttgctttaatcaattctgccctggcctttctcaatacctggagtgagagatgctcttcactagaagacccagctaagatctgccctagcaggaaagtcactgaaggcctgaaggacaaaaatgataagcagaacttcacttccttcctcaaacagtatattggaaggaaaaatccatgatatctggatttcacacactcaaattccaatgccaactcactggaacctgagccaagatagtctttgcctttatatcatctggaaagttgtatagagaccaaatcttcaaccccagatcattctcatgtatgaagcaggtattaaataaatgccagttactattataattatccttgaaaccaggaatttttgtcctcatttcaatgatttctaaagatgcccactgagtatctgtgttgtttcttggtcaaaccatttcctccttataaatgtcctccacaagccttattatcactggaccaggtcacagacagggttattggcttaggtcctctgcttagaacatgaaaatgcccattctcattcatattctcagtgtagaactgatattaagtcctgaaattctgctgtactgaatctttgctcaagaacagacagctctttcctacgtgaatcctgctttctggacatctggaatcaagcactatactggccggttactttgaaataagctatgatctcttacctttacatctctcactagctgcctggagtcttgtggtatcaaatcattgacctgttcaaagtcactcttagccatcattaagttgataatttattgggattactgtatattgagccacccaacttcttccttaggaaccaggcacattatatttatttatttttttaagtcccagggtgttttccattcctagacttcaacatttttatagcttatgttgctctgttcatagaagctttcatagctaagccttcttaacctatattaacttgataaatctttgtgacaatttttaagatagatgacatacagcctttctgggatctccattcttacagcaaagctttggataaagtattatgtctattaacatataactcctcctgaaaaagcccaaatactgctgagggaagctaacagaaacaacaaatgaccaaagtcaaggtgacattgagttatgcacaatattctataggagaaggataaagggaaaaattaaatcttcaaggtttttttcacagaagtcttccaataggcagtggcatttgaattgggccttaggacaggaattctgatagactgggcaataaagggcattcatgagaagggactatgagcactgaagtgcagagttgtgcaactgtatgacaggactgaggaatagtgaatcataaaacaggttagaaatgagtggtagagaatgactttagatgatgcaatcaaggttgaatatactagttggaatgcttaggattttaaaccttttctcataaaaaagaataactcttgtaaattttaaaatagaggaaagaaaataatatgtttatgtgtatattattttttaaacctctgaaaataatgtggaaggcggaatagaaagactagagactagaaattgtccatttagagagaactgcattatttcaagagagatcatacaagccaaaactggagttgtaataaacagacataaaaagctgaatgagagaattcctaaatataattcatagtatttttgataaagtttaccctgaagtttagaaatccagatggatgtaaatttcatatgagagatgaatcagggaaaaggaaatatgggtagggagagagatgaagatttttggtattgggaagattacaattttatctcaagtttaaagtattgagagacttacaggtgaaacacaataaatagtacaaaataagaaagtatatatctctgcagatatttgaagctatgagtgaaagtgcaaagacaaattgcggaataaaggaataagaattgactaaagaattaaagatgagtggaaagagaggaggaagagagaaagagagtgatgggaaacatctaagagcaaatgttggaggattctaacatttaagtggtcagcatgtgaagaggagtctgtgcataaaactggggtggtagagtagggaaggaaattacaaaatagtggcaccatggaccgagctacatacaaaatgttctgggctgagttgaaaatgaaaatcagaaccatttgttcaaaaaagtagagaaaatgtaccgttacaggtaattagatataaagtttttcctttgttttatggtctttatctaatcattttatggtattttatttgctgtttaatgtcattctatgtaagaaaaattttcaaatattggcataaatactaccatttatctttatgttgcataatgccagctttaatgacaaatataatttaagaattaaacatcaaaattacataattcatatttcatggttcatacgtgcatgttattcttatcacaacagtggaaacactgaagccagtggcttgtataatgcccttacgttgtactcgagtctcactgagctattacatactgtggctccaccaaaagtcaagtccttctgaggtcacacacccctgaagcccacactggatagatctaagggcttcacgaagggcagataatgagtgtctaccactgtctatgtctttatgatagggcgccatcagagtggtagagaagacagggacattgtaacttgagatagaacaataggattaagtaggtctgaaatctgaacttttctgagtccatttatggctgatactaaaaacttggccagaaaagtaaaataaaccaaactgagaattgtcaaaatttacccatatcgttatatcagatgctggcaagttttcctgtaaagaagaacatagtaagtattctgggcttgctatgtgtgacacaacctctgtcacaactattcaactttgttgtcattgtacaaaattagtcatagataatatgtaaaccagtggtctccaacccctgggccatggattggtacctgtctgtggcctgttaggaactgggctgcatagcaggaggtgagcctcctatcagatcaacagccacattagattctcattggaggtgaaccccgttgtgaactgcacatgtgagggatctaggttgcatgcttctgatgagaatctaactaatgcctggtgatctgaagtagagcagtttcatcccaaaaccatcccctagccccccatggaaaaactgtcttccacgaaactggtccctggtgccagaaattttggggactgctgatgtacatgaattggtatagttatagctgtgttccagtaaaattgtctttccaaaaacaaggaatgggtcagatttggcctgcaggctatagtttgccaatccttggtctttttttttttttttgcttgctatttttccaaggtcatgtaccactgagatgggtattcagcaatgaaaatgaaagtatttcaaaaccaaagaactgtagaatgcacaaaaaagtttgtattattaaactatcacaatcactctactgtattctctatagaatgtcaataacactattccatgcagtgactagtgggaatgaaatgcaaataatgaatgatctggaatagtacaaactagcacaacacaaaagcacggggctttcatttgttaggaaggtgctagcagatgtacaggaaagaaaatgccaggattttacttctgatcttattgctcctgtgtgttgggtttcagcagatacagttggccctgtaggaacaccagcagcattcattgctgggttagttccaaatgaggttaattgtatatattttaagtaagttagaacaaaagtgacattatatattgttacaaaagattctgtcttccatgcaaatacttccttggccacaggaaaagggttctgagtgacttttaatgtagtaaagtaacttggagaggtatggttggaagtgtctacatcttacttgtagggtggacatcttctttggtgtttaatagttttaatcagaaggaaaactttttccttatttgttggtttataaaatgtaaatataggaatgaggagtttgaaaaccctgggacataaacattattcaaaaaaaaccctaggatataaacatatgattcaaaatacgtagaaaagaaaaatgatgttattgtgttaaagagttacagctcatatttgaacacttcagggcccaaataagcaagcaggcaaacaaacaaacaatcatagtggtgactggtgcctgtcacaaagtagaccatcaatgaacacttgaatattgaataaaatgatgtgattaggccaggcacagtagctcacgcctgttatcccaacactttgggaggccaaggtgggcttatcacctgaggttaggagttcaagaccagcttgaccaacatggagaaaccccatctctactaaaaatacaaaattagccaggcgtggtgacagatgcctgttatcccagctactcaggaggctgaggcaggagaattgcttgaacctgggaggcagaggttgcagtgagtcgagattgcaccatcgcactccagcctgggcaacaagaatgagattctgcctcaaaaaaaaaaatgtgattaattccactcaatttttcttctaatttcactaaaacgtaaataatactgtagaaatgtgattaatgattttaacataaacataataatttcattaaaaatatgtagatggcatgtttggacataaaatatatctctgtgttccatgcaagatatatattatacttttttcaattgatttcctgtcaactattataatgctatgacttacaataattttctatatgaatatatttctcaaaattcttgtagtttattttaatctaacatgaataaaatgatcaaatatgctttttgaaatattcttaatatctcaataaaacacatatttgcaaaaacatattttgttctgataaaaagtatatagtaatatgtaaagcatgtaaaaaataaaagtaaatattaaaaacaacattaaggttctggaagaattaggttgcatatgtgtggtgtgcatgtatacatgtatttagaataggttgtatacatggttttacattttctcctataggaagagagaaacaattttccatgtcagtatttaataaagccaccatattatgataatagttgttttccaatttttaaaattttaatataatatttaatatatcagtaataattttctaaaattgaaattatattttaatgcttttaaattttttattaacaaataatcctccagaaagatggtgacaacttactctcccaccaatagagtgcctccactgtgactttcctaattcagaccactacaattggaaaaaaaaagactaacaaataggtagttaaaatttgtatcacattttgaatttgatactctgagttgctcttaataatttttgaatatattttactgcatatagtttttatttgcaaattgttttactgttctagtggtcagcattttgccatcaatttaaaagaacacttaataatcatatgtctgtcttgtaaggtaaaacatggctgcatatattttctttaacgatgcttaagatcattttttggcttagaaaggtattacttttagttaatgtactataaaatgtactcactatcaacatttaatttataattttctaattttgctttcacagttaaaaattttcaattttgagattaaataaatactattatttgacccagcaatatcgttactggatatatactcaaaataaaatagttttactaaaaagacacatacatttgcatgttcattactgcactattcataacagcaaagacacggaaccaacccaggtgtcagtcaatgatggactgtataaaaggtggtgcgtatacatcattgaatactacacagccataaaaagaacaaaatcatgtccttggcagcaatagggatacagattgaggcccttatcctaagtgaattaccacaggaataggaaaccaaatactagatgttctcatgtgtaagtaggagctaaacagtgagtacctatggacataaacataggaccagcagacactttggactagtagaagttggggagggagcaggtaggggttgaaatacctacctattggatactatgctcactacttggatgatgggatctgtaccttaaacctcagcatcacacaatacaccatgtaacgaacctgcacacatacccactgtatctaaaataaatgttgaaacttttattcagatcatttaatgttttgttttgcaattctatgtggttattcctaacacaatttattttggcctgaaacgtagagaacgagttttcaaaataaaacaatgcatcaacagaattcagtaaataatctttctctatggactcacaatcaccccttggatgtagttttatatatagcatgtatatctagactttctattctatttccttttatcagcattttctggagcaatataacattttaactacagtttttatgtgttacaaaaacatacacattctcttattgccctttctattcaacactttcttggttatacttttgcactttcaaataatataagttctaagtattatcttatttggccttgtttggaatttctttatacttttcaaatattgtatgtaacattaacagcctacatttctgagtgctcaaattaatatatcacatgtccatttatatacttttatggttagtaaattttaccttttaaattgttctgtatggttttaataagcagtagtttgaactttttgttgcttaatgctatgatttggatatttgtgtctactctaaaattcatgttgaagctcaatcaccagtgctgcagtattaaaaagtagggtcgttaggaggtgtttagaccatgaagtattctctcttctggatgtaattagtgtctgataacagtgcttgatggggtgagttcagcccttttggcatttcttccacatgaggacacctcattctggtgaagaatgaggaaacagacactcattgaacttgctggaaccttgatctagaacttaccagtctccaaaactgagaaataaatacccattctgtggtattttgtaatatcagcacaaatagactaagacacttaatgcattttttccatattttctaaattatatgtaagaaatacatgtacatgtatacataaggcattttgaactgttaatgagtttaatgaaactatctcttctgtttcagcattaagacactgaatattgttgtgagctatttctatattggtatgattaggaaatattaatagatgccaaaaagatttgaagatgtaaatcttttcagaaagaaaaaacaagagataaaatgaacacatttaataaaatatcaattgagtgttaaagtctttttatttaatgatgcagtaaattacgttattaaatatcttaccttgacttatcctttttattcttggaggaaatgcccctttgtcatttaatagaattttatctgcagtgtacatttttaaatttagaagttacaactaaaagtggaataaacataactcaaacactctatttttcctatccattgctatttgagaatatttggttcatgaagctctgattgctctttcttatatccttcccaaataaccagtagaaaaaatagagttatattgctgtaggaaaagaatgacaaattgctagaatatgttccctttttctcttacattttatttcctttgtatgttaaattaaatcacacaaagtcatgcagtttcaaagacgtcagagaaaaggactttgattcaatttaatagagctgtcaccgtaatacagggctagcaatcatgcacttcaaaaagtacacaaaactcaaagaatcatgctgatagaggtggctccacgatgcctcactttgttaatcgcaagaggttgctcagagtgtcatttttttttctagtggtccaatacaaagtgggaaagtcaccagcagcaagggactctaaaattataggcttgctaccttagctacttttctattatggaaataccacatatggtggaaatgatagcactcagtggtctactttggaagcagacaactcccttcatcatttacacatttgttctatattttggcagtgtcacggaaaccattatgtgtaagaaacaggtatatataatggttcaatctttcaagatttttgcattgtagaacattagactatggcctactatatcatttctctacatgaagagattagaccagagtttttataaagattatttccagtaatatgttttagtgactttatacaaccactattaagcagctattttaatgccatttagtgttagatgttaggtgtacaagagtgaacaacacagaaatcatatttatgtaatgcttagttgtttaacctggtgctggctatcattttaggtatctgcacgttcctggaacccaatctttcatggataccaaacaatgactactatggcaacatctgcatctaaattgtgtaaaacaattttaaaagaagaaaatactatagtaaccaagacagtttggaattgggtaaaagaaagacatatggattaattgaaaaaactaagactccagaagctgacccgcatgtataccattgattgatttttgacaaggtgtaaaagtaatttcatggataaggaataagcttttaaacacaaggctctggaacaattgtatcaccaagtttttctattttcctttccttcattgccagataattttaagatggagtctggaaagaagattaattagactagatggtatttgtcagttgagaagttagaaataagttaatttgctcaacaaataagatggttatcatattcatgctaagaaagatcagaaaaaaattcaaataatcactgtgatgaaaattttaggaagccaattcaaaattaactaggattgcctagaagaattaagagcctaggtgaggaattccataagaattttagtggaacaagccattattatgaattttgacaaaatacaagctggaaattgacaaatgtaggactctaatacatcaacatttgctcttcccgatcttctttccacccttgtttattctaccctctaaacactagagatcaattcaaaggactggctttagcctccagctactgaacagctttggttaataagaagcacctgcagaagactagaagacaacaggaaaggggttgtctagtattttctagtctcctccctgtctgttcttattggattacctgtgtcctacttccaaaggccacaccttctgtaacctagaagctttccattttaggttctggtccttctcttacctctgtctctttaggcccaatgctggttttgctgttattggtctcttgagaactgtaaggtccttagttttccttaaactctacccatattttaataagtaattaccatattaaactctccccaaatacccagttagactgtttattcgctgatgtgactctgatcaacacagtggatgaacatattggaaaatgtcaacaaatgccttgcaaatgatttattataatgactaaatgactagaaaggcaagaaaaactggaaggagattaggagatgtaggtgaggtcaaaataaagaatagttgcaatgggaatgaagaatgggaaaagtgaaaagcagcaagattatgtttaaaaagaccaaattttaggttttatttactaataatgaagaatttgtgccctgattatttccaagaggtggctatgggatgaattgtttgagagacgttttaactctgctacatttaccaagaaccttatatgtgagaaatgatgtattaggcattgtatgtgagttataacagataaaccacaagctatcagcctgtaaaagtacaaggacaataccacatttaaatttgtaattaattttatcatggttttaagaaattttgtagacaaaattatatcatattgaatatatgatataccaaatagaatgacttgttctttcatgttactgaattttcagccataaattacacacctaaaaccttttaaacgttggggtaatatatgaagcaaaaacacacaaccatacatacacagacacaaaccactataagtttattgtcaaaggaaaattaatttcactgccacaaagtaacacttgaaaattccacaagatagaatttcttaaaataatgaaaaatcttatctttctggtaaacacaattctttaacctttttccttttttacatccttaccaatttgatagcaattacaaggggagaatagtgatttaaaatacgctttaaagtaagaactgttatatgagaaaactggcttgtcattaatatatcaaggctctgaattcaaattcacagatattatctccttcaatttttgcatagtgcttttgttaaataaaatacttgaaattaacttatattctgaattatataaaatgaaacaaaaaactttaaatttaaaaatgatataccatgccatagaggataggaaatctcaagaaagttccagtgatttcctctttcccatattaaaaaaaatgctaccactgaagataccgttagaaagagtatgttatattgtgttcaacctgacaaagaagctatttcaagaaatgagaataataaaagttatttctaaactttgagagatctgtcataatgaattgaactagttcagtttctgattgcttgacagcagtatagctgtctccaacctactactgtattgatctggtagcctttgtggcagtgcataaagaataaccatctgtgtcaggtacaacagcaggtgccttctcaattgaactggctgctgccctgattacaatgaggctgttcagagcacccggtgaccatgacaggctctttcttctctgtagaaaagaaactcatttctaaaagtttactgaacagaaactgagaaactcaccagaaatcatcagccgttgaggtgccagaatggattccagtgaagacaaagtaagagatctagtgaagggaagatgccggcttgcagtgggaaattcctgatattgcacactaggctgaagttcccatttggaccattctgaagaagtcttgacctcttttttaagagaggtcatataatctgtaaaatatggccaatctggcctaattacagacatggaggaagacgtctgtattgaaagtgctggagttgctgaaactgtataaaatgcaacattggtggtgacttctgaaaaatcaggcactgagcctgtcaatggtggcagattatttttgaagtcatttgcatgtgtaatttctgaatatgtctttaaagtaacatccggataaatttgtaagtttaactcaaaatccagagaactatcacttgggtgaagtttgaacagtgtatgagatcctttacttttttccatgtccaataagctctcttgatttagtacctcagtgggtcccatagttatgccatattgtcttattttcaatagttttaaaatgttttctgatactgacagttcatcagtagtcatttttgaagtcaaatcagaattcatcaagtctgaagagatagtttgtgaagggacaatggataaacaagtcttatccaaacataaattaacatccaaattacttgatagggtaatggattcttccaaggatgaggataaaattgttctttttgcactctttttagaaggaaataaagatggcacttctgtgaatgccactgatggtgttatttcagtagcagaagaaaatgaatgcccagaagtgatagtttgagctcccattagtgcataccagctggctaatatcgctgagttcatccagaatgtctcataaaagtgggactgtttgctatgcaaaacttgatctgagaattcacgagaggattttatttcagtcatagaacatgttgcacatgtttggcttaattctcttaaagaatcagcagcctgtgatttgatgtttgtgagtctctggttgcttgaagcctcagtaatagcctgatattcactgggattgaaggcttttgtactgaaccggtgcagagctgatgagtttaagatggttacctgtttagatataattaccttagcaggaaaaatgggagacatcgaggggctgagcaatctccagtgctctcttcttgaaattaaagaatcagctgaatattcttcaatatcctcttgagcccccctagagacaactggagttgcacttatggaggcagctataagcaggaatccacgggagagtaatgactgcctgtttagctcaatatcagcccctggaatgcttctaattactgaagtcgttggggtagcagataaagcaacagtctgacagttctcaaataataaagattgtgtaggaaaaataaaatctgacattaaggaagacatgataaatggggtccttgctctcctatcaggaaaaaagaaacctagtgtggctgctgaagttcgaataggcatatgtgataccgatgttttgtcctggacaatttgtgctgggtcacgaataccaaaattcaggaatcgagaagaggaaacatctgcggaagaaagaagactgtgttttgctgaaagctctctagtgacaatcagttcttggagtaagtagctttccaagggtgtgctaattcttaatgttgccaaaccagtggttgggagaatgtcgtgcttgacaatgcctgtctgttttggacctacaaaaaggaaaaaagccaaaaaggttagaaaaatgaatcagaaacgaaccactttggcactgggataaatctcaggcaaattgcactggcaccttacatccattatatgtagacaaatatggttctgtaaatcatatttctaataaaagtacatgaggagtttaatgatttcacaaactgcataaatgcaaagattcctattatttacactccatgggagggctaaagttagaacaaatggcattacatagaattgacatattcccaactaaatgactcctttgaataagaacacatgaaaaattacaactctttgtcattgacacaaccaatgaatgtttgacccatcgggttagaaatgttagaaataccgttttacttcctcaataggcaaaatgttctgtttatattagataacaccatatttcaatttaattttttaaaagaatagaaattacatagatgaaaaatagacaaggtacatttctacttagaatacccaatagccttcaaaattattttttcttcaagaattccttgctaagggctacaattcttactctgattatccgaagtggcattggctacatgaagagtaaatttggaatttaatatacaatgtactgtttataatatgacatcacttgatttagaaagttaaagaattggacatgtaaaaaacagcctgaagttgttaaaataattcacaataggaaaataagcacatatcttttatctgagtgttagtcaaataatttgataggaatataaatttaccttaatgactcagagaatatgaagtaaagacacattgatgcaagtagcacaaggcccttttaaaacaaaatgtgctgggattgaggtccagttgtctattcgaatttacacagtggaataaaaactgttaatttacatttttttactgatccagaaatagtattagcaaacaacattgtttaaaacaaaacttaaaacaggagtcataaccaataatgcttaattttacacccctaaaaatcatgtatctcagaaaaaaaaaagattttaataatgcagaaaatatgcttttaccacacaactttttcaaactcaaacttcttaatatcttacccacttctacttaccttgatcaactgggtaagtgtccattatggctggtattctagtagcctttatagatggaaagctgctgaccaaagtctcagaagggggaattgtatatgtctgtgtggaaatgggatctgttctttgaaagatgggagttaaacaggtaattctccttatttcatcaccacaaagaagcccaatggagcaggtctgcaaatgacaattacagtaattaaattaagctcagtttctttgttcctaagagaaattgtaaagtttgttttgagatccatttgcatttccatagacatattggatagctcaaataaaatattttacttgaaaattaaatctccatagtaaattttacccatatttcaaaatggactcaatcctttcaatttgagatatgcacagttgcatgcccaaatttattcttaattcctttaattttaagtcaaaatactatttttacttttgagaatatagttttccaatgaagaatttgtactgtatggtaattaatgtggatataaaaaagaagtcacattacaaattataaaacttttctgctctaaaagtcaaatttagttggaagctaatgtaaaatgcagtatctgcaacagaaaatttgaaaacatattcttgtgatttgcaaattattttagtttgtattggcttgcagtaggaatgatctttatgtgttttagtttgacatgaaaaggctatttctaccatatcctataaaatagctttcacatgaagaaactgtgaatgaaaattgcgataatgtataaataagtataaatggaccagagagatacgtttataaatgtagagttaaaaacaagttatactatatgaatcatttttatttgtaagaaaataatatttcaaaatgattttaaaatactaatacatgtctatttcctaataataaagacatacctaataggcatccctgctttagtgttctaatatttgttaaatattacatctaatttgcagaacacttaagtcttctttcagatgtgggtggtggttgtttcacagttccatattctgtagtcactttcaactcacaccaaaaagttgtataaatgtcagatgattcctaatgttagataattcgcaacaaagaaaagcccaggaccaggtggctttactgctgaaattgatcatacttttaggaaagaactaacaccaagtctttgctattgtgaatagtgctgcaataaacatacgtgtgcatgtgtctttatagcagcatgatttataatcctttgggtatatactcagtaatgggatggctgggtcaaatggtatttctagttcgcaacccaaatgtccaacaatgatagactggattaagaaaatgtggcacatagacaccatggaatacaatgcagccataaaaaaggatgagttcatgtcctttgtagggacatggatgaagctggaaaccatcattctcagcaaactatcgcaaggacaaaaaaccaaacactgcatgttcttactcacaggtgggaattgaacgatgagaacacatggacacaggaaggggaacatcgcacaccggggactgttgtggggtggggggagggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaatttaaaaaattatataaaaaaaagaaaagaactaacaccaattcttctcaagctattacaaaacattgaagaggaggaaattcttccttactcattctatgaggccagcattaccctgacaccaaaactagacaagaacataaaaaaatccacaggcaactatcattgatgaacctagatgcaaaagttctccccaaaacactagcaaactgaatacaacaacatatcaaaaaataatacactatgatcaagtgggatttatcccaggcatgcaaggatgtttcaacatatgtaaatcaataaatgtgacatatcaatcaacaatatcaaggacaaaatccatataagtatctcaatagatgcagaaattaatttgataaaattgaatatcacttcataataaaaagtctcaacaaatttggcattaaaaaatactttaacataatgaaggtcataaatgacaaacccacacctgaaatcatattaaatgggcaaaagctgaaaccctttcctctaagaactgtaataagacaggatgcccactttcaccattgttattcaccattgtcccggaagtgccaacaagagcaattaggaatgagagagaaataaagagcattaaaattagaaaaaaggaagtcaaactgaccctctttgcagaagacataatcttatatatagaaaaacctaaagactccaccacaaaatctcttagagctgatgaacaaattcagtgaaattgtagaataaaaaaatcaacatacaaaatttagcattgtttccatacaccaataatgaactatttgaaaaagaaattaaaaatgcaatcccagtcacaatagcctcacaaaagaaatacataggaataaatttaaccaaggaggtgaaaaatctgcaaggaaaactacaaaacactgatgcaagacattgaagaggacagaaatgaagggaaagacatcccatggttatggagcagaagaattaatattatttcaatgactgtattaaaccattctgcattgctataaagaaatatctgagactgggtatttcataaagaaagtaggtttaattggctctcagttctgcaggctttagaggaagcatggtgctggcatctgcttggcttctaagaatgcctcagatagtttacagtcataacagaagacgaagagggaggaggcacatcacatgacaaaagcaggagcaacaaagagagagagagccagggaggggatgggtaggggacacacactttaaaataaccagatctcacaggaactcaccaactactgcaacaccagcagaaagtgatgagggatccacctccatgacccaaattcctccccccaggccacatctccagcactggggattgcaatttaacatgagatttgggcagggtcaaatattcaaactttatgaatgaccatgctattcaaagcaatctacagattcaaagaaatctctatcaaaagaccaatgatatttttcagagagataggaaaaacaattctgaatttatatggaatcacaaaagattctgaatagccaaagcaatcctaagtaaaaagaacaaagctggaagcatcatactctctgactttaaattatactatgtagctacagtaacttaaagcagcatggcattggtatgaaaacagacacatagaccaatggaacagaatagagaagaaagagatagattcacatattcacagctagctgatttttgatagagataccaaacgttagagaaagaatgctatcttcaataaatagcgcagggaaaactggatactcatatgaagaaaaataaaactagactcgtatctctcaccatatacaaaaatcaactcaaaattgattacagacttaagcataagaccccaagctataaaactactagaagaaaacagagtaaatgcctcaggacattggtataggcaaagatttttatgagtatgatctcaaaagcacaagaaacaaaaaacaaaaatagacaaatggaattgagttaaactaaggagcttctgcatagaaaaggaaacaattgacagagtgaacagataacctgcagaatgagaaaaaatgttttcacacaatgcatccaacagggaactaatatttaaaattttacaaggacctcaaacaactcaacaacaataaaaaatataaccccatcaaaaaaagtggacaaggggcatgaataggcatttttttcaaaagaagacatacaaatggccaagaaacgtatgaaaagctgctcaatgtcactaatcatcagagaaaggccaattaaaactgcaatgagatattatcttacattagttagaatggctaccattaaaaagacaaaaaataacagatattggcaaggatgcagagaaaagggaacccttatatgcttctggtaggaatgtaaactaggacaaactctatggaaaacagtatggagatttctcaaagaactaaaaatagaactacgattcaattcagcagtcccactactgggtatacagccaaaggaaaataaatcattatatcaaaaagatacatgtatttatatgtttatcacagcaccgttcacaatagcaaagatgtggaatccacctatcagtgaaggctggatcaagaaaatggtggtatatatacacaatggaatactagtcagccataaaaagaattaaatcaggtgttttgtagcaatgtggatggaactggaggtcattttccaacatgaaacaacccagacacagaaagacaaatacccacatgttctcagttacaagtgggagctaaataatgtgtacatatggacatagagtggagaaaaataaaaactggagacttaaaagggtgggggaggacatgggggggtaaataatgagaaattacttgtggttacaatgtctgttattggagtgatggatatactaaaatcccagatttcatcattatgccatatagacagtcacgtaacaaaattgcacttgtaacgcttaatttgatacaaattttttaaaagctaaaagagaattttaatgttcacaacacaaaaaagatatcttcaatattatgctaattaccctgattttatcactaacacaatgtatacatccattgaaatattactatgtattccataaatatgtacaattaatatgcgtcaactaaaaataaaagaacaaaagaactataaagtgtctgtgtataaaaacttaaacattaagtggaaaaatatccacagcaaacaaaaacacagggtcaacaggatcccttaccataatggatacagaatgcatgtaaattaagaaaaaagagaaggggccaggcgtggtggctcacgcctgtaatcccagcactttgggaggcccaggtgggcggatcacaaggtcaggagatcgagaccatccttgctaacacggtgaaaccccgtccctactaaaaatacaaaaaaattagccggccttggtggcgggcgtctgtagtcccagctactcgggaggctgaggcaggagaatggcgtgaacctgcgaggcggagcttgcagtgagccaagattgcgccactgcactccaggctgggcgacagtgcgagactccgtctcaaaaacaaacaaacaaacaaacaaaaacctaataggtaccaagatgatatagtaatttctatgaaacatcatgacttaaaaaattattttctttctgaatctatgtttgaggaaaaatatgcaaataagatcttctgaattagagctttatgagaatatggtcatctgctttcttgtggacattgtatagccctctatgtcttcactcaacaaatgtttattgatcaatatctaagtgccagtaactgttgtaattgttggaaatgagctggtcaacaagataggcaaagtttctccattatatactttgtattttaggaaagaaatttgaattaattaatatcaattagtgataagtgattttaagacaaaatatcccaaaatacataataaggaaaaacagcaagggctgttttggaggcagtggccagggaagtcttctctgaacagggatataaattaatgtgagtattttaggaaagagtatcaaaggcgaaaagaacagcagtgcaaaggcctgcgggcaggaaaatgcttaatatatttacacaaaagcaagatggacagttaaagagaataagggaaggccatgtaggtagaaatgaggtcacagaggtgattagaaaccagataatgtggcttctttacttgtttgttgttgaatttggaattgattctgagaattataggaagccattggaatatttgaaataagaaagttctaatcttattgatatcataaaaagcttactgtagataatatacactcaatggagcttggattcgggggaagaatggaagctaaggtatatttgggaagcagggactgatccaggaaagggaaataattagactgacctggagtggaaatggtgaatatactgagtaaagtttgtattcagggtatacgtggaaggcagagcctataatacatgctgatggactagatgtatggggtgagaataaaaagtttagtgaatgatttgtaaatttgtattcctatcaataaaatagaaataaaaattaaagaagacaagcaaatttactaaattatagaagaccagttacagattggaggatagatcacaatttctgtttaaatacattaaatttgagaagcttattggctaccagatatgtaacaagttgaaaatatgagtctctcttgaagcagaattattaatagtttcaataaaataaagtatggtttaaagaaaagcagtgttatcccatagtcctgtctaattttctggtaatagagctagaaaatggcagagcaaagatttttacctaagaagtgaggctccagaacccacacttcaaaccactatactatacttttgatatatgaaacatcgtcaagatttgttatcaatatttctaagctaaagttgattattttaggtaataaagctaaaacaatcttgtactctgacagtctacttaacaaacatcactgtcaattaaatttaatcatcacaaaccatgttttaagatctgggcaaaacagtttctattatctcaatgactttacaatccagtggactgttagtatatttcactctattgacagtaacatttgaagataaaatgttgtggcttatccttattttctacaagaaataaggagtacataatacagaaaaaacccagcatccttcaggtgacttgttcctctttcctgtgtctttccagcctactttgagtggtttcatgccattgctgacctctgtttacctcactaacctctggttattttcagctctcttttttttcaactgtatgtccaattctctctatggtttctgttttcctcattaagatattaacagattctgtgttctataaaagatacataggatatttctctatgtggttatctaacttgattgggagacaaaaggcaaagtaggtggcaaccagaaagtgagaataatattctgaagatatcatttacccataataataaaaaaactctagtaataatcaaatatcaaatgttaagaatactttgctccaaaacatgtaatattgagatatctttgtgctatgttactgggctagataaatattttagtttctaggtttttaaaaagatttttccacacaaaatcagtatgtagggttcatgataataattatagtttttaacagcattccttttgttatgccaaattgatttgtatgtcttttccagcatactaccagtgcccctaggaaggggactatgttacattttccactgaatggccggggctaatatgatggctggcacatactgatgtacttgatggtcagtaaacatttattggaaaaaactaagagaaacatattgaaaacacacgtttatctaagtacatacatatttctttttcccttttgtagataactgtattgaaatgaatattcattaaattatctaaacttttcattctttcctcaagccattctaatgtagctttcatgtcttcttgccactaggactgttatagtgaaattccagaaatcctattgtgctgttaaatacaaagcacagtttttgatcttcatcttattcaaatcatctacatacttaactaccaccttctaaaaaacttggtttctctctaaccttctacctctttctcctattcattatcaatctcctctgctggctccttctctttgtagcctctagtttggaatttatcatggcttagtattcaacttttttctttctccattctccccagaagcaatgtcatatattcaaaaaggctataaagatatcatatattgatgagtcccaaaatcatatctctacttcacacttctctgaaatacatttttatataaccaactgcttatttagaatcattatttaaatatctcatgggtaccttaaacataacatgtacagtactgaactgctgattcagtctctccattctaacatgttcctccaaccacctgtcccatcacaggaaatttattatcattactctattgctgaagtcctccctgatttttcattatcttctatctcacacatctactcaatacaatgtcttgctaatttttctttcataacacatttcaaatccagccttttctctgaatttgctttgccacaaatatcaaaccatcattatcttttacataataattgttagagcctagctggtttcttcactcccacttttaacctccttctagatctttctttatggaagaataggaatattttaagaacctgaataagatcacatcatttcccttttgaaaaaacttgttagtatatatgtcaattgcacttgaataaaattcaaactaattactatttttctgactctcaacctaacctgaccctgtttacttctacaggcacttctgtacttttgcccccaccatagttactgtgctcaactcccattatccactctttactgtcccatacaggacaagatcttttcctcctcatgacccttgtttatgctgatacatctgacagcacatccataccctcactcttcctttggattatttctttttatcacacgggttataacttaaaggtcccttccttagagaaaacttttctactatctacattatttttctatcacagtaactttttcttttccttctgactactatagtttgaattatattttatttttctattgccttgatttatatgtcattcctggtacattgtaaatgtcactaggtagaagcctatctccattccatcctgcattgtattcagcacactatttgtatgctgctaaccaattagtgtttgttgaatgaatataaaattatatttacaaaattgcctctataaattaggttaaagagttgagcaagcaaaatgtaagtatttttacccataactcgtttaattaaaatttgaaacacaggatggccctttagatgcctttatattacaagaaaaacaaccaaccaaatatgagagttcaataggcaccagtcttgagctacaagagtcatcaaccttactctgagaaataagggccacatcatgtgaacagtctgtcttgaaaccagagatgacagatgaaatggaagtgcaattagcactattacactctttctctttgtcctctacacttaagaaacattttccccttttcccaaggtctatcattaagaaatgcttaatgctgctgaagatgagctcaaaagaattggtaaattatttgaaaatttagcaatttgaaaactaagtaagctcaaagccatttaccactatcccatttaaacatgcatcaagaaacattttcccccttttccgagatctttcattaagaaatgtttaatgctgccaaacaggagctcaaaataagtggtaaattatttgaaaatttagcaattggaaaacaaagtaatctcaaagccatttacaaccaccctacctaaacatgtgtcaggtagctcctaggctttagggactaataaaaacagagccctgggtgagtttttctggttgcttagcaagtcactagaggaaaaatgcaagctggtagaagaataggtcctattgcctcttgtgttgggtggacttcctgaggagctatacaaggctaggacattagaatatgtaatatcatggatgctaatcttccacaagatagtgcctccaggttcaaacactgccctacctggtagctctggccctttttgggataactattttaaaccaggaaagatttataggaaaaaaagtgcttacaggacaaaataattagccccatttagcttttctttttcttctgtttcctcctcttcccccacttctactccatcctccttctcttctttcttatcctactgctgctcctcttcctttttcttcttcatttcaagagcataatcccacagagattttgtttccctgagactgatacataatgagttgaagcggaaagagtgaaattagagatcaggagaccccaaagtgcctggaaaacctctgttgcctcccaagagcacacagaacttcgcccttcttgaaaaaatccattagacaggaaatcattcagaattttagaggagtctggtgaagtctctcttagatttccaaaccctgcaggctgtttatcaaaatcttatacagcctcatacaaaccctgtgatctacaaagatgttatctaagactccagaaaggaaagccctttcatgtagttttctatatgtgatagggctcacagaagtagatggtcatcattcaaactggttctgtggaggtgagtcagtggtcagatctgaagaagtaagtgtgatctatgcatgtcttccgaacagagtctatcttaatggattatatagatagtactacagatcacatgaattatccctctgcttaggctgtgtatactactaaagtaaatgaatacctgtgtgtgtgtgtgtgtgtgtgtgtgtgtgtgtgtgtgtgtgttctctgcctgaagcatctaccaaaaaggtggccaagctctcaagaatatatataatgctggtattcttttcttcccttatgacaacttgacaacacacaacaggaattctcattcccctaatctgcattatttctctctttttttatttttgggtggaacatgttccatcaaatttatgtgcttcgctctctgtatctctgtctctttctcttggtttagaataattcatctataatggctcctgagagtcattgcctgggacactgcaacgtaacattgttttatttattttcctaggttatccacaatatcctgtcatgaaagtttaaaatgtcttttcctaggggaggatgataatcatgttttctgtctgataacctaacaatgtatggcccaaacttttcaaaacattttcaagtatgtcagtcaattaattgttaattcaaatcagttttcatctttctcaaggttaaagaggagaataaaatcaaagaccatgaataaaactatgggtccataattttataaatttgtatgaagtctgaagaacatcaagaatttgtgaaattttccacagagtagaagcacacaagctccatctaagttttatggggtgacaacaatataaacatgaaatagtcacttcttctctggtgtctgataattggtagtgaaaactttaaggataattttctttttccttattgaatttggctaccagaacttcaggggatttgcttcaatggcaatgcttctgaaagcacaagttcattgatttgctgtataattttaatctgcagggagatcttctagcagactaaagaatgcaggaataaggatcttaaggaatgcactgaatctcacttttgtttctagtctatccaaaagaaggtgcaataagaagggaaatggaaagcatagctcaggggagaagtcaaggttaatactagagacagatgcgcaggcaacaaatattgctgcagaaagttgatgaggcaagaggtcaagatgcattgttttagaggcaaggtctcaaaagcacattgactatgtatcaaacatatgccagagttatctttcaaaataaaagtctgaccaggtgattcctcagttcaaaaagtcatgactggcttaccactcttcttgaaaacagtaaaacaatttaatctagcacacaatatcaccagctatttcttattgaatattgatttttcttattgaaaacatggtgagaaacttacttaggttacccccaaattttaaatatatgggattttctcgacttttcacaatgattaagtttaattacatgtcaattattttcgatatccatgatcctaatataagaagtgccaatggccttcttatacactaactacatttgtagatattgagttttaaaagcaaaaaaagtttgaatgttaaagttatatgcctgactacggccaagttcatattggaaataccattgtttttaatttaaatttaagtactttgtatttaactccaaatagcaaaatcaagaaattactctgtgtcagtcatcatatcagaacaatttaataacgcataattactacaggtgcaaattatcagtgtgactaatatatatagttatatataacataactaaaactctgtggtcctactgtcaatagcatcctctgaattttttttttctaaattctcacctaattgaaatcaaataccttaaagatttccctgagaccactgtttatgactcaccagtcctagaaactgatatctgatacagaaccctgagtatgtacaagtaaaagagccatgaaacatttcagaagtcaaattgtttgatctttcctactattttggtaagaatacatggaattagcagacactataggtaaattcgtgggtcatcgatgtgaggatcccaatactcaactgatttttgagaactggcaagtagaaatttaaaactttctttttcttaccaccaaatatctataacatttagggaagcttttcttaagtcacagaatgttcaactgactgctcataagaaaagacatttatttcatgaaacatcttacgttcctccattggaaataatgtcctcattctctgaatctgtataatgttatgtgtttacattttatgctgcttacccatttcttttctgtgttataattgttgttttgcatgttgtatctcttctctacgaatctgagtttcttaggataaaaaaaatcttaaatagttgttagaatctaagttcaacaatatacacatattaagtgctaaaatatgtgtcataaaggatatattaaaaaataacataacctcacatctttccattcacactccttgaaagtaacttgcaagctttcctacctgttctccctagaacaatgtctccttgtattcaagaagacttgctacacttgacctcctatatagactattacttgagccaatctgagcaaacaaatttggactgcatacctttattttgccatccatagcatcttgtttttatacctctatcaacacatattagttaatatattatcatttgtttacccatttctcccttggagtattattctataccaacccaaacagccacagttgtcacacaccaatgaatacactgatcattttatacttatctttaactaatttatcattagaaacattaagttggcatcttcattttagaacattaagaacaatgtcttctgaacactttcaagcctctctcattttctacaacatactgtggcaatacatattttctttctcctttcagattgaagtgagtcagccttatagtcagaaagtctttgaagctagtcttcaaactctgggaatgtgcacacagccttctccttacttgggaattcaagtgcaaatgacatgaaaacagttacagaaagtaaggcaaaaccaaatcaaacactatcatacaaggacaccatctaacatccaaaatatatcaaaagcagcaagcaagatatgctgtgttgtacgtcagtatccctgagctgcatggagagcaacaaccaacaggtcttccttcctacgcattaactcttttcttagtttcatttatttttaattaaggggggaaaagcttaaagcaggtggtttctgtatgaataaaaaaaaagactcctaagccaaaagagaagtataaaaccctgccgtttctcagtggcaatgccagaaaaagcagagaaacagagattggtttttatcataaaaaacgcaatagatgcaagttatattttctcccactgccttgccagaatttaattatttctagaataagctagcaggtgtaaaatgcacagttccatttgttatcatgtaagaaccatgtgaagaaaagaagttttggttaaaaaaaaaaaagaaaaaattgaaggcactaagtcttagtctgttcaggctactgcaaaaaaagataccataaactggttgacttataaataacagaaatttatttctcatagatcaggaggctgggaagtacaagttgagggatgtttagtgtcggctttctcacagatggtgccttctaactatgtcctcataggctggaagggactatctagttatctgcagcttttttataagagcactcatcccaatcatgagtacttcaccctcatgactgaatcacctcccaaaagccctacattctaataccatagtcttaggggttagaacttcaacatttggatttgggtgagggagatacaaacactcaggccataacagaatagataagctaatctttatataagttaatgtattctgtgctcaccaaaagaaatctgagtatggctcagagtgaaaagatctagaactgtattttggttgcagagtgaaaactttctgacgtagtgctcatggatatagggtttgtattcactggacaaactacattctaacatttgctatctatgaataagcgaccaacatctctgagcctgtttcctcatcatcaccataggaataaataatgattcttacatcacaaaattgttttaatcattcaatagggtaaagtatccaagacatttagcctggcaaatagttaggcttccttcataaataataacgttttaatggaagcttatggctcaagtgatattttaaatcactctaaatattattgtagaaaacaatgcattatatctttagcagtgtatgatattgcattcaacagactgttccacaaaattcttgtgcttagttgtgattaacaccacaataattgtaatccattcatgttttcgttcatgtataataatcaacaaaattttatttagaatctactatgttgtatctgcctggagaacagaagtaggtaatatgtgcacagttcctgttttatggaacttattgaagaggagaaaagcagaccagagagggagaagggaatagagaagaagaggaagggaggtgagagtagttggtcaaataataaatatatagccacaaaaataattgatgaattacaattttagtaattgctatgaagacaaattataaaatgctgcctaatttcttgtgcgaatgcaaaatggtacaaatattttagaaaacagttgggcagtttctaagtaaacatactgttactgtataatccagtgagtgtgtgcctcgatgtatagcaaacgaattgaaaacatgttcacacaaaaaactccacaagaatattgataacagccttattcatgattgccaaaacttgaaaacaatcaagaaaaactttagtaggttgaacggataaaccatggtacatctggacaatggaacattattcagccctgacaggggctctcatgccatgaaaaaatcctggaaggatattaaatccccattattaagtgaaagaagccaatctaaaagggctatatactgtattacttcaactatatggcatccttacaaatgcaaaactatgaagaccctgaaaagatcaatgattgccagagatggaggggacagaggaattcacaggaggatcacagaggatttttagggcattgttactattctgtatctataatggtggttacatgtcattatgcatttgttcagacccaaagaatgtacaagaccaagagtgaactctaatgtgaactacagactttgggtgataatgatgtaatatagatttattgattgtaacaaatgtaccactctgtcatgggatgttgatagtgagggagcctgtgcatgtgtgtagggatgggtatatgagaactctctgtattttctgctcactttttctgtgtacctaaagctcttccagaaaatagtttaagaaaaaaagagttacctaagcacatgttgtggcagtattatgaggtttacctgaaaaagagggacatatgctaaaacctgaaagatgagtagaattgggatagtgggcaggaaggattggagatcattctagttaaagtgtagcatgtgcaaagacacacagccagaattttgaagggaatatttgagcaactgaaggctaaatagggggctacagtacagggttagaagatcaggaggaagtgaggctagagaagttatcaggaaggggtcaaactgcacacagccttgtagactacggcaaagttgtaggacttcggaatggattttggaatccaatctgtttttattttagagagtagcttaataatatctttgtacagacattgtggctcatgcctataatcccagcattttgggaggctgaagcaggacgggtgcttgaggccaggagttccagacaagcctggcaacatagtgagacctcatctctacaaaaaatattataaaaagttagctggttgtgggaacacatgtctgtacttccagctacttggtaggttgaggcaggagaaccatctgagcccagaagtttgacgctgcagtgagctatcatcatgtcactgccctccagcctgggcagcagagaaagagcttgtctaaatatatatatttagttatataatatattaactatatatagacaataatatagttatttatcttaaaaataaatggatattgcatttagttatctatcttaaaaataaatggataacatttatggcatagaggaaagaacactgatctaccattctgtaagtatgggcatttaaaattctgtgcccaactctccaatgggttaacaatgttatcttcaatatagccaagcttttaattcatccacatgttcatgctgtaagtgaagaaacaggctcagagaattttccatctaattgaagtctaaaatgttaagccattacttttttgagtcaatatatgacattaaatatattctaggtttctaccaaatacattcttccaccagccacattaagcaaaaatctgatgcataaagatgaaaggtgggcattcattatctttaatatctacataggtctatgaggtggtcattattttaccatactccatttaccaataaaaactgctgttgtaagaatttttttttttttttttttttttgagtctcactctgtcgcccaggctggagtgcagtggcaagatctcggctcactgccagctccaaatccccggttcaagcgatccttgtgcattggcctctccagtagttgggattactgacagccactaccaagcctggctaatttttgtatttttagtagaaacggggtttcaccatgttggccaggctgatctcaaacttctgacctcaagtgatccaccagccttggctccccaaagtgctggggttacaggcatgagccactgcaacaagcaagttgtaagacatttagattgtacatcacagctgtgccataataaaatgtaaggcaacttattttaaatattctacttctgaaaatattaaactacatttttcattatacattatacttatttaatacagaaaacttcctcttttcattaatatttatgtctttattctagtttgcaccatctcctcccccaaaaccctcacatatcttgcattacaaaatactgtcactgtgttgcttagaaatgctcagaacacacatccctccatctttttcccccccatagcactcattgctgcccataaacaaattaacaaataaataaacacaataattttgtttcttcccccatgcatcctctgctttttaggtggtagatttcataaaagctaggatcttggctctctgttaccagagcctaattgatctggggagaggaaaatacattttttgtgttttttttgttgtttgtggtaaaacttgtcctgagaagcagatcgagccttatttcttatggctattttatatttagcattctcattagcagtactgagcaaaccctcagggtggacttccactatgtggtgcagattaagtttcagcgcttttagagatacctttctaatccttaggaggaagccattatcttttgtccattgagaaatctttcctaacgactactttactcagagttcgccaattgctttattattttttaatattactaccaaataagcgtcctagctaatgcttttatttccctcatcatacagttttcttcattttgtacccaatgctgacttccttattatcccacacattatttgtctcttccatacagctgaatgttctctttggataacaaactgaaactaattgatttttatattattttaaggatctgcaaaaaatggtgctcaacatatattagagaaaactatcaaatttcacccgaataagagcattattgatttttttagtgcattgcaagaggatgtgagcctgtactcttttccttaatttgaatgtaagactagtgtatatgtatttctttataagttttccaaatacattgttttagtgagtatccaaaagatgtgttttgactgatctaaaatacaaattacttgaattcaaataaggataaatgtcaaaaccacaaaaatatctacttaaaagagcattacgagtttgtctaaaatggcatctttgctttatttcctattaggagataataaatattttttaatagaacaagtcatctcaaacacagaaaacacttggtaaatatttattaataatattgatgactttatcacatgagaaaataaagaccagaaacatagacatacatcaaaatgtttgtctgtcttgctatactggtgtcttctgtgttaggtttattttgaagatgacatttaaaaactgaacaccacaaataggctgtccttctgtagaactcagaacccttttttctcagaaaatagtttctccattttttcttcattttaatacaaatacagcttccacactatataaacatctgtgttttaatttaagggctgtaattaacactttcatcgactctatcatttacaaaacacaataagcctgaccaatagacactcatcggttaatgcatggagatcaatcttgtttggcagaatttcatttactgaggaagaaatgagcagttctgatcaaatgaaaaagagaatgatcatttttcttgaattcttaagcaagtttaggacattcaaaaattgtattctgtcatttaaattcttttacagaacatttgaatttcaaaatgatgtaagtactttaatcttgtttggaatcacttttgtaattggatctgcttaaacaaataatattcactaattatcagcttgtcagagattgtcatagctctaaacattaagaaaaacctgagagttcagacttttaatgttatcttcaaaaaattaattctcagaaataaagaaaaaaacagcttcccatctccctacccagcagggactatttacctcccacatcactcttcatcattaaacaagaataactgtagtaatattaatcctatctaatcctgtaaatatgtagctgaattaacatttttatatgatgacctaattagtgaaacttttaaagtagcttaaataaaaggaatctgggaaaaaagtgccatttttctgaagatctctgagaagaaagatattagagggaagttcaggtgaacataaaaggatttaatgtgaagagaattgctacaaattgttaggtaaaagccttattgctttgaattgtgctttgttgtttcatgttcaattaaaaattcaatacaaacatatttcaattatttgaattatttgaatgttctttacacagattgcatgtgctactgtatcagctggtgtagttagagtacacatgcaagacaatttttaatttttaattttttacatgttaatggagaatctgattgccaaattaatgacttttgaacaatcccataaagccttctagtaactctgaaaaacaagacaaccattcaagttgagatacctgagaagcctaattagaacaacaaaatcctttttttaaaagacacattgaattacatgaatgaaagaaaatccattcatgttttcttaataaatatattcataggtcctttcattctaaaacaatcacaaaattctgggttttggtctggtgtgtagagaatttggaagtcatcattcccatctacacaataagagaaaagctgaacaaactaaaaatcaactcttcttagatttttaagaaaattgagatcatttcccactaaaggaaaacttctgcccccaaacattggagagacagtcaggcaggtacaaagaattatagcttaccagagcagaaattcagaagcagaaacctctgctggagccaaaaccagggtagaaaaacaaactgtaattgatgaaatgctggaggctcagtgtgtacgagcttgagagttagttagaaactacaggggagcccactcttagggaatatcccacactgtaatgaactttatgttcaaaaatgctacagggttctcacagtgaggtttggagaaaaatcccctcatgcttccagcatggagaggagagaatagccattttgaagactcccagagcattctgttcctcttaacaaggcttgtcctcaagtgaaactattttaccagagcttagttgacctgcaggaagggaaatacccaactccagccctgtgtagattttctgtctcacctaagggaatggggtacagagaagcacattcgaaggtcacagaccagaggcacagaatcaccaagactgagacctaattataggactgttaaaggcttaccctctccctacaccttactgccatatcaacagggatcttttataacaacaggagattacaactgaaagaactccacacctcacacttctttaagaagaattttctaatgaaaccaaaatacaacaggcaagatgaaaataaaaatataagacgaaattttgacctctgacacctatggctgtagcatagcaaacacagcctgactcctagccagataaacataaaatgttatgctacaggcctatttatctgagttccttttacgcaatgcatcatgtgtttaaatataaaattacaagacacactaaaagccaaaaaaatagaagagacagagtaagcattgaagtcagactcaggtatgacagggagtctgtaattatcagactgggaatttaaaacaactgtgactaatatgctatgagcagtaataaaacaaccttaacaatgatgaccaaaatgaaaacacgtatacagatgctcctcgacttatgatggggttacattacgataaacccatcaaaagttgaaaatattgtaagtggaaaatgcatttaatacacctaatctactgaacatcatagtttggcctagcctaccttaaatttgtccagtacacttacattagccaacagcttgggcaaaatcattcaaccccacacccattttatattacagcgttgaatagatcatgtaacttattgaatgctgtgctaaaagtaaaaagcagaagggttgtagggatgttcaaaataccatttctactgaacgtatgtcactctcgtacaatcataaaatcgaataattgtaaattagtgaccgcctatactgtgctctgtgctcttaggaatactgcaacgtccagtgttgtcttcgtccttcaggagtttacagtgtttcagagttgacagagaaatgagcaaacgttccaacagaatgtgataactgatgcaatgtttagtctcttcccatctattctagtgctagaatgccatgacttaccccctgtacattgtcaactctccattatggacactgttttcatgttcacctacactctatgtacacacttcatttttagtactaatgcaaatcaatttaccttttttctaattcttataactgctttattcttaagactctctcaagtttgatatcttcctgtgaatgaagtacccatgaagtttcacatttccccatggttgtgatttttattcttttaatatcccatttgcactaaagattagtgggggagggaaaaataaacctaaaaagtgattttctaatgtttttatgcattttccatacctgtatccatttcaatattttatttcaatatttacaaatttaacgtgctacaaatattttatcaaatattttgaatatttgattttctgataattcagcagattattttattttctgttccaattaataatttgcgtgttattttcaaaagtatatttcttaggaatatctaatttagagtaaatacatactgctatagcattggcatgaataacatttcaatgttaaaattctttttcaataaactgaatttcccctatctttagctactcattttaaagaataactaatgcattagcaaaagttgaatctcccttatctcattgtagcatttcacacaaacattatctcttgctatgacaagtttttaaattttgtttcagctttcaagtacttagagaatggttgcaaaactatccatttgaaattaatttagtaaatgccttactaaaatgtaaatgcattatgtctataacattttcttctatttagtagacatgtggtcttataaaactatattttccaagatgtttctatttctaacatatactaatgtatttatccttcagatttgatttttttattaaagaaagagctcaaatattaatagattcatatttcacatgtgaaagaacatataccaggagattaactatttcaggaaattttatagatatttggtagtaaattatttgtttttatgaaaacatatcatatgtaaaataagcattgattttctaagttatttagattcctacgtatctaaggctgcactggcagaagacatagttaaataaaagacacatctcagtattttgctctttatactgactcttcgaggaagacattattggtataatctgaggtgtcagaaaaataacttcttggtaccaactaacttccaatttaagtatcagagcatctgatatttttctccaaagatctatcgcttttgtagcagtaagagaaaatctttttcctagggcaaatccaaaattagagaattctcagagaaaggaagatatctgtttgagctcattcatatccctccaaaacagatgagccctgggaatatcctttaagagggaacagcattggacttaagcccaggtccttctacaattgatttttcaaaatcttgtgttccgtgacagttattgattatttttttctatgtaattccttaacctcgtctagagactcttggttctggtttttcctttctgatctttcacttctgagaaggagtttctagctccatttacacttcccttcacacttgttcatcttttatacacactggccagatgcttgaagtatgattctttattctggcactgactctagtcacctgactataccccatctctaattatttagccttaatttcagtgaaggctggtctaataatgatatttataaatatacatttaaaatttctgataacacattcttaccaattgctgttttttcactatattcatgggctgcggtcagttttaataaaagactgtggtcaaatgctattttttaatagagacatttttaccaaggaaagtcatttctagtgctaatggagttcaggccagttcaaacttgctgaggaagcagatccgtcctcctcggacatacaatatgctgagcccaaccctggaagtagtactatgtccttgggcaaaataaaagttccgccaagaccctgacggtattaagtaattcctccactggcatcctccttccaaatgcattaagacattaaaggccaatacattaagtcacttgcaccttggtgtggatcagtttatcagaatgtttttcttctgaaagaaaggactgagggtgcaagtgatgcacggacaacaagggaaagaggaatgccgagaaaagtgtagcgtgcacagagaaggagagatgcgctgaagattaactactccgaccttatttttcaccatataattttctactatttactgtgtatcaaagagaataaaaaattattacaaccacaaccaccagtaatctttaccataaatccaggtgtgcataaacatgtcgagccaggttcattctccatgcagagttcatgaacacatgagttgggaatgcactcaagctcattctcacagtggtgtccagaccatcctgttcaacaaaattacaaagcagatatgcaatttttaatgataataaaaacagttatgctaatagcctatatttattggcttttactatttgaaataattatgctagatgttttgtacaaattacctcagtgtatcttcatgatcagtttatcaggtagctcttattctatctctatttagttcaagagaaaattaaactcagagaaaataaataatttgctctaaaatcacctagttaagtataaatgaaagtgagtacatgtatgatatgtctcagctcttatccgtggtgccatttaacattacatattcaaatgtctttacttattttactttggaataaatacatggaaagcaatagaataaagacacttaataattcccttaatatgaatcttaaattcagaggaaagcacctactatagatctctagatatacaatgttatttgtgatacttgtagtattacagttagtattttacatttagtatttgttatactgtgattctatagaatataagtattgtgtctacgtacatttggccattggctgtaagaattctcattaaacatgacaatctaaaattttccagaccaaaacacagtttgattgtatgtattttgtttggcttttgctagtcaaacattttattatttccatcatcaacctatcaaccaacattgctaagtattccataagctaatatctcagctatgctttactgggtagatattaggaacatttttttgaaaccattgattctttcccatcagataattacttctaatgaatcttaatatgcctaacatgctagccacaacatcatgttaacctaagtatacccttccacatagggacaatgggtctttacaggcagctctcactgctcactgactatgcttactctaatcacaactttttaacttttctttatttttctatgtattgtccaatagcatttaatctgaaccctggctgttgggaaatgtaaaatttaattattgtttatacttaggaagatattctgattgttcttccctgataaattgtaacaaaacaattaaatacatattttgaggtacttagaaatgatttattgaaacacttcattataagaaacaaatagggcctgagtctaaaagacatggcaatgtccacatcaaacttagaaatagcggccaagagactaaatttatcaaatcttcatccaagactctttccactttgcaatgctctttcatgtgctgggctgattctgcagagatctctactgaagaggctgtaaaaggtgatatggaaaaaaacatcttcacagggtttataaaaagccaatatgactttgttgagtctcacaaacatagttgagtctcacaaacatattattgagcataaaaacatattgcataaaaatacaccctgataaatgctcttataaaattcgaatgcatatgaaacttagtaacattgcttagagatgcatacatatataataaaactctaacaaatactaaaggaatgctgatataaaattcagaatagttacttcagggagtgggatgtccctggagggatatagaggtggcgagaattattgctaatattctatttctcagaacacatggtagttatacacatttattacagtgtattttgtattttttatatattgtatcctcttctgatcgaatatttcaaaatataatttaagcaattaaaatgacatagttttcctttgcttctcatactgtgaagaacatgataaagctttaaaccataagatgggaagtgtaaaagaaaaattgcactgggccagttatacagacaaagaagacttcattcaagagtactgcataggagacagatttttacaatagagtagagagcttgtactcaaccccactaaaataaatgggagcaggaacatttttaaaggccaggtgagctaacagaaaagtaccagggggatgtttgggtgggtgggaatttggtcaatttcaataggccacctgtacttgctgtctcttactgaagttaggcttctactctcccaaagagactgggaaataggggcactatttgtctcgttccagggttacatttgttttgttttgtctttcattgttgttgtttttgctgttttgttttgttttgtttttgagacagggtcttgcactggtgcccaggctggagtgcaggggtatgatcacacatcactgcagcctcaacctcctgggttcaagcaatcctctcacctcagcccccggagtacaggattacatttttgaaggaatgactcccaggtccttgggaaacagcctgagagaagatttacatctcaaagagacagagaaataatttacaactacaagttttctaaagtaaatgctctacgaaaagggagatcaggccctatagtcaggaagaagtctgtctaaagcctagtcaaactgagaaaaacattaaggctgtgttggtcaaagacaacaaacaaggatagaaaataaattagtcaagattcattacaagaaacagaaatcactctagttatttaagcaaaacggacctgaataatggaattagatgcttacaaaattatcagaaggaaggaaagctgtaggagtaacaccaagaaccacaggtatgactttctggaagatgtcccctcagtcaggatcaggaagatgagaaatataaaagcactcttaggatttttgagttcaagagcccattgtgctaatccaaggaaggttgaccaccaggcagctgccgtttcaatgcacctacgcactgaaatagtgactctacagtgagatctgctgcaaagatccacatagctccatgacttttttttaccagaagaatctgctaagacacccagaaatggtctccatcagagccttcagattttaggtatgtttcttactggtggaactcaattatatttgcaactccagttttgaaggattctggaagttgtagttttcaatactcttgcctctgcagtacaggaaaccacactacatgggagtggatactgagtgtcaatcatacccattagtatgaagaaacacgtaagatgaataggtgcttattctggtgtgggacaaggtaatgggtaagaaatgagaccagaataagaaaacataaatcaggcaaataaatatttattggattttttaatgttcagaaatgaaatatattttcttttgaatcttatgtaggttttatgttcattcttaataaggtaaccaaatattcagaaaatagtttggtaactgaaaacaaaaaccaaaaattgtcattagcaatctaggaaaagtaatcaaattattatggtgttaaactaatagtattaacctaatgtctgacacataatataaagtaagtaagtgcataaggaataaatgatttaaaataattgtggtgcaaaataaagacaactttaggtgacacattgcaataaaattggagtaaatttttactaatttttttttaaagacaatcttgctctgtcacccaggctggagtgtagtggcatgatcacagttcactgcaaccttaaactcctgggctcaagggagccaacccacccagcctaaaactagagtgatcttaagttgaagactaaaccaaatctttaaatacattgatatattcagctagaaatattgaccagttttaatattaccattctataacataagttataatactttgagtttatgaatgaaaataaatgtcactacttctaagatttatatattttattttcatttcattttccctctctgcccatagtgatttctatctgatgttatgaatataaaataaaaataaacctaaacctaaaataattttgtctaactagttaatacattatttagtaattggataacataaaattattttctcttcttagtctaactctagaatatgtaaaaaaattttacatgtacaccctcatgaaaatacaatagtatacactcttttatctcataataaggatttctttacttttcatggatcttgatttaaaaaaagattattctgtatctcttttgttctaaatgcagccacctcatcatcgacaataattgtggctactggtggcagatattatctatgtttgtttctctgttttcttgccccaaggatagtgcagcatttctgctacaaaatgaacaatactactttaagggcaaaacatgcatttgaagtttgcatcaccagcaatataacaccattgcacccctgctgggtataaaaagtatctgggcacagtgactgtcccagggattgagaacaactctgagtgaatttgtggtacacaaactgttccctatcactttcaatttgctcttcatgggatagctctgatcacttactgggtgttctacattgttagataacactatacatggtactatttcggctaaaaacacactaagtgtgtttctatttctataaaaaacatctgaatacctatattgatacttcattggaaatgagctcaaaaacccatttaattccctatataggtacaggatgaactctgtgattaggactgtcctaaatgatgttcaggatgtttcttgcacaaagaattcatgcaaagaggatgagtgaggtctgaaatctaacctgagctccacttgtcaagtcttataccttgttggcttggaggaagtggcatatttatataatttttctgcctagagatggtggagggctttatgcttaccatggccctgtcatgactggacaacattggccatcataaatgaattgtactttttcaatatgtgctgaacactccccaaggactgattatgatacaaactctctactaggatttggtgatacaaaaataaacaacatttacaatgtcttctaacccacttatatccaggttaaatttcagtgtgttttgcagactgtctggtggggaaaacagtatttagtttttcaaactgtgctctgttcagaatgttgcaggattcacacagctctgtttgtactaaaatgaagagggaagggagaaaagagataaaaccttttggcatagaggtggagttacccaggatgacaaccatggagttgttgttagataaagacaagagtattttgataattagcaacataatatgaatgtaagaaagatttccacaactgaagaaaatggcaatgatttatagtgtttagccaatttaaagacagaggaatacttgtgtagttttctacctggagctgtgtaagataagataatggcatgactgagatcaaagcctaggaaaaaattttcaaaattatttgaggctttttaaaaatcaatgacagagaagtggacatgtgtaaatgaaatgaatcagtctttgtgtttttctatggcatttaggagaaagcaaattgctgtgaattactcagaagagtgaaaagttttatatttttctaatggaatcttttaaagagaaaaacagattgggtaggagacttcctgagaattctcacagtgtttagaattgctaacatctagactaagctgaaccacactgattgattttattggggaaggcctttgttttttaatgattggtcaattcaattttttactgtagtaagcacatttaacatgagctctcaccatttaacacgtttaactgtgtaatacattactattaactataggcatgatattgtacagatctctagaatgtattcatcttgcatgactgaaactttatgaggagtttctcttcaccaagataacattttgggggaatatgagaaatgatgaatgcacaagtgtcagtgcagacttcttaggtgtgaatcttagctttgccactaacatgttgtgggacattacccagtggttctgggactctgtttccttattagaaaaattaggtaaaatgagatgcccttttctcgatgctatgaaaacttaattagttaatacatctaaaataacatggtgtctatgcagtaatactgatattattattattttctaagcacatacatgccaaagaactcacacatttgatcttcgaaatataaaattcatatacacgagacagaggtgctgaaaaaaggtagaattttcaataaaaattatagagaaaaattagtattctatcaaaatcagttccttttgggggtaaagagttaattacaaagggacagcatgagaaaattttggaggatggtggttaattgccttactgtgagggtggttacacaactttatgcatttaccaaagctataaaattgtacacaagagagttaattttactgtgggaataaaaataccctgaaaccgtggcaaactatgcccattaagaaaatgagaaagggatgaagagtaatctgcaggagcaagattattccttaaataactttaaagggaggatggattggcatgattaagagctatggctggagcagagacaggagtgttggggacgtgtcaatagcattttccaaaaatttgactttttcatttgtcacttagttttcactcccatgactaagttgtgaagagtgtaagtaactctaaagtcaaaggtatcagcagattttgaataacgcctagcaatacaggtggtatcattttgagatcttctgcttcccaatagtgatctgaaaagcagcctgaacaattcaacagcttaaaaatgtcctcatgcttacaagtgaatccagagtagtggaatcaacctacagcaacaaaactaatctagcacctgtaagatgtttattaacatgaaacagaaaatgaatctagtagttacaagatacctattgttatgataaacaaaatttatatgggtattttacttaactgtttctgtagaatttattgtttatgctagctaccatagagtatgaagtgtttgtgggcacaataaagatattttttgcttgaaagaggcaaaatgtttgaaatggtattcatttcttatataagaaaactgtaattttattctacttatgttacctgcaagagttcccattttatgtacggctggctatttcaaaagggaagtacaaagttctccagatgttctacgtgaccaaataaaacctagtactagtaatgaatgttcaaaaaacagagtaggtctctgagtgatgtttaacttctaaatagtatgtgggtgacactcagttgataggtattcactagtttgtatgacttcacataaatcatattagtcctaatactctcatggctattatttccgtggtgggcccaataaccagaagcccagaaccctagggtttccataggctttctgaagtcttctgtgaggtaggtaaatagggactattttttttctaagagatcaagtcctgctatgtttcccaagctggagttcagtggctatccacagatacaatcaaagcatgtatcagcctccatctcctgggctcaagtaatcctctcgcctcaatatagttggaactataggcatgctactatcatgactggctcaataactttttttaagtgaccagaaatatcccctacatatattcctgagaaattactgctgctcaaggaaatttaggcattgaacatccgttttgggttaactgaatgttgaaaataagatgagtggcagaagatgtaggaaaagagcaaaaatctgaagttagagaactaaagaaaaaagaaggaaaaaaatgcatgatcaacaatcacttatatcaatatagacctaaaaggaatatgatcaaaggtagagatggccaaaaagaccaatttttaatgagcagttttcttaatccattcaagactgctataacaaaaataccataaactggatagcttacagaaaacagaaatttatttctcacagttctggaagctgcagggtacaagaacaagttgatgacagatcctgtgtctgtggagagcctgcttcttggttcttagatgttgccttctggctgtgtcctcacattgtggaagggccagctagctctctagggtctactttataaaagtgctaatcccattcgcaagggctttactctcatgacctaatcatcttccaaagtcccacctcttaatactatactatcgtattgttgattagggttcaacacatgaatttcagggagacacaaatatttagacaatagcagcaattattccttgaagaaaacaagtttattcagctcgtccatctctgtgctgacaattgtgggaagaaataataatgtcaatactaataagagctaacattgataaagtacttgctgtgtgccaggcataattgatacaaagatcagaagtatgaggcttacatatgtttagaaaatccatcaataaggtattacactctaaacattaagatttcctgatgaaagcctaagtgcttgctttctagtatcatacaacattcatttcatgtttttaaagaatgatcattgcttaaaacttgattagtagtcaacaatagtattggtggagtggattgtcaaaattgtattatacatacatgtccatatacatttacataaacgtatatattattatatatgcagtatgcttattatttttaaaataattacctggttggcatttgcaaacatatccattgatgtgatcttcacagtctgcaccatgtagacatggtgatgaagagcattcatttatattaatttcacaaaattgaccagaaaatccaggaagacatctaaggaaaaaaaatgaaaacgatatttgtatatattatacacatgagcactatcacttttcatcttgggattccatcattcaaacgtgttttcagagctccaacaacatgtagctgggagccttccttggggtgacaatgagttgaattgtggccccaaaacagtatgtctaatacttaacactaaatatctgtgaatgtgaatttatttggaaatagagtctctgcagatttaattaagtatcttgagatgaggtcattctggattaactcggtgggctctaaatccagtgacaagtgttcttacaagcacagaagacagagacccacaggggagaaggccacgtgaacatgcacataaagattaacattatgcagccctaagtcaaggaacacccagagcctctagaagctggaagaggaaagataagattttttcctagagttttcagagggaacatggccttgctgacactttagttggacttctggtctccacaactatgaacaaataaatttctgttatcttaagctaacgagtttgtggtaatttattatgtcattcctaggaaactaatacagagattatgttattgcatgtatctgcttaaatccaagtgaactgtttgaaaagaaataaaacagaggtctctgggagactcttaaaatggagaaattgggggcatgtcatgaaaggtatgctccataattggaagaatagatatggaaagagtcaataggtcagagactattgtacttcctcttaatttttagggacgctttaataaaaaccatttagatgtcagctgttaaaccatgcttcaagaactgatggaggatccacaatattgattaaagtgcaatgtccatagctatagatacagatttgtcgagtgcctacaacatgcaggtattttatgaatgctaagaatacaaacgtaagtaaaactctgtgtctgccttcaagaagcactgagcccagttgggaaaatagacaagtagccgacacaattatatgataaatgctataatcagcatatagataaatgtatttttatcatggcagagtatacgcaagggcaagaataagaaaagagtgtgagttaatccagaaattgcaagtagttttgaaggctgaaatataatgtgggagagcacagtctggggtgatgctgatgaaaaaggataaattaaataaatagaaattagatcattatacagtattggatcataagttttaccacatatttactgaaaacttattcacaatatataactttaccaaagtcacaagacaagcaaatttgcaaaagtagaatttattggtctgtacttatcagctagccaaatttagccactgtgctttacttgcatacacagttacttaggtgatacaaaaattaagttctgtttttcactgcaactgggtctgcccggctgaagctaggtaacgatgaattttagaccgtccagaatgttagtaactccactgtgctagatccttacctagctgaagactttcttgaccaacaaacaataagacttgctttagggccgggggcggtggctcacgcctgtaatcccagcattttgggagaccgaggcgggtggatcatgaggtcaggagatcgagaccatcctggcgaacacggtgaaacccaatctctactaaaaaatacaaaaaattagccgggcgtggtggcgggcttctgtagtcccagctactcaggaggctgaggcaggagaatggcgtgaaccagggaggcggagcttgcagtgagcccagatcacgccactgcactccagcccgggcgacagtgcgagactccgtctcaaaaacaaaaacaaacaaacaaacaaacaaacaaagacttgttttaactgtgtgtggatttatggatggtctgattttgtactgtgaagatgacatcttcagtattgaattcccactgccacagtcaacctccccatctttgtagcaaaaagaaacccatagcagtgttttttttttttttgagaggaattcatcactagtggtttactcttatatgcaaaataaacttctatgcaaaataaactcaggtctgattttgtcaataatcgaagtgttcattgtctttccttgaatatcataaattgttcttcaaaaatgcattatcaatatatttattttatttatttttgagacaggttctttctctgctacccaggctggagtgcaatgcagtggcccgattatagctcactgtaatataaaactcaaagtaatcctcacacctcagcctcccacataggactacaggtggtgtgcaccatcacacctgcctaatttttgtgtgttcattatataaaatggacattttctctgtgtccattacacaaaatgggtcatgctatgttgcccagtcacattatcaatttatattcttggcagagttatctaaaatgtccatttgtctgcgttcttacctatgaacaatattaacatttattttaattttcattgcaaaggaaaaaaactacttacctaataaagattttttaaaggggatagtttaaaaaatttttaatataatttgtattttgcgataattttaaggataacaaaaaagttgcaagggtagcacagaatgttctcatagactatgtatccagtttcctttattgttaacatcgtacattcacatggtatgtttgtcacaactagtgacacaatattactacattattattaactgaagtctatgtattattgcagtttctttagcttttatctaatgtcttttgtttctgttcaagaatcctattcagaataccacattccatttagttgcatatctccttaggctcctttagactgtaatattttctcatacttccttgtttttgatgacttcgactgttttgaagggcattggtcaagtattttgtaaactatacctcaatttaggtttaatattattcccatggttacactggtgttatatgtttctgagagaaagacatcatagaaaaggctctcatcacattatattaacattactctttagagggaagttgctttgcacatcccacgcttaagagatgagaagtcatgcacacctctttaaaggagaagtgcctatataaataatttgaaataatttctttatatatatttttaaaatcttttctggaattttgagtgaaatggctttgaatctataaaagtcaagttgtaagaaacaatatcttaacaatactgagtttttcaatttatgttaagaaatatgtctccagtgacacatatctttgatttctttcaccgatattttatagttttctacacagagatattataaatattttattagatttatacctaaatgcttcatttttgtttactgttctaagtggtatatttgttttgttttgtgtttcttctttccgatattccagtgttcattactagaaagcaattgacttcagtatgatgatcttatatcctgcaaaccttgttacactagcttattaggtccaagagcttttttcaaaaatagtagagggttttctatagagaaaattatcttctacaaagataatgattgcatctgtagataaagaccgttctgtttcttcctgttcaatctacataccttttatttcttttccctgtcttattgcactcagtaggacttctagtaggatattaaatagcagtgttgtgagaggaaatgtttgcctgtatcaaatctgaaggagaaagggtttagttttcatcattaagaatgatgttagctataagtttttaaaatgtagcctttattaggttaaggagtttaccttttattctgagattttttttgttttttgtttttatttttgtttttgagatggagtctctctctgttgccaggctggagtgcagtggcacgatctcggctcactgcaaactccgccacccaggttcaagtgattcccctccctcagcttcccgagtagctgggactagaggcacacaccaccacgcccagctattttattttgtatttttaatagagacgggatttcaccatgttggccaggatggtctcgatctcctgacctcgtgatccacctgcctcggactcccaaagtgctgggattacaggcataagccaccacacctggcctattcttagtgtttttgacagtttttatgagtggaaattaagttttgtcaagtgatttttgtgcatccattaagatcattatatggttttacttattcatctgttgatatataatcatattgattaaatgatacatgatatgataatgattgatacagtcatgtgtatttttcttgatcaagtgttaaaatagtgaactatactgaatgttttatgaatgctaaggtttgctttcctggaatgaactccacttgctaatttcagagtgtgttaatgcagtcatcttcttgttatttgcaaagggcccatgatttcaattttaaacttttaatgttaaacttttactctttgttccttcaaggttatgtgatgtttacattcttagcttgaatggaggaaagattttgaaaacacttataaaatagaagtgcataacaatttataaccccatgtttcacaaaaatatttacacaatgatctgtaaaaatttataacatggggaaattgtgctacttatattggtattataagcagttttatcccatacgtatttattcactttataagcattttaatagaatgtctgacggattgaaattacttacccaacttgtttatacaaaaggatttactaaaaactgttaaacactactacataatgacactgtcacaccaggcttttaacataagaattgctctgcaatactaggagaaggggcataaaagacaagttgattttgcagcatagcaactaaaaatataacaatgaaagcaactgttaaaaatgagaactcagaacttaacattagagggacccaacatcatgcctccatttagctaattgatacaaaagagttagtttaactgctattaacaggtgacaggagccactctcaaatgattcttcaaattggaaagtactgtcttacaacctgttgttgcagataagaagtaaatgaaatcattttgtatggtttgcagctgtttggataaccacctggcctagatactttcccataatcattctgctagttaccacttattacccaagaccttcctgaaaatcctcctttaggccctcactattgttgctgatactgttcctttgatacagctgcttttatttcacatttattaagcccatcatagtagtatttattttccattattttcttcacttgtttctgttcgttaacgataatgcagagcccatgtctccttgttggtcttttccatgggagttttatagattttaccactccaaaaacagcacttggttcatttattaagataaattatgaggcacataacaaagcaattctccagaattgctttatttgtttattaacaaatgtgtctggtatcatacaaccgaagtaagaaagaataagaagggtacaaaaactgaattttcatcccccacaatctattctattcagaaacctttttttattttttgagatggataatattttaatttaaatgagacttaattcaagttacatacattcactaaattcttatttgcctttgaaatatttacattaaaaaacaattaaatttatattctatttatattacatttataatttctaatatcccatttgctgggctttgataatataattgataggatgtagtttaataattgtcaaggaaggaacgatgttatgactttttatatctgcaaagcatcaactttaaaatattaactctaaatgctcagaagctgagtgtttatttataaacttcactgaagccaagatttctcaagttagaatagttgaaaagtatcagatatgtaaatgacttcatacaatttcagaatcaccacagttcttttccgtgatttatcttcttttttaataattagtgaccacaactacatataacttattttcttaagatatgcaaaaaattaaagtatatatctctgtgaatagtactctattagtaactgatcatacttaatcatgaataggaagcctccagttagaaatctacacacctcggatattacttctgcttaattttatttacctgtgctgtagccaaaaattttgacggtttggaatttttgccttgtttttacataagaaactatagttctgaggaataaccataaaccaaaccaaaccaaaccattttacacttcacttacccctgtgtcctgacctcttctctgtcctggatgatataccagaatatctaactggattcatccttcagatgaatggccatgggcttacaaatttgacatattttcttttttaaaatgttatttttatagatgatattgtaaacttctatgtttctgggaaacacaataggagcatcaggttgataagtaggggatattcagtgaataggcaaagccaatgatctgagcagaatggtcttgattatgagttcaatattatactgcttctcatttcagtatttttattactattcaattgatcacattatatgctctaaatttttaaaaatacaggtattttaaactcatttcattgctttgttgcagagactgtgatagattggaatctaattattaaatgtattttcaaatgtgtaatttaattttattatagtcaaactgcataaagcataatccaaactgaattataaaataagtaattttagtgttgtttatattatgtatcttgaaggtcattttaatttaacatttttacttttatcctgagtaattctattgtcactatcaattatgcatacagattaagaggagttattcttagcaattattgtaacataaaccaaagtttcctgaaaccactttaaaaactagaatattgtctaaataactgttgaaattgtatgtagacatatacaaagatttaggtaaaaaggacattaactacacctgtctccgtagttatgaatgaatgaaactcaaagtagttcctttttatagatgatattatttcgtatcactttttagtaaaacattgctttatatattgatattgacagtatttaaacttcattaatttgaaatgatccatatgcagaaattaagacagagctgggtgcaggttgtttatttagaaggtgatccaagtaagcagaaatgaaggagtggaaagaacaaaacagggaaaaataaaagttaaataagaatgcattatttagcagtttgtcacattgagcaactgggactcagtctgactgcagtagttttcacattctttcatacttttctcagcaaaaaaaaaaaaaaaaaatggagcctaagcccccttttaacccccatcattggaaagttggcttcctcctactctgtttggatctcttgtgcaggcaagctagacagtctatcataaagaaactcatgtatcactataaagaggcccatgtggaaaagaactggagccttgaccaatagccacataagtaaatatagaaggggatctttcaaccccatgtgggtctttatatgattgtaatccagctcgcatcttgagtgcaacctcctgaaatatactaagccagcaccacccagacaagctgctcttaaattcttgactcacagaaatggtgagatgacaaatgcttgtgtttgtttctttgtttgtttgtttgagatagagtcgtgctctgacatccaggctggagagcagtggtgtgatctcaactcacttcaacctccgcctcccgagttcaagcaattctcctgcctcagcctcccaagtagctgggactacaggtgtgcgccaccaagcccagctaatttttgtatttttagtaaacacagggtttacccatgttggccagcatgatctcgatctcttcacctcgtgatccgcctgccttggcctcccaaagtgttgggattacaggcgtgagccaccacacctggcctaaatgcttgttgtttaaacaacagaattttgagggtagattgttatatgcaatacataattatgtacaaaatgaggactaattgaaaaatctgtaaagaagacaaatcagaaactacctcagaaccactgatgaacaaagcaattattcactgattcttattccctactagccatggatagctcataggctaatacgggcaaacttctgggctgatttatgagtggctatcttgtgcgtatactcagtaagataccctagcttccaaaaaaaaaaaaaaagagccctaaggcacaaaagtacaaaatattgaagtgtggtatagtcaatatacttgggaactgtccagcacagctgggatgagatgaaaagcattaaaaacaactgctccacatgccatgtgaggatccccaacctatttcatatgtcaaaaaacatctaagaaaaaatgaagaagggaatttaataaattcaaactacactgagaactttggttaagataatttttctcttctatattccacttttaagaacattcaatataaaagaaattagatttttattaaggggactatttttaagagataacaagcatgatggggatggcattgaatctgtaaattaccttgggcagtatggccattttcacgatattggttcttcctacccatgagcatggaatgttcttccatttgtttgtatcctcttttatttcattgagcagtggtttgtagttctccttgaagaggtccttcacatcccttgtaagttggattcctaggtattttattctctttgtagcaattgtgaatgggagttcactcatgatttggctctctgtttgtctgttactggtgtataagaatgctggtgatttttgcacatggatgttgtatcctgagactttgctgaagttgcctatcagcttgaggagattttgggctgagacgatggggttttccagatacacaatcatgtcatctgcaacagggacaatttgacttcctcttttcctaattgaataccctttatttccttctcccgcctgattgccctggccagaacttccaacactatgttgaataggagtggtgagagagggcatccctgtcttgtgccggttttcaaagggaatgcttccagtttttgcccattcagtatgatactggctgtgggtttgtcatagatagctcttattattttgagatatgtcccatcaatacctaatttattgagagtttttagcatgaagtagttgttgaattttgtcaaaggccttctctgcatctattgagattatcatgtggtatttgtctttggttctgtttatatgctggattacatttattgatttgcgtatattgaaccagccttgcatcccagggatgaagcccacttgatcatggtggataagtgttttgatgtgctgctggattcggtttgccagtattttattgaggattttgcatcaatgttcatcaaggatattggtcaaaaattctcttttttggttgtgtctctgccaggctttggtatcaggatgatgctggcttcataaaatgagttagggaggattcccgctttttctatttattggaatagtttcagaaggaatggtaccagctcctccttgtacctctggtagaatctggatgtgaatccatctggtcctggactttttttggttggtaagctattgattattgccacaattttggagcctgttattggtctattcagagattcaacttcaatcccatccccatcaagctatcaatgactttattcacagaattggaagaaattactttaaagttcatatggaaccaaaaaagagcctgcatcaccaagtcaatcctaagccaaaagaacaaagccagaagcatcacgctacctgacttcaaactatactacaaggctacagtaaccaaaacagcatggtactagtaccaaaacagagatatagataaatggaacagaacagagccctcagaaataatgccacatatctacaaccatctgatctttgacaaatctgacaaaaacaagaaatgaggaaagcgttccctatttaacaaatggtgctgggaaaactggctagccatatgtagaaagctgaaactggatcccgtccttacatcttatacaaaaattaattcaagatggattaaagacttacatgttagacctgaaaccataaaaaccctagaagaaaacctaggcaataccattcagaacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacagaatgggagaaaattttgcaacctactcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaatgacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacacgtatgtttattgcggcactattcacaatagcaaagacttggaaccaacccaaatgtccaacaatgatagactggattgagaaaatgtggcatatatacaccatggaatactatgcagccataaaaaatgaagagttcatgtcctttgtagggacatggatgaaactggaaaccataattctcagcaaactatcgcaaggacaaaaaaacaaacaccacatgttctcactcatagatgggaatcgaacaatgagaacacatggacacaggaaggggaacatcacactctggggactgttgtggggtgtggggaggggggagggacagcattaggagatatacctaatgttaaatgacgagttaatgggtgcagcacaccaacatggcacatgtatacatatgtaactaacctgcacattgtgcacatgaaccctaaaacttaaagtataataataacaaaattaaaaaaaagagataacaagcaaatggccagaaccaacctggacaatgaaacttacctcaatctatcaccacgtctacattactctacagtgatcagaaatctcttctcaaggcaaaattctcaattattattgtcagtgtggggagggagctgggagagggagagcatcaggaagaatagctggtggatgctggtcttaatacctaggtcatgggttgatctgtgtagcaaaccaccatgacacacgtttacctttgtaacaaacctgcatgtgtaccacacataaaataaaagtttatggtaaaaaagaaaaaagaaatttttttgttctttttttacagtagcatgctatttctagatcaccttttaaaaaaaagagaatgaatacaactccaccaggcaccctgatggaccaaacccaacacaattcaaatatactgaacttaaggatacactgagcatttcagagcaacccactgtcctgaactgacagttcaaaaatgtataggagtgcattctgagaatacaactatatgatattttaaaaattctttattttatgaaaaaacaattttaaacacaggcagactactttgaactttggatataaatgttgggaagaatgtaggaccttctgaggcagggacagaactaaactttaaacagaactagcttattcctgaaagtgtttagttataggtagatacattgttcctttctaaagaagctatgactagactctctattaaatctaaaatagtgagaatatgaattgtatttacaatagaatacagaaattaataaattaaatgattattaaaatacacgcataatgttgtaatgataattattaagagctgtgaattgtcattcatctagttacctccacaacataaagctcctgtcttagttcagtccatctttcattttcttttaatttttaacatgtgtctttttcattatttgggagagttctagaatgagcaagacatcttgcctgtgttctttttagactatcttcaccctgagacaacaaaatcctccctgacacatctatctcatatatactttgtagtggggggtttaaagccatggcctcaaaatattcaagtgcagtcattttcaagcaattttctctgactatcttttcctctgggttttttgagggtgttaagaacatggtgctgatgtttctacttccctaccaaatgctgttctaatgttaccagttaccaacatattcaagccactcattttgtctttaaccacttgatgtgtttaacagttccttggttgctttagtaaattctttccttgtttacctccctgccccctctagtagattttcagggttgccataagaaagcaccacagataagtggcttgaacaacagaaattcattttctcacagttctggaggccagatgtccaaaatccatgtgtgggcaggatgacaggattggtatcctctgaagccgtctccttgacttgtgagagactgtctcctccttgtgtctttgcatggtcttccctccatgcatgtttgtgtccccatttcctcttttttataaggacaccagccatgttagattgaggcccaccttcatgacctcattttacctaacttaccttaattacctctttaagagacctgtctccagtcacaaccttaaagcaggtcttggaaaattacaaaatcaattttcagaaacttcatgaacatttatgttttcaagcatgagtattatatgtaaatatacatctcttttttcatcaatttgtggcttttaaaatcatgctcagttataagcattatacaaatttttcccatttcttaatatacaaaccttgaaacattctataaattaaaaagcgttttgcagcttttagtgaaaaggcattgcatgggaggcccttatgctaaagattaaaattccttacaccttatacaaaaattaattcaaggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctcattaaactaaagagcttctgcacaggaaaggaaactaccatcagagtgaacaggcaacctacagaatgggagaaaattttcgcaacctgttcatctgacaaagggctaatatccagaatctacaatgaactcaaacaaattgacaagaaaaagacaaacaaccccatcaaaaagtgggcaaaggatatgaacagacacttctcaaaagaagacatttatgcagccaaaagacacatgaaaaaatgctcatcatcactggccatcagagaaatgcaaatcgaaaccacaatgagataccatctcacaccagttagaatggcaatcattaaaaagtcaggaaacaacaggtgctagagaggatatggagaaataggaacacttcttttacactgttggtgggactgtaaactagttcaaccattgtggaagtcagtgtggcgattcctcagggatctagaactggaaataccatttgacccagccatcccattactgggtatatacccaaaggactctaaatcatgctgctataaagacacatgcacatgtatgtttattgcggcactattcacaatagcaaagacttggaaccaacccaaatgtccaacaatgatagactggattaagaaaatgtggcacatatacaccatggaatactatatacagccataaaaatgatgagttcatgtcctttgtagagacatggatgaaattggaaatatcattctcagtaaactatcgcaaggacaagaaaccaaacaccacatgttctcactcatagatgggaatcgaacaatgagaacacatggacacaggaagggggtcatcacactctggggactgttgtggggtggggggagtggggagggatagcattaggatatatacctgatgctaaatgacgagttaatgggtgcagcacacaagcatggcacatgtatacatatgtaactaacctgcacattgtgcacatgtaccctaaaacttaaagtataataataaaaaaataaaaagattaaaattcatgcaaagtattaaataaaaacattcttaagcttcatgatgaaaacaaaacaaaaatagctttgtattcttttctcgttctttgtaaccactaaacacatttagtgtctcattttggataaatgccattggaacacgaagctcagaatctaaggtcagctgccctattcaagaggcttaggacttctggatcctctcattcattaacgacatgacatttctactttatacaaaatattcagttgaaattaaattctccctaaccaggtagggcaggcagaatttgtttttaactccaaagctatatcttcacaatagaactacttggtattagtccattttcattctgttgataatgacatacccaagactgggcaatttacaaaagaaacaggtttaattggacttacagttccatgtggctagggtagcctcacaatcatagcagaaggcaaggaggagcaagtcccttcttgcacagatggcagcaggcaaagagagagtttgtacagggaaactccccttttgaaaatcatcaaatcttgagagactcattcactatcaccagaatagtgcaggaaagaacctccaccataattcaattgcctcccaccaggtgcctcctacaacatgtgggaaatcaagatgagatttgggtgtggacacagccaaaccatatcatgcttataatagtttgccaactttacatggtacagattgcatggtacagtaagaagaccaaatcaatgaatgggttccatgcatcaaaatagcatcagaagggaatctcttgctctctttctctctctctttcacagagacattgtggttgggggtgaatttcactttgagataaaaactgatttcactaacagtttccctttcatacttaaaaaactttactgtgtaaggcagaggtctccaacacccaggctggggactggtacaggtccatggcctgttaggaactgggctgcacagcaggaggtgagcggtgggtaagggagcgttacctcctgagctctgtctcctgtcgcaccagcagccacactgaattctcataggagcgtgaaccctattgtgaacctcatatgcaggggaattatgttgtgtactccttatgtgaatctaatgcctgatgatctgaggtagaacagttttatccccacacaactactccttcctcccatatgtgaaaaaattttcttccaaaaaaccagtccctggtgccaaaaaggttggggactgctggtgtaaggatgagatagctgttactaccactgtgtccacaaaaagaacaatgtagttagactggaaataacatgaagacagaaagattctggctccttgatggcatcatcaagctgctgaaagaaatctggaatcaccaactcttaagtttctgattttggggaaaaaaattaatctgtattgtttgtccattagtcagtttgttgttctggtggttacttaaagttaaaagcatcttgaattataacatttttgttttaaatttcattcgtaatttatctttatatttaacattcatcttaataaacttttttaataattaccagttttcagaacacatagaaatatgatatttgaaaaattatggtagctgagatttaatgtgccattatatattatgctctgtatttctccatggttatatacacatattttcctatacttacaatcgatatattcttttcttcccctagcttataaggttatcctactgtgagtgaagatgagagatatgacatagccctttctgtgctgtgctcttgtctccatatcattttgtccacattatttatttcaacatatataattttcctcttctttggagaaatcataaatgaaatgcttcctgtgaggaaaacttacattcaatttttgagtagccagggttcctgccagagagataacacttgtccagctaatgcattactaaaaagcaaacaaacaacaacaacaaaacctatgtatctattcttttcattctctctaaaacccttctctacattgagaggatagaagaaatgtgctgtgcaccccttcctttattaatagatagtactgggccaggtgcggtggctcacgcctgtaatcccagcactttgggaggctgaggcggacagatgacctgaggtcaggagttcgagaccagcatgaccaacatggagaaaccccgtctctactagaagtacaaaattagctgggcgtggtggcacatgcctctaatcccagctacttgaggggctgaggcaggagaatcacttgaacctgggaggcagagattgtggtgagccgagatcatgccattgcactccagcctgggcaacaagagtgaaactccatccccccccccaaaaaaaaacaacactgaagaaaagacgacttttcaactcctcttagttggtccaaatgcacccacttcctttcttagggagagaagacatgtgcttttatccatagagtgtataattggcatctaaatttagatatcaggtcagtgcaaaagtaattgtggttttgtcatcactttaatggcaaaactgcaattaattttacaccaacccaatactttggaggtttaaagtaagtcttactgttaattgtcctgggccaaaaacatgaataaacaaaaagaatttcagacaaagtggtatgtatggtcatcctacccataaaaggtctatgctctttggatgcttggcatcttttcctctaaggaaatcccacgtggtcctgggcagagttgggggtgagagtaggtgtagggaagtgtgtggtgttaacaatgatttcccaccacatatcccctgatacggtttggctgtgtccccacccaaatctcatcttgaattgtaacttccacaattcacacatgtcatgggagggacccaggggctggttactgaattatgggtgtgggtctttctcctgctttctcatgatagtgaataagtctcattagatatgatagttttataagggagagtttccttgcacaagctctttctttgcctgctgccatccacgtaagacgtgacttgctcctccttgccttccaggatgattgtgtggcctctccagccatgtggaactataagtccattaaacctctttcttttgtaaattgctcagtcttgggtaggtctttatcagcagcgtgagagtggactaacacattctgtaaggcactgaagtgatccaagctgtttaatccaaaaagctagttaatatatttcctgtaattttgtttgctttggaagtgagaattttactcaagtggtatcaattaagttttcttatatgacctgatttttcttttgaattgtagcctaagatacagtgaaggttaccagctgcaattttccccaccatatgtatacagtctacctttcagtaaagtcattatatacaagggagcagagtcaaaagataaataatttctggacgagtcattcctggatccagctgtgcttgaaattagcatcataatggagcatcccagttttatgagccataaaaattctatatatgacttaattaggcagagttaatttttttacttgcagttgacagtattaaaatggcatttttgtcatcttaggatttaaaagaattgggatggagtgaagagggtaagaaccaagagtaagaggaattaagataggagattatttctattgtgaggctgatcatgatgagaatgtatgaattttttatattttaatgtgcaatatgcttttaggaatgcatattctctggagatataaactatattcataagaattattacaaagctaatacattctggagatttatacttatatttaaccattttaaatacactaatatccagagaagtagtagaacattatgatatgaaaagatgatgagcaaggaaattatatatgcatggaaaaatatgtttgcaaaccaattcctgatttcagcctacctgaattgatataaatgtatattttaatgcagttaaaataatggtctgggttctcttacactgcaattgctaactatagctcatgtcatattctcagggttagtgcaatcatttacctgtgccaggcagctctgaataaaaaagatgtacatttactggatgggagaaatttctatatgagcctacaggatgcagcatcagcatgtcagcttcctgaactcttttattagtagttattttctgtgtaaaattttattgttttttaaatctctaatcacatttagtgagtaaacaactagaaataatcacttaccaattcattcatcagaatattattttacatcaactagcctttaagaagtagctaaatttctttggaaaactaaatactgtttaccatttctctttgccaccagactaatagaaagttttaggtatatctcactgctaaaacccaggctgaacactaagcaattgggagattgaaatgaacacatcattatccgagcaatgaaacattgaaaatcagacactggagcagtctcgtgtttgaatcaacaaataaaacagaagcattaagatttcaataaggtgcttaaacaacttaaagcagaacgattttagacaaatcacaatattgaatcctctctgggaacatcagtcctgtatgtaatcatggatctgaaattgacttcatgggaaattcaccagaagaccattttctaatttaacagaaaccaagaaacagcagtatgaaatagtaaaggtgtggaatattaagagtcagagttttaaagttcttgacatcagacggcgtggagatgagtaagatcactgagaattagatatgtgaccttggtaaatgacagatgcttttcatctataaatatccacaagctttttcatctgtaatatttggattacattagaaccaaaatcgtaggtctttttaaagatgaatgtaaataataagtgtaataataaatgaaaaaataaacttattagaatgctgtcagaaataaggctgcttaaatgctagtgattttttaattctctttttttagttctcttttattgctatgattgttgttactgaaaaattaaatttacattattaatagtgcaacaggcatattgttgagatgactaaggttaatctgtctccatttgcttaaatactctaaaagaaatacagcttgctattcttatcacaaaagtatatttttaaatcttttaatgtttctgctaaaatagaaaatgtgttaagatattagacagttacagttaacaagtttgaaatattaatattgaaaaactatactaggaagtaaaaatcatttggggatcctaaattctcagggtagctacacttcttgtgtaacagctatagaatctcagaaaaaagagaatcaagagaaaccggcaggggctacaaggcattttccaacccagtcgtggaagcatcacgtctgccctgttacttcagttgaggcatagagacatatatcgtatttataaccctaaaatctattttgagttgtggatgggctgtcaataaagaataacaaatatacataatcaactttggtaaaatgcttgagaaagggaaaaaatcaaaagtgaatcattcattggattcattatgaagatttcattgctctagacatatgattctgactcatataatggtaaaagagacatttaaccttcttttcccaaatattctcatattataagtacatgattgtctgctttcagatatttatgaagtttgagatatttataagaaaattctttataggcagggcgcggtgactcactcctgtaatcccagcactttgggaggctgaggcgggcagatcaagaggtcaggagatcaagaccatcctggctaacacggtgaaaccccgtctctactaaaaatacaaaaaaacattagccgggcgtggtggcgggcgcctgagtcccagctactcaggaggctgaggcaggagaatggcgtgaacccgggaggtggagcttgcagtaagctgagattgcgccactgcactccagctctggcgacagagcgagactccagctaaaagaaaaaaaaaaaaaaagaaaattcttcataaatgttgagttgcattattcctcatgagcataataatactattaacatgggatgaggtcttggagtgttacctagtttatacttctttgtgacagttatgacaaacatttgtaaggcattttaataaaggtgaagaaagagtagtgaatggaatgtcaaagatgatgccaataaagaggtaaagttgatttttttctaattttccaacttataaaagaaaccacttactgtgtaactgtgagacatattctacttcaagaagtaatatttacataatttaatactgaagtaactgtatgtccgaaaacatctcatataaaaatgtaaattacatcacttgaaaattcttcatatcatgcctatttttatgtaccaaattttagtaaagtacctcctgacaaaagaatttctaaacaaaaatgactacaaacaacagtaatactgagaaaggtcaaaattaatgcaaaaaaagaacatattctcacatgaaaggcagtttttaacacacacacacatattgagagagacagagctagctatactgaatttctagaagttatttaaactctacaagataaaattatcttaatacaggtaactttgttttggaattgttcattatgttcatgaagaatactcaacaactttataaactattaaataaacaaatagctatgtacagattttctatatgtataaatcactacaaaggaaagatgctttatggcactataccaatgattatcactttgtggcaagattatggctaatattttttatttgtgcaatcctttaaaaatattctgataatgaacatacattgtttctatagtcagaaaattacatgataaattatattaaaactcagttaaataaagaaaaaaaacgctagtattcttcaaactttttttctttaccagaggttttacttcaaacggcatttgttattctttattggcaaaattgttcaaccgactccttataggtaggaacctttttgcttatttaacctccagttggtgatcataagggtttatagaatgcatgagtgccttcatgaataaataaatggttttaaggaaaaaacatgcttccgtaagaaaaaatatctaatttcctgacatttgcctactaataattgatgtggtcatgccaatcgccctgtgaattacagggtaattataaccattgtatagccagttatgcttaaatggctgattaattaatcatgtattttgcatacaaatcttgtgttctctggatccagctaggtggtgtgttctctcatacactcatagccttatgatggctggcactgatgttatctcacctacctggtatttggactgaaaagactaaaaactaggggcagaaacagctgagctccttgccctccccctggtcttactagtttctctttgtcatggcctcgaggtaaccacactgcttgtgtgacaaccatagactcccagaaaaagaacatcaagaaaaactggcagaagctataagctgttttcctacctagccatgaaagcatcatttctactctattatttctgtctctattggttgaaatgatcataaaattctgtctgtgtttaagagagtgtcatagacataacttcttggtaagagaaatatcatataatttggaaatatggtctgaaaccactacaatctataggttaaagtacaacggcttaagggcacttaaaaaactgattgataataaattaacacagtacttctaagagtgcataatctgagtcaaatcatgtggaaatgtcagataaaccaaaattgaggcaaaattacaaggtaaacgatttataatcatcaaaaagtaaaggtcataaaagaaagatagactgataaaccgttcagaaggtacaactactaactataatttaggaatggattctggagggggaaaagtagaaatggagaaatagctaaaaataattttattgagataatttatgaaatttcagtaaagcttgtggattagcaaattgttttacatggagtttaatatcttaattgtgataatttaccaaggttatataattgaatattcataggaaatgctgaagtatttaggggtaaggctctgaatgtctgcacattttctctcatggttcaggaaaaacttgtaggcacttgtgtgtgtatgtgtatactttgcactaccttatatatacagaaagaaaggaaaatagaagaaatgatttagaagatctaacagttaagaattgatgagtccagatgaagagtatacaagcatttttttgctcttactgtaattttcctgttatgtttgaaattataacaaaatttaatgaaaaaagacactttaccatcataaaacttttccagcaacacactcaacattccagatttgccactatttaattttgaattataagcatatttgttaaatccatacttgtaactttaataatatgcttacatataatattaggactccatatatttctataactgccttttttttttgagatgtagtcttgctctgtcacccaggctggggtgcagtgccacgatctcagctcactgcaacctccgccttccagggttcaagcgattctcctgcccctcagcctcctgagtagctgggactacaggcacctgccactacacctggctagtagtagaaactttagtagagatggggtttcacaatgttggtcaggatggtcttcaactcctaacctcatgttctgcctgcctcagcctcccaaagtgctaggattacaggtgtgagccaccacgcccagccaactgctttctttttatagaaatcataattgcttctcatttttgtttgctttgttttctattttaccatcactaatttatctgacaaatatctcaaagacatgacaaatcaatgtccaagagaaaaatttgagtatctttctttcagaaagtgatggaacagtgaacaaaaaattaggatttttaatgtttataatacattattaagaaatttgatctcataaatatatatctagaaccatggcccaaggaaatagaatatattttgtgagggtaccatggactactcacagaaattaaccagtttttaagcctcaaagaaattttaataattcccccaaaccagaaatcatcatttagaacaaattttaaaatccaaatttaatataatttgatatctaacaaaatttcacagctaacagaaatattttcattgggaattttagaaaatactgttaagaagttaatgagttaaagagaaaatataaatttaaatgataatctagatatatagccatgcaaatactacatagcaaaaactctggtttaatcaaacattctcagagaaaattcaaagtttttaatgcatctataagaaaatattaaaaattaagtaaactaaatctttaagtagctacaaaatgaataaaataagaattaaaattatattaataaaagtggtaacacattaatttaacattaatttaaaaatacttaacaaaacctagatttttagttgttgtatttatcccttgaacaatgagtagaaaacttttagccagtgtgactaaaaacaaagagaaaccccaaaaagaaataaataacattaattacatgaaagatgagctggtgaaaatgtggattaaatgaaagattcataggagaatttaactttatacagcagtatgcttataaacctatactaagtgaatgctttttcaaagaaaatataaacttacaatattgttttgaggaaagggggaaaattggaaagcacaaattgtcagagaatatagtaaaaattttgactcctacagtcaccaagcctgagctctagtatcatgtgtactataaaaattttaagaaatatgtaaattcatgttgtataaactgtctcagaacatagaaaaaaggtgcttttcacatctacctacaaacctagagtaacctgatattaaaataattcaggtaagcacatgtacccactaaataaattatacacatatctttgaaaatcatgaagaaatcacaaaaataccacagcaatatattaaaaataataaaatataaaaatgtatcttcacgtttattgtttgactaatagaagaataaatacaaccttattgtctggcaactccttaatgagttatgatttacctatattatgaaatattatattgttatcatgaaggagccaatttaactattcgtgtagacagattccccaatatggttaactaaaaaagccagtaacttaaaaattggtttcaatgtctttctaacctaaaaaaaaggtccacatgaatattatagatagataaatgcttacagaaaggatagaatggttacgtatcactctgttaattgtaattactctggaaaaaagactaaatagttgccaggagaaagatgttattttaagaaatattatagtctacagttctatattacttgaatgcctcatattgagaatgtatctgtatatatgtgcagttcaaaaattatgtttgtttttgtttttttccaaagtacctaaaaataagccattagattagagagtagattcatgggaataatcagagagggagagggaagagagaatatgaaagataataaagtaaaataaatgaggaagggaaaatacagggcaaaaaacaaacttgtaaaaatattcataaaggctaggcacagtggcttacgcctgtaatcccatcacatcgggaggctgagacgggagaatcgcttgaacccgggaggcagaggttgccattagccgagaccgcgccaccgcactccagcgtggtgacagagcgagactccgtctcaaaaaaaggaaaaaaaaattcataaaatacatatcagagaaaagttcaatattgttataagagattttatatatcactgagaatggaaaattagaacaaaatgaatatgaacataaagaaagacatattagtgaacaataaacctaactcaatgttttctcttatttatcattttgataatctacagttacataaagtaagataccaatctttatcatattgcttatcaaaagattttgctgttattgtttaatgttgagataaagttctgttaattggcatacactggcatacaggcactccaagtgtactggtggaagtgaaaattagactttaacaacaggttttaaaagcttacaaaaatttgcatttactttgagggagcaatttccctgccaagaacttattttaggacagttattctcaaaaacacaaagatgaactaatgagatgatttttagtaggcagaattctaaggtgacccacagtcatgtatataatcttctcttaagtataaatgaagcctactaatattatgaaatgtcactttgtgatcaagttttatggcaatagagaaattaactgggggtgggccttaatctaatcaggtgagctcattaaaaacagtattttctctgatggggcacagaaagggcagaaagattcattctggctggcctagaaggaagcaataatttgcattgtgaacaagggggcaaggacctaacgatgcatctaagagctgaaagtattttctacctgacaaaaaatggaaacctcagtcctacaaccacaaggaaatgaattttgccaccatccattgagcttggaaggaaaccctaaggcctagagagaaactacaaccccaacaaacactctgattttagcccagtgagactctggacagagaaccagtcacgccatgcctgaacttctagtctacaaaaactgtgagaaaataaatttgttttgtttcatacttctaaatcagtgataatttgttatgcagcaatatgaaactaataccatattcatgaaatcgtcatttatgatagcaagtaaatggaaacctcctctacatgtagcgataaagaacaggtaagcaaaatatgacatactacacacagcaattaactctcatgtttgcaaagcctatttacaaacttcgtaagaactatgtataaaattccgtgtgtgtgtacatatgtgtgtgtgtgtttgtgcattttacatacattcgcacagttttgcattgcatattattcattaggggttgaattctgtctctcagaaaaggatatttgaagtcctaattctcagtacccccgtatgtaacgttatttagaaataggatctttgccgatgaaagtaagatggggttattagagtggactctaatgcaatctgactggtatccctaattaaaatcagaaaattgggctaaatggagagaaatgcaccaagggaagactatctggacacagggagaccaccatctataagccaaggaatgcctgatgctaccaaaagctactagagaggaaaggagctttcccttacagttcccagcaaaaaatcaaccctgataacaccttgatttcagactagcaccaaactatgaaacaataaatttattttgtttaaaccacccagtttgtgatagtttgttatggcagccaggaaagtaatatagatacctctatgttcatgtagatggaattgcaacaaaatttaacagtgactgtctcagttattgggaatatattaggcgggttaatactcaatttttaatatttggccacatttaacctataaacgtggcaatttgacatgtttcagttcattaatttcttctatattttttgtgctcatcttaatttttaattgtctttcttttcatttttttgagacaggttcttgttccccaggctggaaggcagtggcgtgactgtggctcactgcagcctcaaccttttgggctcaagcaatcctcctgcttcagcctcctgagtagctgaaaccacaggctcataccaccatgcccagctattttttttttttttggtagagatgaggtcttactatgttgccaaggctgatctcaaactcctaggcttaagtgatcatcccgcctctgcctcccagaatgcttggatgacaggaatgagccaccacacctagcctcctctaaatttttgaagttttcataatatgtgttatttccatagccaaataaatttgataatcacaaaaagtagacaaccctcttcaaataagcaaatgttggagattatttatattcataaagatgttaaaccaagatgaattgctaacttgaaaatcatttcctttcctatattcctttttctgcattcagtctcttcatatttaccttaagatgttttatagtttatgcattatttgtatatgtcaggttttaaattgaaatattagaaacagacattattggaaacagcagttttctgtttctactagagcaaaataactaatgggagattaatattaatagactatgcactgaatttttcttataaaagttcaattgtctaataaattaatgatacctctcacttttacaaataatatgcatatctctacttgctagtgttgatctgatcattcaataatcatttaaggattcattgaaatccaaaaattggctaagaaacatgctactgttgtctagagggaaagacaggcatcaaacaagcaattacaaaaatgtatggttagtcttataatgggaaacatgaattatatggaactaaccaagtcaaaggtgagaaaatgccctctgaggaagtgatttgcaaggtgaagttttccgatttggcaggataagtaggaccaagttgcagagggagctggggcttgcactgtatagaatgattaaaaatagaacaaatgttgcttgacaaagttctgtgattttagttacaacacctgaaaaatgttatgatgctattgtcttttaaatacatgatttcttttgacatgaatcctgattttttagaaatattttcaaatctgcattttctgtcacgaataaatctcattaactgctccactccaaatggccacttctgtcactgcaaatttatatagggacagctatacattattaacaagctatgaaaagtcaccggctaaatgtcaccaaagctgaggtatagctgcaccttgggattcatatagcaaacagtttagttttaatcatcccggaccacaggatgtcttgacatttgagcagcaactttttcctctttaacttgcactggaatcagacctctattatctcagccataatttttagcttaaattgtgatagaaagttttaccttctaaattaaaaacgtgaaaaaaatcgatccatcaaagaacttatcattcatgtaatcattgctcacctgcagccctcttcctcttaacccccactccaagaaaggtgatcaaggacagctataaaattcaaacatctttagacctgccagaaattttttgagctaaatgcttttctgttacattaagacctacaagaaatgaccttgctgaactgcattaagagagatgattgattttaccgtgaaatattttttattttgataaaataagtaggtttcatatttttaaaatatgcttttgaatctttttctgctcaaagtctaataatgttatcaggatatcaatctttgatgcctacaaagtgtctaaatttattaatattttataaaaaatatctaatgcatattatatatttgagtcttcttaagatctatcattttagcccttcattgtggagcattcacagtaattaacatagtaattagaaaaaaagggaaacagacatatcaataaagataatgtttgctatatatatgtgtcttataacctcatgctgtataccttaaaatggtcatcaatacaatactacaaatgcattacataacctgttctgaacaaatatgactggcttactgataatttttctatatatataataagtcatggataagcaattattaaaaaagggcttattgtcaaataaattggcttattggtatctatcatacagctcttactttatttaataataaatatcatatggtccataatgaatagtatagtgaatgcatacatcaaaataaaagtagatgatggaatttaaaacaatgatcatagcattgtttcttaactgttttatgagttaacacctaaaaatatgtaaatttataatatgtcttctttttatttcaccaaaaaatacatgtgatggaaaattgtctatggttgtcttcacctctttgaaaagttaacagcatcacttttatgtttgcttctattttctctattttatgaacaacattcaagtagtatttgtcaattacctattatgttatgaggtattgtaggtttcatacagtgatgagcaccatggacaagatctttgtagatattacaatcaaatacagagagaaaaattagtatcacagaaaaaaaaataaatgctgctatgttttacgatggtgtctaatgagagatacaactttattgagtgggttggtgggaggtggggaaagaagattttcccatacctgttcttttgagagtgagttaggggagcattagcaattattcttgaataacaggcttaactcaggcacatatttagtcaactaaccctacaaccttgactgattgatggagaatatggtaggtcttgagaacttttccaagacaggaataccttagttgggagtctccagaaacagaccttgagcaaaaagtttgagtagaagtagttttttaggagatataaaacacacctaaagttgagtaagttggtagatgaaagagaatgtagaaaatgaaattaaatcaactattaaagtgggtgcttagaggttattcccctaggaaactctgatcaaccgtaaaaaacacacacttcagaattatcccacctgatagactaagaaagctaaggtgtgtatacccaaacttccatcagtaattgttgggggctgcatcctggattgggaggatgagaaggggaagggggttaattcaccagaatttctgttctgctttgcatgaaagtagtttctgaaataaacaagctcataaataaatacacagtttgctggaaattggctgtaaaaggttgaaatggtaggatgagaggagtaggagtgatagccacccattagacaacagcatgacagagtgagctaaggtatttgcatctattaagattatcagtctcccattattattgtgtgggagtctaagtctctttctaggtctctaaggacttgctttatgaatctgggtcctcctgtattgggtgcatatatatttaggatagttagctcttcttgttgaattgatccctttaccattatgtaatggccttctttgtctcttttgaactttgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactttttatccaatttgccagtctgtgtcttttaattggagcatttagcccatttacatttaggcttaatattgttacgtgtgaatttgattctgtcattatgatgttagctggttattttgctcattagttgatgcagtttcttcctagcattgatggtctttacaatttggcatgtttttgcagtggctggtactggttgttcctttccaagtttagtgcttctttcaggagctcttttagggcaggcctggtggtgagaaaatatctcagaatttgcttgtctgtaaaggtttttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccccttgtaggtaacccaacctttctctctggctgcccttaacattatttccttcatttcaactttggtgaatctgacaattatgtgtcttggagttgctcttctcgaggagtatctttttggcattctctgtatttcctgaatttgaatattggcctgccttgctagattggggaagttctcctggataatatcctgcagagtgttttccaacgtggttccattctccttgtcaatttcaggtacaccaatcagatgtagatttggtcttttcacatagtcccatatttctgggaggctttgttcacttctttttactctttttcctctaaacttctcttcttgcttcatttcattcatttgatcttccatcactgataccctttcttccagttaacaaatcggctactgaggcttgtgcattcgtcacgtagttctcctgccttggttttcagctccatcaggtcctttaaggacttctctgcattgattattctagttatccgttcgtctaattttttttcaaggtttttaacttctttgccatgggttcgaacttcctcctttagctcggaagtttgatcgtctgaagccttcttctctcagctcatcaaagtcattctccgtccagcattgttctgctgctggtgaggagctgcattcctttggaggaggagaggtactctgatttttagagtttccagtttttctgctctctgttttttccccatctttgtggatttatctacttttggtctttgatgatggtgacgtacagatggggttttggtgtggatgtcctttctgtttgtcagtttttcttctaacagtcaggaccctcagctggaggtctgttggagtttgctggagatccactccagaccctgtttgcctgggtatcagcagcggaggctgcagaacagcggatattggtgagcagcaaatgttgctactggatcaatcctctggaagtcttgtctcagaggagtacccggccatgtgaggtgtcagtctgcccctactggggggtgcctcccagttaggctacttgggggtcaccccactgtcaatattagacagatcaacgagacagaaaggtaacaaggatatccaggaattgaactcagctctgcaccaagtggacctaatagacatcttcagaactctccaccccaaatcaacagaatatacattcttctcagcaccacactgcacttattctaaaattgaccacatagttggaagtagagcactcctcagcaaatgcaaaagaacagaaattataaactgtctttcagaccagagtgcaaccaaactagaactcaggattaagaaactcactcaaaaccgctcaactacatggaaactgaacaacctgctcctgaatgactactgggtacataacaaaatgaaggaagaaataaagatgttctttgaaaccaatgagaacaaagacacaacattccagaatctctgggacacattcaaagcagtgtgtagagggaaatttatagcactaaatgcccacaagagaaagcaggaaagatttaaaattgacaccctaacatcacaattaaaagaactagataagaaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagacctttagcaagactaataaagaagaaaagagagaagaatcaaatagatgcaataaaaaatgataaaggggataccaccaccgatcccacagaaatacaaactaccatcagagaatactataaacacctctaagcaaataaactagaaaatccagaataaatatataaattccttgacacatacaccctcccaagactaaaccaggaagaagttgaatctctgaatggaccaataacaggctctgaaattgaggcaaaaactaagagcttaccaaccaaaaaaagtgcaggaccagatggattcacagccgaattctaccagaggtacaagcaggagctggtaccattccttccgaaattattccaatcaatagaaaaagagggactcctccctaactcattttatgaggccagcatcatcctgataccaaagcctggcagagacacaaccaaaaaagagaatttcagaccaatatccctgatgaatatcgaggcaaaaatcctcaataaaatactggcaaactgaatccagcagcacatcaaaaagcttatccactatgatcaagcaggcttcatccctgggatgcaaggctggttcaacatacacaaatcaataaacataatccagcatataaacagaaccaacgacaaaaaccacatgattatctcaatagatgcagaaaaggcctttgacaaaattcaacaacacttcatgctaaaaactctcaataaattaggtattgatgggaagtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattttatatctagaaaacccgatcatctcagcccaaaatctccttaagctgataagcaacttcagcaaagtctcaggatacaaaagccatgtgcaaaaatcactagcattctaatactccaataacagacagacagagagccaaatcatgagtgaactcccattcacaattgtttcaaagagaataaaatacctaggaatccaatttacaagggatgtgaaggacctcttcaaggagaactacaaaccactgctcaatgaaataaaagaggacagaaacaaatggaagaacattccacgctcatgggtaagaagaatcaatatcatgaaaatggccatacagcccaaggtaatttatagattcaatgccatccccatcaagctaccaattactttcttcacagaattggaaaaaactactttaaagttcatatggaaacaaaaatgagcccgcattgccaagtcaatcctaagccaaaagaacaaagctggaggcatcacactacctgacttcaaactatactacaaggctacagtaaccaaaaagcatgttactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcctgtccttacaccttataggaaaattaattcaagatggattagagacttacatgttagacctgaaaccataaaaaccctagaagaaaacctaggcaataccattcaggacataggtatgggcaaggacttcatatgtaaaacaccaaaagcaatggcaacaaaagccaaaattgacaaatggtatctaattaaactaaaaagcttctgcacagcaaaagaaactaccatcagagtgaacaggaaacctacagaatgggagaaaatttttgcaatctactcatctgacaaagggctaatatccagaatctaaaatgaactcaaacaaattgacaagaaaaaaacaaccccatcaaaaattgggcgaaggatatgaacagacacttctcaaaagaagacatttatgcagccaaaagacacatgaaaaatgctcatcatcactggccaacagagaaatgcaaatcaaaaccacaatgagataccatctcacaccagttagaatggtgatcattaaaaagtcaggaaacaacaggtgctggagaggatatggagaaataggaacacttttacactgttggtgggactgtaaactagttcaaccattgtggaattcagtgtggcaattcctcagggatctagaactagaaataccatttgacccagccatcccattactgggtatatacccaaagtattataaatcatgctgctataaagacacatgcacacgtatgtttattgcggcactattcacaatagcaaagacttggaaccaacccaaatgtccaacaatgatagactcaattaagaaaacatggcacatatacaccatggaatactatgcagccataaaaaacgatgagttcatgtcctttgtagggacatggatgaagctggaaaccatcattctcagcaaactatcacaaggacaaaaaaccaaacaccacatgttctcactcataggtgggaactgaacaatgagaacacatggacacaggaaggggaacatcacacactggggcctgttgtggggtggggggaggggggagggatagcattaggagatatacctaatgttaaatgacgagttactgggtgcagcataccaacatggcagatgtatacatatgtaactaacctgcacgttgtgcacatgtaccctaaaacttaaagtataataaaaaaagattatcatttaaaagtcccagatttagtttgcttatagacttttgtccagtagagatgcaaatactttctgttcagaagagaaaaataaccccaaagttataatttattgtcccgtgggacagcaagcagatatgcatctcatccagcaaatattattctgaaatgcctttattaaactcccagtgaatacacaactcttcaaatgctctctagtctgtttgtataatagtttgtaatttcaaactattataggctaaatcaaatttagccttgcttcgctcatagattttttttgtttagactatgttttaggttccaggttttgtataacattttacataatatattgagatagttcctactcttatttttgttttataaatgagaatgattgtgttttaataaggttaagtaatttcccaagatcacgcagttagcaaataatggatttagattctgactcaaggaattctgacttgagatccttctgatatacctccaccccatttttgagaattactgctctagaccttttctgaaaggaacctagactgtttatatctaaacacacaactaccaagtatctgtgcaattcaggtcagaaattacataaagttgcagatctttgaataggaatgtattcaagaaaatagctttttattgaagagggctagatttttaaaaatctgtaagagttaatcagagcttagcgaattgatgattttcctaaaaaataatagaattagacttcccaatgttactagttatcttgataacaattttgctaaaaattcaaaatccactgacaacaataattatgtatgcttgtaaaacaaaaaagccatattctgacgaaatataccattggtaataagggaaaattgctcagtttttattctcattaagtctcaagaaagtctgagtgaggaaaactttaattggataccacttcatttggtaacaccattaattggacagttaacaactttttcaaaaggttgataagtaaattggtcatggtagactaacttatgctgtttgaaaaaataatccccaaatctcagaggctaaagtaacaaaagcttatttcttgcttataagacaaagctatcacgggttcactagaactacattcttcggatcattgtcctccctttggacctggctgatgatgtattaccaatgtccatatcagcaaaaaaagtgagcctgcaattctctcatgagtatttaattgctcttcccacagaggaacacgttacttccagccaacttctccccttagtgaaaaatattgacgttgcctcaaccaaacagaaggaagctagatgtaccgtcatactgttagcagcgggtctttgctcccagagcccccaagatggcagcaagcctcttgcactctgacctggggttcttggcctcaaggattccaaggaatagaaccttgggccatgcagtaagtgttatagctctattagaagccctgggtcacggaagagaaccatggaacccagcgactagtgttaagctagattaggatgaacctgggcacttagctgcacagaataatggcgagcctctagcccgatcaggagtggcattaggcgccttgctggattagaagcgcagcagacaccctgcccgatctggagggatggaagtaagcggcaggtctgcaacgcagggatcagtagtggtggacggcgagtgataactcagctccagctggaacaaacatggaccagcagagtatgcagttgcatgatttaatagagtgaaaacagagctcccatacaatgggaggggacccaaagggggtttcccactccccacttaatggctggggtttatatcccaatcattgtcccttcccctgtgctctcagatgatagatgatgtgactatttctttacctcctgtttttagcctaattggtgttttagtgagccctctttactacctgattggttgggtgtgagctgagttacaagctccgtgtttaaaggtggatgcagtcaccttcccagcaaggcttaggaattcttagttggcctaggaaatccagctagtcctgtctctcaatatgatatgtctggaaagaggggaagtgggatatttggccaaaagagttaaaaaacactgcagtgagctgaatgtttatttccacctcctcacccgcccccaaattcatatgttgaaatcttaaccttcacagctgggtttaattgggaggtgagacttttaccaaatgattaggtcctgagggctttgctctaatgaataggagtattattcttatgaaagaggccagagggagctcatttgaccttttcatcatgagaacacagtaagaagacagctgactatctatgaactagaaaatgggtccccaccagacatgaatttgctagcatcttgatcttggacttcccatcctccagaaatatgagaaataaatttttgttgtttacaagccgtccagtttaaggtgttttatatagcaacctgaacagaccaagacaagtaccacaacatgaaatgaggtgattatgtatacctatattaatatacatctattactatagagtacatcaatttcttgcatatttctgcacatgtgtgaaaaaagagtcacatgaaaagtcttatctttgtaaatatacatatgtgggaatgtgtaaacatgatacaactgtgatacaaataatatagactttgaaagttttcataaatgaaacgcttgttttccgaaactttgtccactgtaataatgttctggcatttataaaatactgcatgtgaggtttttaataattagtaaattcacatatgtgttttaaataacatagtaaaataatctttttaggtaatgtggaacaaattgtgaaaaaaatgcaagagtgaagtagaaatgataaaaataaaacataatttaattgttgtaagtgctttgagtaagggatttatccaaaattggatttcaaactattataggctaaatcaaatttagccttgcttggctcatagactttttttgtttagactatgttttaggttccaggttttgtataaaattttaacttggagaaacagccctagtcaccattaatatggtcattctaagttttttggatgtttcaaaattatcgttatgctaaaagtgcatttgtattatatttaaatgtcttaagttaataggtctgaaaattatctgtatatagacatttaaaacaaatttagaaattattatactggtataaaaagcacacttaatactatgcttcaattgaaccaattgtcacgttttcacttccaagaccccctcccgcttttcttttttccatactgagttctgttcctactgttctgagaaagctatgctcttactgttttccaaagctgggcctccatatttgtgaacatgccatatatttgtcactccattctaaagagaatgcccgattttcctacctattacccaatttgctgttttcccttcatcatcaacataatgtgtactctagtgagggggtggctggaggccaggaacttggatggagctggaggctgttatccttagcaaactaatgcaggaacagaaaaccaaatactgcatgctctcacttataagttggagctaaataaaaacatatgaacacaaagaagggaacaacagacactgaggtctaagtgtggagagtgaggagagtgaggagagggagaggagcagaaaaataactatcgaggactgagcttaatacctggctgatgaaataatatgtacagcaaatcactgtgatgtgaatttacctatgtaacaaacgttcaagtgtacccccaaacctaaaacttaaaaataaaacaaaacacaaaacctgtactcactgctttgatttttaatttcccatttacttctcaactcatgacaacatatctttcacctctaatgtttaaattgctctaacaaaaatcatccaatctaatgattacaaaagtcaagactctctgctaatcctgacttcattttgggatcaatgcaataaatcaatctctccttgaagttaattctcccctagttcccatgacattcccattccaatcttttgctacttgtttatttactttcactgtgtcaacttcaatcacacacttcttaaatgttactgtttctttgggctgtaatgtctgttgtcttcttttcattaaattattgctaaataataccaaccagaaatcaatgttatttataactgatatgacaatgactactaacttgtgtttccagtcctaactgctctcattaaactagatctatattttcagtggccacttagttatctccacatggatgctctacacacatctcaaaaggaacctaccaataaccagtctgtttatcctactttctcctcacaacctgattccatatatttaatgggctatgtaagaattatttttttcttatttcatcctcatcagtcgactcctttgagagtgtttgaaatatttctcaattctttcattttcctagacttttgtgtttttgttttattttctcccctggagatcaatgggcagaccagaatagttttattacagttcaatggcatttagggaaaggagcaaatcatcatattcactgtgacatcacaaaaagaatcacagaaatcaagaggagtttcatagttgatatttaagaacaccaagaactttccctatatcctcactcaggattctctgcttaatgaaatgtgtaagagcacagagaacttattaaatatttaataatatttataatatataataatataaaatatattatttcctcttaaaatgattaacatcatttattggtatctaagtttttaatataaaaattaatttatttgatctcctaatttcttaaagatgccaaatacatggagccttcccctgatgtcctgatggcagaatcccattttgttacaccgtgggtggagagagcagatgccccagtgcctccttgcagctttggacacaacgtgcagatggcatcattatctcttttacatcttggatggattgctgggaaggacattctgttaaatagttattttaaaagatcatttgggaacttatgacttttttttttgctatttccttatatattttatgactaacatatattgttatttttaatttttttctgagttcattcccttagtttatcatgttaaatttctctaaagagtagtagttttctttcatttattcagaatattatattttcatatagagggagatccagcacccataaaacattagaaacactcaaaaggtaatttacatattgttttttaagatttttaatattattgaaaatacattgtggtcattttattgtccatcacaaatgaataaattcatacacaaatatatgataataaaaaatgctctacaagcaggtagaggagtgaaaggactccatgtattcagctaaagactttgagccagtatttgcaggtaagtatcataagccaaatgtctcaaactttagcatgcatcataacatctggagggcttaaaaattcagcttatgttacccatcccagagtttttcattcagtgagtctacagttgggcgtaagaatttgcatctataataacttctcagataaggttactgctgctcaaaatgtgggaactactgcttgaagtcacctatagaatatttggaaatattgaaaaaccaaaagcaacctgaaactagcaaatatagttaatacagacaataatactaataaattgcaatgttaagatatcaattattttaatgctttcatgctaaaaggactaacagaacaaaagtgtttaatgatcaaaataaaacaaaccttttggaagtaatagatgaaaacaaaacctttcatgataacattttgtgttgttttaaacgtacagaaaagtgcgaattaccttcaaaatatacttcacaaaaaggtcccctgcggtgtagacattggaaaaggtcaaaataactattttctctaaatgcttatcatatttgttgctttcacctattttaggtgacacaatttgctccttttttagtgtcttatttccctatttatggcactaccctcacccagccttccagctagtaccacaattctttttttttttttttttttttttcgggacagagtctcgctctgtcgcccaggctggagtgcagtgggctggagtgcagtcacgcaatctcggctcaccgcaagctcggccttctgggttcacaccattctcctgcctcagcctcccaagtagctgggactacaggtacccgccaccacgcccagctaattttttgtatttttttaagtagagacggggtttcagcatgttggccaggatggtctcaatctcctgacctcgtgatccacccgcctcagcctcccaaagtgctggtattacaggtgtgagccaccacacctggccgctagtaccataattcttgtgaacactgactggcactctgaccatcatttttcccaatttatttagtttaaataaatcacgtgttttgccaattgtagttggttatctgtgtgcttttctttcttcttagcttctgcctgtaccttccaatatttcttctctgaagtaaattaaagaagaaccctcacaatatcttctataatgctgtaaaaaatagcattttaacgtggcctttatatactcactcgtttcttagaaaacaagttggcttatttcagtttgaaacataagtaattgatccttaccaaacaggattaaaaatagtagcaactgtaatagaaattttgatattgaccacataacaatcttatcttactttacagattagtctaagatgctaggagttgcaaagagacttaacaggcttgaatggatataatctgtacagattctgatctttatctaaaaaaactgatattcaccctttgatgcaaaaaagagagagagagataggtttgcagagtgggggaaagatgaagagagagagagagaaacgacctcagatttgggcttgtgtaagagttttgtggaattcagtgactgaagggccctggaccagttctttgaatgagagtactggggagaaaagggggctttgagaagtgattacatgaataatgaaatgaattttctgtaatgttccttaagacacaattaagtgattgcatttatttttatttgtgcaatggactgtgctttaataagtgcaaatctctgcagagccttggttgcttgggcctcaggatttataaaagctatgtgttttttatttgttcttaaaatgacattttcttgattttagttattttcagaatgttgagagtgggaatgaaaggcaactttagaatcagaatttgacagtagtaggaaaaaagtgataattatactgacatggtcaaattcacaaaatgttcttaaccttgtggtacttaattttgcatattgaccaaaaaaggccttaacattcttctcagcttaacgttagataggttgtttaagttcctcaccttccttttcttagagcaattaacatagagaacttttaactttctagcctttgacatgtaaatcttttaaaaactcttataagctttacaacctaggactaagtttctccaggatccgggagccacccttttgaaatataatcaccatagagataatgccctgatctccccgtctctaagggaaagtaggagcctaactttggtgggcaccttactccaagttgtaaaactccctcctgtcatgaagaaagtctatttttccttagggtaaagccaattaacaaacacagatgactcgtggatccttctcgccctcatttttaaaagatcgtccacgctttgtcttagaggagttcagctcagactgagttatggcctctcccctatttcaacagccttgaacgaagtctacattgcctgattaactttgtccagtgcattttttactttaacaatatgaagtggcccaaaataaataaataaataaataaataaataaataaataaataaatgaaaaaaaaacgttaatagcactagaaaaactacaggcagaaccgtgttacgtttgacctttgctttattattattgcattcgcacagcttcagttgtttacacttcaaaacatagagtatgagacattttgcatttctgtatttcactacaccacagtcaggatcttttgtgtccccagcttccaggaagcaggaaaatgcaatcttgcttgttttaggaactacccttcgtctgctaacaagggcttatttaagaatcttggttgtcctagtgccaaaaaatggccaaagacataagtacatttcatggagaatgctgtacttttgttcccaggctctacattgctcaggaactcaggtttatactatttttttcctcaggagttactccttcaggtatattaaggatagtaactcacagtagaccctctccttcaccagcagcctccctcccccaccctccaattctaaatgataagtaaaagtggagtcctagactctgctgctggaacccatttcttctcccaatattggaaagacctcaaattcattcccagacctactatttcctcctcccacaggaagaaagtactttattttgcattcattccctcaaggctagaaaaacttcctcaaatttattctactttcaagttctaaaacactgaagaaatgtatctacttttttacctggaggagggttaaggaagataaagcgtcagaccatctgccatggtctgaatgtttgtgtctccccaaaattcatacattgaaacccagtccccagtgtgatggtattagaaggtggagcctttgggagaggattaggtcaggaaggtggagccctcatgaatgaaacagtacccttataaaagagaccccagagagatagctggcatgttctaccatgtggggacacagcaaggagccatttaagaaccagagagagagccctcaccagaccctgagtctgttggcaccttgagcttggacttcccagactccagaactgtgagcaacaaatttctgttgtttataagccgcccatgtattatatttttgttgtagccgaccaaaagagctaagaaccatctttttgagacagtatgttggtgtgtcatttcagggatgaggaaggagcttcaacctggttatattttgtttttaagacactctaaactgatgatacaatttaatgatgaaaataacagcaaatacacatctgacagttctgttgcaaacattatcctaaggcttctcagttgtgtattataatagaatttaaaaaaaaaccaaacatagttttagaagagggagacactcagtgcataagaatatggctactaatatattcctgctcagtgtttgaaaagtattcatttcccctgatatgcacatgattttctacatgtccaaaaacaacattattattaagtatgttgatagaaaaaaaacaataatttatgatcacctcactgtaattgcatacaaaaattaatatgtggaaacccaccaagaagaagttatgtatcttcaaagcgcaattattttattgaattcttagaagaaattaaaatgaatatggcattttattactgaattattctggttttagatcatacctagatacctttaaaggaaagtcatttcgtagctgtgtcttccagaggcttttcaaatatatatttagcttgtgagatttttcttttgaataacctttcccttttaactgatgccctagtctctgattacccactccctggcctctgcccttttctcaaatcatcttactcagcggtaatgaaacagcagccacagaacagcagtgttgcaagactcaaatgcattagcctatcacggaaaaacacaagacctttgtttagatacaagtacgtacaatctgagttctcttttttcccctgtcatgaactctatatatcttgatgactttgaaaactaaactttcttccccttttcttagactaggattctaatttaggtataatgggatttgaacctccctcaagccttttaaagtattcaagggaggcataaaagaaatagcagagagacattcactttttattactctctatgatggggatattgtattgctcacatactaatgtaaattcctctaaaatatataatttcaacccttttattctctcactattccctttccactatcaatttggatttctgagaccttacgcaactaaactaaatcgtttcctgaagcttatgtgccttggtcttttgagtacagtaactgcacaatcgacagaagttacaactaataaatttctctttgtgactcttcctgacaaccagaaaaaaacagtaatttaacttttctggttaaacttgaaccaaggcctaaaaagtagataagtgactcaaactatttatcttactactcctaccctataaccctcacagggaaatgaaatattgccagcattctaaaacttgttgaaagggaagcattcatatttaggaaaaagttacagatagagatcattaaaatttagaaacattccttttcaacttccgcataacttctatctttatagttagtcttgctctgcttaaagctatactgaggaatgtattttaaatttagaaccaattttaccctttcttttataattcaaaaagttggaatatttgttttaataatttctgtaaaaacaaaatgccatagaatttcatattcaggatattagtatatacctcactatcttgatagactcttttagaatcttctcactcctcacatagagaaacagtgcatagacatccaggacacagaagcgactgtaacaattattttgataagacatatatgagatggaagatgaacattatttatgttgaccatagggacagcacagtataattgagttatgataacactaactccttcatcatgtgaacagatgctaagaagcaacatgttcaattactatttgaatacattatctcattctttgcccttaataaaatatcctagtgccacaatttcaaaatgagttgaaactttgatgtactgctgccaacagccacagaacttttaaaagtcactgtctagttattttgcctctaacaaggaaacacatttgctgagaattagaatgaattaatattatacttatcgagactattcatgataaagctgtctcttcaggatctttataaatgatcaacctctcctggatgtgatattttctgctaaattcagaaataatcagaagagacaatctttatctcattgatatcaatgctggttttaatgcctactacagtacctacagacaactaaaccacattcttacaatgttttaatgatgcctactatggtacctaaaaacaatcaacattaggaaaaagtaacagttaaataaatagaaacctgtactttgcactattagaaaaatttatgttttaaataaaatcagcatgtaaattaaataatgaatgcaatatgtgttctaaaccatgctacaatttaaagatttaaacaaatgtgttgagatgtaactaatagaaatacaatgaagcagttcacatacttgaaaaaccaaaaaacttaataaaaaatatatatgcagatgacatttcttgactagtgatacagagaaatgtcctataaaagttgcatagaggcctatgaacttcaataaatatttaaaatctattctttactgagaatagatcttatcataaatttatccatctcttttattggcagaggagagaagcagtacaaatatccttggaatgctttacctttttagcagagggcagctgatacatcatgtagagaattgttcaataggtgctctgagaagacaaaatgtccctatttctttgagactttattcactaatatttcaatttggcaaagtgtgtccatttttttttcttatgtgatgggaagggatttaagaactttattttataagtcaggatctctatttatacaggaaaagtacaattactgtcagtaaaatgaaagtcttctatattcagctggcaaccctaagaggcagttcagagagtttcttaaagcagagaaaggtttaaaattatgaagtgatggatatactttatccaaattcctgctgtcatatttactattatctttaatataccaacacactgttaattgcctaaggaatagaaagtccttggcttatcttgctttcttgcctgcatagaaacctcttaaaactatacttttcttttatctgttatgcctctaacatttctgtcattaacacacacacacacacacacacacgcatatatacatacacacacacacacatatatatacacacacatacatatacttacacatacatttctacgtttggggctttgttatactccaattgcttggagaaaaaaaaatcaaagttttaacgcttgaaaacttttgccaaactttctttttccatatgctctaccattagggatttctttattttcagggactcaaaagtttatgacactccagccctgacctgacatcatgctgaaattgtcaataacccacttttatttctactgttgcccaaatcaacatgtccaacataaaatttgttttgccatccccccaaattctaatacaagttttaattaatggctgtaccacattttagtaatgctaagctttaagcatttttggctcattttttctatcttaaattttagtcagattccaagtcatgtatagtatacattcaaaatgtcttaggcttttgctccccaccttacactcctacactcggtatcttctatcatgtaccatctgttcactataatgtttcctaagtattttacagctgtcttccctgacttcagttcttaataaatgcaatagcaaaataaatcttcctaaactaaagattctggtcatatgcctgtgattgcaaacctttcttttcgtttttcctgtttctctttttttttctttttttttttttttttgagatggagtctggctctgttgcccttgctggagtgcagtggtgcaatcttggctcactgcaacctccacctcctaggttcaagcaattctcctgcctcagcctccagagtacctgggtggttacaggtgcccacccccatacctggctaatgtttgtatttttagtagagacagggtttcaccatgttggctaggctgatctcgaactttacctcaggtgatccgcccaccttggcctcccaaagtgctgggattacaggcatgagccaccacacctggcctgtgattggaaacttttctagggtaccatcacatatggaattaattacagctttctctacctatcctgtaagtactttacctgcactatggtctcttagaaagttacttaactacttaatcccttagttactatttgtaaaagggaataataatatgaaacttttagacatgttgagaagattaaatggctctctctctctccctctttatatatatctagatatatctatcgatatatctattgatcgatagatctatatatggacagattctatatatctagatatatatcgatagatatatatagatatacatatctatatatatggatagatctatatatagatagatagagagagagagggagagagagagagccatttaatcttctcaacatgtctaagactttcatattattattcccttttacaaatagtaactaagggattaagtagttaagtaactttctaagagaccatagtgcaggtaaggtacttacaggataggtagagaaagctgtaattaattccatatgcagtggtaccctagaaaagtttccaatatatctatatctatatccaatatatctatatatatatatctatatatctatatatatatatagagagagagagggagagaaagagggagagagagcaagaagagaggagcattataggtactcaaaaattgacactttattatctacgtttctgacctcactttttaaaataacttattcttttgatttgtttataattgttattacaaataattttcaacatacataaaaattttaaaaatagtgcaatacataccagtaaacctacaaccaaaattaaataactgttaacattttgccatacattttgtatatatatgttgtcttagtctgtttgggctgctatagcaaaacaccatagactggtagcttatgaataatagaaattcttttattacagatctggagacagggaagtctaagatcaaggcgtcagcagactcagtgtctggtgagggcccgcttcttcatagatggccttcttttcactgtaacctctcatgatgacaggagctctctctggtctttcatagcacgaattcctttcatgagggctctgctctcaagacctaatcatctccgaaaggtcccacctcttaataccgtcaccttgggagttaggatttcaacatatgaatcaacgtatgaattttgagtgggcacataaacattccatccactttatatgttaaagtgcaaatgcatgctttttgaactgtttcaaaacaagcggaagacactttaataaagcagatgatactttatccttaaatactctaacatccatctgttattaataatcagaatattctccatgctgcctaggccattatcacatctaacaatattaatcataaatattgagtattagctattatctaagtcttatcacaatctccccaactgttcctttaatgcatttcataactgttttgccttcagtttagtgttattttttaaccaggatgcaattaagtttcatatggttgttagaaatgttctctctctctcttaatttaaaggagctctactggttttttaaaaaaacgcaatgctactttattaaatatctgaaattatggattttaccatttgctaactcagtttttctaaactccatatttctgccaaattggaaattagatctaagaccaaattaaatcatgttagccactttcggtaagcatctttcatgagcttttcataaaatattacatcaagacaaatatatcatggtgtcttaaaggtagtaatgctaaatttgactgatgatttaagatgacctccatatcactttattttatagtttggtaattttctttgcaattagaaaatatgcagtgaatgatacttttactatgttggtttatgaaataaaacatttcttctaaaagtttcagtatccactgagggttctgtaaaaatcaactatttagttataaattttaaaaaaatgtctaattctgtcattttcatacataacaaaatggggtttcttttttcacctcatcaaatcaatatgaactacaatttgtcttaaaaagagaaggtaaaaaattatctccctttaattactaatgctaagaacaaggagttgatatatacctactaggtatacacaaaatttaaaagtaaaaaaaaaaatgactataaaggaataagcagttgaagtaatagtaattttcaaagatagtaaaactttttcctctttttattttagtaacactaagaaatcaggatttttcccccttgctgttttatatttacttatgcccattattctttctcatgctcacattatgtcatatttggccactgagtccattcaggctggctcctgtgtccttttgtcacatctctactagcttttgagtatcaaaaagagtctggcttacatgtactactttttgtcctcaaaatatattgtacttacttactatttttgatactcaaaagctagtagagatgtgacaaaaggatactgtgttaaaaatcattgagaatacgccaggtgcggtggctcacacctgtaatcccagcactgtgggaggccaaggtgggcagatcacctgaggtccggagtttgaggacagcctggccaacatggcgaaaccccatctctactaaaaatacaaacattagctgggcatggtggcacgttcctgtattcccagctacttgggaggctgagacaggagaatcacttgaacccaggaggcggaggttgcagtgaaccaagatagggtgactgcactccagcctgggcaacagagcgagactccgtcttaaaaacagaaacaaaaaataatttgaaatatttttttcactctgtagttttgctatgaacttaatacaagttgtgtttatttgtttagtttgtttccaatttcacaattcaaacatatcattttgaggcctgcacagtggctctcgcctgtcatcccagcactttgggaggccgaggcgggtggatcaattgaggtctggtgttcaagaccagcctggccaacatggtgaaaccccgtctccactaaagacacaaaacaattagccgggtttggtgataggcgcctgtaatcccagctgctcgggaggctgaggcagaaggatccctagaacctgggaggcagaggttgcaataagcaaagattgtgccactgcactccagccttggcgatagagactccctctcaaaaaaaaaaaaaaacactttgattttttaaaatgtgttcaatatgttatacacttacataatttaaagtttatatattcataatctataaaaagctgtactataaaaagttacactttcatttctatcctcttctctgcagtctctaccccaacttcacatcttgtagagatttccctctttaattagtttctggtttatcgttctgatggttctttttttttatggatgtatgagtgtattgttgggtatgtttgtaagtgtgtatgtgcatatgtgtgtgttgcccttccttccttagaaaaaaggctgcatagcttttctcgggcactttatctttttggatatatatagcctaaggattattcaagtactccataatcttccttgtgctttttacacctccttattacacctttatgtagctttatttttttcccaccaagtcaactattggtagtcatttggattgtttccaatctcttaccattatatataatactgctgggaaaagtctaatgcatacattgattctatctgtagaaccgcattttcagtatagagtcctggaagtggaactatgagtcagtggttatttaatgtgatcatgttaaaaacatgaccaaatttcccttgatatgattaaataagtctccacacccaactgcagtgtgtgggagggcatttacagctttgacaactgagtgtgttgtcatcattttggttatttgctggagatataactttaaaaatatattttaataccattttaattattttttctttattatgagtgagataagcgtattttcacatgctacacacatttactttctttttctgaacattttatgcatgtattgtaacctttttattctaccagaactctttttatatcctagagattagctctttgtcttaagttactttctccccttatataacttctaactttactcttatctcttctacaacaggtatcctactgtccaggccaaatttttacatagggaaaataaattaggttccacatgtgtcaaaataaaataattctttttttgcattaaaataaaggaattattttttaaacctagatgatggaaaaaaaaacctattcaataaataaaacagatagtcccttaaacataaaataaagagggtttgggaaagactatttgtatgccaaaagtgagtgatgaagaaaggaaaagcttaagaaagcaatgggaacagactgccttagtagtaaagtggagaggggtccacctccagagtgccagcatgagcttccctgctgatgccatccccagtgaaacgaccataactggtaaaaactataacaaaatgatcattttatgttctacaggcaggaatacaacaaataaggaaacttttgtttaagaaaatgtactaattcaaatgagtgctgagagtctgtgacacttgaaccacaacccattaaccacaacttccagctgactgtgttggaatctctactttcagtgaatatggctgagaagatgaagctaactctcttctcaactcccaatcaacagatattgtatctcactggaaatggaaaggccaccagcatttatctgcttaaacgttgagttgcagaggttaagatcctggttagtgtgactaagagtttacggcttccttttctacacccaaccccaactcatagggcagaattatttaccttagtttcagcaggccaagaatatgtggagaccgattaccttagccctagtttgcttgtactgtgggggtttcacatgcagagaagttcagaggctctcaccttcacgcagggcctggaggagtgactcagagattttgccccggggaaaacacagtccataaaacagagttcccaaaccctctccaagaaactaatttttatttaaaacgtaatgtgaggtagtgcaaaaccaaaggcaatcttgatgacaaagaaaattttgggggtaagtatttaagaggaggctggtatatatagcagagcaacaaactaatccttaggccaattagcttactggagagaaatggggaaaaaagcagctaagaagagcctgggacaggaggaaagtgttaaaacatatctcaaatactagcctcacaaatgactactttggctattggcacagtagtttatctcagaattactgtctttaaaaatctggagaaaatataaaaacataactgaaggcaccagaacatgaccaaagacaggaagaaactgaagaagattcaacccttgaaagaagagaattgcacctagtgagtagaattttttattgtatgactattgcttgagggtaatttctggtcccccgtgcccttttgtgtttgggttgctagagatcaagtacaaagttgcaatttcactggcttaatagagtgtgacaataactgaaagaataactaaaagatgaggggggaaaatactagggcaaatactagaaaggaaacagctgtttgatgtagctcaaaatgctacaatttaggtagttaggcagttagacaggcatgagtggggctggcgagggctcttccctcgtccactaggaatgtcaggtgatggttccgcaatgatcacctggcctcgctaaaagtgattcacggccgggcgcggtggctcaggcctgtaatcccaacattttgggaggctgaggcgggcgcatcacaaggtcaggatgttgcgggacaatcaaacaggagagaccgacaaggttaaggagagcgctttattattaaggtgatcaccggctcagtcagactagggtccaatcaccttttaagctgtttgtggcgggagttacgtgctacgggaagagtacttgcagaagcgagaacaaaggcagttaatcattcttttacatttgttacaccacatgtcttacatccttgggaatacatgtttttgcaacatttgcttatcatccttgtgacttaacagctgcgctagggagagaagcaagaacacgccgtgcctcaaggaacgtgaaatgatagaacacagataagcctctctgggcacagaggagaaacaagcagttaatattctctcaacccaggcccccgggtggggctatattgcattctacctttaaggaaaagaataaatttcttggctattataaaattcattaattttcccttcaaggagatcgagaccatcctggctaatagggtgaaatcctgtctctactaaaaatacaaaaacaaaattagctgggcgtggtggcgggcgcctgtagtcccagctactccggaggctgaggtgggagaatggcgtgaacctgggaggtggagtttgcagtgagccgaaatcgcgccactgtactccagcctgggagacagagggagactccatctcaaaacaacaaaaacaacaacaacaacaacaaaaagtgattcactggcagtggcaccagagagaggccaattcctgatggtccacactgttgcacgaaagtgttaattggatgcaggcaccagggagatgcaacttcctgggcatgttcattaagagacaaaatggcagagtatgaccttccaggggcagttcatcagaaaagtgaagaaagcctcacatggacatgcctacaacttcctaaacacactgtgcgccctcaccttccaagggtaaggagtactttgcatgcaggcagcccaccctaagggagtagtattgagaaagaagacagtctgtgaagtcttaggatcaaggttgaacatcgcacttggccttcacatacccacttggatttcttccaaacgtaccttcctttttttcctgttctaaagaacctttttaaataaacttccgctcctgctctgaaacttgcctgggtctctgtttctgccttatgctgctcagttgacttatttcttctgagaaggcaagaattgaggttgcttcctgacccatatggattcacagccagtaactcggatacctaacacccctaagaaaaatctttacccagctccttaactaatacagaaatagttcatgtataggagagagcatgaggatatagaaggaagcagtagccgcaaggctgagagagcccagcagagactttagctgctgtacactctagggaaggcagagtttagagtagtaatccttccatgtcatctgtctgctaaaggcagaatcaacattctttataaaaagaatccaaaggctcaatagcctatcattcacaatccatttttttaaacatggaaagaaataagaaaatgtgatctacatgttaattttgcactgagctcataaatgttttagccatttctgatagcagagaaataattaaaaggagccaatatcaatatatttaaggagttaaaaaaaaggctagggccacatgaattaacagatggggaacatccatggataaatagaaactataacaaagcaccaaatgaacattttaaaactaaaatttgtattatctgaaatgaaaaatttattgaatttgcttaatattggattagagaaggcaaaagaaactatcagtgaaattgaagtcatataaacagtaatttataaagtactgaaaatacaggagagaacaagtttgaaaataaaatggagtctagatgtcctaggataggagataaagaatagggcagaaaattgtacttaatggctgacattttcccaaacatggtgaaaagtgcaaattacacacaaaaagctcagcaaatccaaagaattaatacaaagtcaaaattgcaacttaggcatgttagctcaagttgctccagtttgtacaaccccaccattgtgcagaccgtggtgagagtggaaaattccactagggttgggaccatgagaaacatcctcctggacaagtcccaggcctaaccgcctgaccacaggaaattcctccttatcagcagccaacctcgctgcccaccccatttcacagtaagcccagagcttcccccgccctagtctgtaaacgaaggcaggctcctgcactagctggtgtccgcctccgcaggtctttgttcaataaacctgtgttgctgttgagctgccaactctctcactctttcttttaccttcaccttcgtttcagagccttacaatgcatatcttaagagataaagaaaatatcttaaaagcaatacaatatcttgtattctatacaagagaataactgtatgaatggtatctgacttccggtcagagaaaacaaaaaggtaggctggaagacaatgaaatgatatcttttaagtgctgaacaaattaccatgaacaacaacagaaatataaaacctgtcagctcagaaatatgttatccatcaaaaatatttttaaaaaatgaaacctaagtaaaaaaagatatttctgaatacaaacctcttattttctttgagtttcaataataattcatttcagtggacctgcatttcagtaaatgctaaaaaaaacacaactgaagagaaattatactgaaaactacactaagaataaagagcaccagatatggcaaatttgtaggtaaagtcttatattttctccttattttttaaaatacacaatttttaaagcaacaattataacacataattataggaaaaaaaatatatagagagagagatatatatgtatatgagtggacacacacacatatacactataacataatggcctggtaaggatatggaaatatagtatgacaagtttttgacattttataagaagtgttacaatattaattctaggtggactgcaataaattaaagattcaatcccaaggacgttaataaaaatggaatgtataaagatatagtcaatagaaaaattaaaataagatattaaaaactttcagttaactgaaaagaagacagaataggaagtaaattatcaataccagatgggataaatagaaaattaataacatgataaacccaaatccaaccatataattgttataataaattaaatggcaataaactaataagtgcatataaaaggtagacattttccaaatagataagtctcaactacagactaatataagagatgtactttaaatataaaatgttgaaagcaaaggtaaaagatgaaaagcagtatgttgtggaaacaaaaagtataagaaatttggcctgattataataatatcagacagaaaaagtcaagatgggaaacattaccagagataaagaaggggatttcataatggcaaaaggaaaaatttatcagaaaaatatattaatcctaaatatgcacatacttaaaagaataattatagttggacatttcaaagattctttataaatacttgatttaaaaaaaatctcaaattcttattaatgatacagaagttgtgaattaaattattaaccactgctatcatttgtatgtttgtctcctccaaatttgatccgtattgttgaagttgggatctgatgggaggtgtttgggtcatgggggtagatccctcatgaatagactaatgttttggggtggtggtgagtgagttccaactctgtagtttccaggagagctggttgtttaagagtctggcacctccagtctctctcttgcttcctctcttgccatgtgatctctgcacctgctggctccctttcacattcctccacgagtggaaacagcctgaggcttttgctagaagttcaagcttccagccagcagaatcttcagctgctgctggcatttttttctttataaattattcagtttcaggtatgcctttatagcaacacaaatttacttgtaagagacccacactcagtatacttcagaatacactattttttcaagtacctttgaatcattatatattttcagaattgaatcaaaataccctatcttttcaactacatttgaatcattaaccaagggtgataacatgctgggctacagaatatatctcagtaaattgtaagagtttgaaatcttatagagtatgttttctgaccatgataaactcaatggaaagcaataaaaataaagtatggaaaaaagtcagacatatttggaaattacacaatgcacttctaactcacccaagagccaaatgaaaaaaacaagagaaattagaaaatacttttaacattaaaaacattaaaaaaaaacaggaaactgttaaagcagtgcttagggaaaaaattacagctttaatagcaattatgagaaaataagaaaaatttaaagttaatgacctaaattcctatctgtaagaagatagaaataaaaagataaatttcaataaaatagagggaagtaaatacacatcagcaaataaattatttaaatttctaataagagaaatcttttataaataaaaatgttgattttttgaaaagataaatgaaataaataaatgcctggaaatactgatgaagtaaaaaggaaataaaacaaacattaccaatatgataaatgaaatagaattatataaatattaaaatgattataatagggtgagcgcggtggctcacgcgtgttatcccagctctttgggaggccgaggcgggcggatcacgaggtcaggagatcgagaccatcctggttaatgcggtaaaaccccgtctctactaaaaatacaaaaatttagcgggccatggtggccggcccctgtagtcccagctactcgggaggctgaggcaggagaatgacatgaatccaggaagcgggagcttgcagtgagccaagatcgcaccactgcactccagcctgggcgacagagcaagattccatctaaatatatatatatatatatatgtgtgtatatatatatatatatatatgtgtgtatatatatatgtgtgtatatatatatgtgtatatatatatatacgtgtatatatatatatgtgtatatatatacgtgtatatatatatacacacacatatatatgtgtatatatatacacacatatatatacgtatatatatacacatatatatacatagatatataattttattctaaaaacctagaaaaactggataaaataaactaattcctagaaaaacacaattttcctaaatgagaaacatttgaatagaaaaccagagtagtcctcatatgtattaaagaaattggtttcactggcatattctatgaaacatttaacgtagaaataatgctaattctacataaactctctaaaactagagagaaagaaacacattccaagtaacattaagtggccaaagtaactctgatactgaaatctgacaaatatattttaagaaaatatgattacaaaccaatatttctcatgaacatgattgtaaaaattattatattagaaaattaaatcaagtaatatgttacaaaaataacatatttgtattaatagatgcattggaagaatgcatgagagtttaaattgtttaaaagtcatgcatcaatacctaattcattgagagtttttagcatgaagggctgttgaattttgttgaaggccttttctgcatctattgagataatcatgtggtttttgtcattggttctatttatatgatggattacatttattgatttgcatatgttgaaccagccttacatcccagggatgaagccaacttgattatggtggataaactttttgatatgcggctggattcggtttgccagtattttattgaggatttttgcatcaatgttcatcagggatattagtctaaaattctctttttttgttgtgtctctgccacgctttgttatcagcatgatgctggcctcataaaatgagttagggaggattccctttttttctattgattggaatagtttcagaaggaacggtaccatctcctctttgtacctctggtagaattcggcagtgaatcagtctggtcctggaattttttttggttggtaggctcttaattattgcctcaatttcagagcctgttattattggtctgttcagggattcaacttcttctttgtttagtctttgcagggtgtatgtgtccaggaatttatcaatttcttctagattttctagtttatttgtgtagaggtgtttatagtattctctaatggtagtttgtatctctgtgggatcggtggtggtatcccctttatcattttttattgtgtctatttgattcttctctcttttcttctttattagtcttgctagcggtcaatcaatcttgtggatcttttcaaaaaaacagctcccggattcattgatttttttaatggttttctgtgtctctatctccttcagttctgctttgatcttagttatttctttccttctgctagcttttgaatgtgtttgctcttgcttatctagttcttttaattgtgatgttagggtgtcaattttagatcttcctgctttctcttatgggcatttagtgctataaatttccctctacacactgctttgaatgtgtcccagagattctggaatgttgtgtctttgttctcattggtttcaaagaacatctttatttctgccttcattttgttatgtacccagtagtcattcaggagcaggttgttcagtttccatgtaattgagtggctttgagtgagtttcttaatcctgagttctagtttgattgcactgtggtctgagagacagtttgttataatttctgttcttttgcatttgctgaggagtgctttacttccaaccctgtggtcaattttagagtaagtgcagtgtggtgctgagaagaatgaatattctgttgatttggggtggagagttctggagatgtctattaggtccgcttggtgcagagctgagttcaattcctggatatccttgttaactttctgtctcgtggatatgtctaatgttgacagtggggtgttaaaatctcccattatgacaaacccacagccaatatcatactgaatggacaaaaactggaagcattccctttgaaaactggcacaagacagtgatgccctctctcaccactcctattcaacatagtgttggaggttctggccagggcaatcaggcaggagaaggaaataaagggcattcaattaggaaaagaggaagtcaaattgtccctgtttgcagatgacatgattgtatatttaaaaaaccccatcgtctcagcccaaaatctacttaagctgataagcaacttcagcaaagtctcaggatacaaaatcaatgtgcaaaaatcacaagcattcctatacactaataacagacaaacagagagccaaatcatgagtgaactcccattcacaattgcttcaaagagaataaaatacctgggaatccaacttgcaagggatgtgaaggacctcttcaaggagaactacaaaccactgctcaatgaagtaaaagaggacacaaacaaatggaagaacattccatgctctcagataggaagaatcaatatcatgaaaatggccatactgcccaaggtaatttatacattcaatgccatccccatcaagctaccaatgactttcttcacagaactggaaaaaaaaaaactactttaaagttcatatggaaccaaagaagagcccgcattgccaagacaatcctaagccaaaagaacaaagctggaggcatcacactacctgacttcacactatactacaaggctacagtaaccaaaacagcatggtactggtaccaaaacagagatatagggcaatggaacagaagagagccctcagaaataatactacacacctagaaccatctgatctttgacaaacctgacaaaaacaagcaatggggaaaggattccctatttaataaatggtgctgggaaaactggctagccatatgtagaaagctgagactggatcccttccttacaccttatgcaaaaatcaattcaagatggattaaagacctaaatgttagacctaaaaccataaaaacgctggaagaaaacctaagcaataccattcaggacacaggcatggacaaggacttcacgtctaaaacaccaaaagcaatggcaacagaagccaaaattgacaaatgggatctaattaaactaaagagcttctgcacagtaaaagaaactaccatcagagtgaacaggcaacctacagaatgggagaaaatttttgcaatctactcatctgtcaaagggctaatatccagaatctacaaagaactcaaacaaatttacaagaaaaaaacaaacaaccccatcaaaaagtgggcgaaggatatgaacagacacttctcgaaagaagacatttatgcagccaacaaacacatgaaaaaatgctcatcatcactgaccatcagagaaatgcaaatcaaaaccacgacgagataccatctcacaccagttagaatggtgatcattaaaaagtcaggaaacaacaggtgctggagaggatgtcgagaaattggaacgcttttacactgttggtgggagtgtaaactagttcaaccatcgtggaagacagtgtggcgattcctcaaggatctataactagaaataccatttgacccaaagatcctattattgggtatatacccaaaggattataaatcatgccactataaagacacaggcatgcgcttgtttattgcggcactattcatgatagcaaagacttggaatcaacccaaatgtccatcaatgatagactggattaagaaaatgtgtcacaaatatacaacatggaatactatgcagccataaaaaggatgagtttatgtcctttgtagggacatggatgtagctggaatccatcattctgagcatactcgcgcaaggacagaaaaccaaacaccgcatgttcacactcataggcgggaattgaataatgagaacacttggacaaaggatggggaacatcacacactggggcctgtcctggggtggggggagcggggagggatagcattaggagatatacctaatgtaaatgatgcattaatgggtgcagcacaccaacatggcacatgtatacatatgtagcaaacctgcatgttgtgcacatgtactctagaacttaaggtataataataataaataataaaaataataaaaagtaaaagtcatgcatatataatattaaaagaggaaaatataaatatatcattacctcaataaatttaaaaaatcatttgaaaattttatcatccattcatgatttaaataactattagcaaattacaaataaaaataaactatttcagtctaataaagggcaatgattaaaaagtacgcatgtaacattagatttcatagtgaaatattaactatgcagtctttaaggtcacgaacagggcatggatgactactctccatcttctatttaacatgttacaagtcttagtcagtataaaccacaaagtttggataaaaagaaatagaaatgcgtctatacacagagaacaagatttacttcccagaagttttatggaacctacagaacagctaataataactaatgaatagagtatttttcagaatacagtatatatgtacatatagtcaatgaatttttatatgcaacagaaacagtttggaaaataaattttaaaaatttcagtttcaacttctctttaagatacagcagttacatgtgcagatttgttacatgggaatatatgctgctgagctttggagtatggatcctgtcacccaggtagtgagcatagtaccctataggtcatttttttagccctcccaccttcctccatcctctagtaacctacagtgtttattattctcatatatatgtcaatgtgtgttcaatgtttagctcccttttgtaagtgagaacatgcagtatttggttttctgtttctgcattaattcgcttctggttatagcctccagctccatccatcttgctgcaaaggacatgatttcattcttttatatggtagcatagtattccaagtgtatatgtatcacattttctttatccaatctataattgatgggcacctggattggtttcacgtttttgttcttgtgaatagcacagtgacaaacacacgagtccatgtgtctttttggtagaccaatttattttcttgtggatatatacccagtaatgagattgctggattgtatggtagctctacttgatgttctctgagaaatatccacactgctttctacagtgactggactaattttatattctcatcaccagtaaataagtgttcccttttctccatagcctcactagcatctgttgttttctgacattttaataatagccattctaatgtgagataatatctcactgtggttttgatttgcatttctctgatgtttagtgatgctaagcattttatcttatgtctgtaggccacttgtatgctttctttggagaagtgtctgttcatgtcctttgcccattttttaacggggttattagttaaattctcaatataagacatttgtcagatggatagtttgtgaacatcttctcccattttgtaggttatctgtttatactgtttatatcttttgctgcaaagaagctctttagtttaattcacttgcgcttatctagatatttttgttttcattgcaattgcttttggagacttagccaaaaattctttgccaaggttaatgttcagaagagtactttctaggttgtcttccaggatttttatattttgaggtcttacattgaaataatttttgactcatgatttaaaagaactattagcagaggtaatttttgaatatgctgaatggtaggcatccagcttcagcctactacatatggctatccagttatcccagcatcatttattgaataaggagccctttctccattgcttgtttttgtctacctcatcgaagatcagatggttgataagttggtggctttatttctgagttttctattcttttctattgatctatatgtccgttttcattctagtaccaagctgttttggttacagctgctctgtagtacagcttgaagttcaggagtatgatgatgcctctggctttattattttgcttgggattggtttggctgcttgggcttttttttttttttttttttttggttccagaggaattttagaattttttttttctaattctgtggagaatattgtttatgatttgataggaatatcttttttaaaaagcacaagtatgaataaatttaagaaaaatgtaaattagttctactctagaaactacagaataatgcagatagaaatttttaaaaagttaggtaaatttaaaatattatcatgttcgttaattgaaagacttaatttttttcattttaattcttcccaattgattcagtccaaatgtcttgatcttaatttcatcatgtttttaaaaatagaaattggcaagcaaattctaaaattgatctggaaaaatcgaaatatttctaaaaatttataataatgttagaggatacacatttgctaattttatgatttattataaagtactgtaatgaaaatgagctattgtgataaaggtatgcacatagattactgcaacagaatagagttcagaaataaacctacacttaaatggtcaattgagcatcatttacaggggtgccaaagtaattcaatagtgaatgtaaaggcttgctgccagattgtgatgagacaactaagtatcactatggaggaaaaaatgaattttgaatcctcacatcataggtaaaattgaattcaaaattaatagacccaaatgtattttttaatggaaaagacaataaaaatgccttcatgtcttgagggttgggaacgttcttaggtcacaaatagcgtagccattaatttttttaaaaaatcaataaagaaggctttataaaaattaagatactctcttcattaaaaatggaagttaaaaaaataagacttagatgggggagaagtagcctccaaacatacatcaaactaaagaattatactcatacatatatttgttcacatatatgtattacatttatacataagtgatgaaatgattaaaaggcaatcaatcctatcttttaaaaaatataagaaggcttaaatgggaacataataattactcaaaaatcttacagattcacatcaatgaataaggagaaaaaactgatataatcttgttttgatttttttctctatacaaaatttattgttcaaacttaaaagttaaatgatagtagctgaaaattaaaattgaaaaataaatcgttgttgggttttttccccaagatggtggaatagaggctttgccagcatgacttatttacctgtaaatagtaaaacagtatatagagattcacattacgaacttttatccatgaaggaacatggggtcacaacataaaagttaaaaaaccattgaatgcttttaaaaataaggcagaaaacagctcacatggcatgtacagcagaagattgagagtaaattctcaatgcataagaaggaaaaagaatgcctttgcaatgcacattcccactgggaagctgggcaactcaggccacaggggaactccttgaccctgctaagccctcggtctgacctggggagcaatcaggagactgtgaggaggattgatactaggaagtgccctgcatgcattcccagacccacatgccaatagaagaccattctttatcctttaattcataggtgactgcacaggaagctgccagcaagcacaggctggagtcactggtttggagactaactggatgggaatttgtgatgtagtctcaagctggggagaagccttcataactagaactgagaggtaaacgtagcataagctccagcgatggacatgggagttggatgtccccacttttgtgagactggatcaggagaagtttagcctgagaactgcagttttgactcaggcagcaaattttttggcctggtgcagtttcacggtctgaagacaaactgcttgtgacttggctaactggtcattcttgctgccagtgtcaggctgtgggagagagccccactgggtcaggagcaggagagtaaagcaggctacactaccacctgctagtctctggagcctgagcttcccctctttccccatgctgcatctttggttcatcagtagttgctgtgctcttctatggaacattattctaggggcctgagaactgccttccaaccacttggaaggctgccacttgtccccactattggccatctcagccccatccaacccaccctagaggcagagcataggactgggaccactgagagttccagggcctaaaccatagcctgggacactcaggtacttctcatggctaacaaagggcaagcataagccctattgccaccaatgcagctgactcccacctgaaagcacaaccttcttgcctggaggtcaacttgcacagctcattacaacatctgctgataccaattcataacatttgcaaaggagacaccctttgcgtgatcttctgctaccttcattgcccattgcaccccagctactgagaaggccttcagctcactcatcctcccagtacattgctattacaactggcatttgaggaagccaccacactaaggctaattataaccaaggaaatcatacagagtatacaccactgaatgcatccagaagaaatgccaaataatcatactttttttcttttaactttttttttttttttgagaaggagtctagctctgtcacccaggctggagtgcagtggcatgatcttagctcactgcaacctccttctcccgggttcaagtgattctcctgcatcagcctcacaagtagctgggtttacaggcatgcaccaccatgcccggctaatttttgtatttttagtagagatggggtttcactatgttggccatgctggtcttgaactcctgacctcatacttaatatatatcatagacacagcctcacataaaaaagtgccatcccaatgaaaagtaaatacaaaagtaagaagtgactcttcccacatatgcaaataaatcaatgtcataatactggaagtattttttttaaaggtactattacacctctaaggaacacagttttctgtagcaatggataccaaacaaaaagaaatattcaaaatgccagataaaaaattcaaaatgctgatttaaaagatattcaaaaagatacaagataaatctgaaaacccatacaaagaaatcagaaaatcaattcaggatatgaatgagaaatgtaccaaagagatagatatcttttaaaaagataaacaaaacttctggaaataaaaaatttgttgaaagaattacaaaatacatttgaaagcttcaacagtagaatagaccgagcacaagaaagaatctcagaatgtgaaaacaagtcttttgactttatccaatgagacaaaatgaagaaaaaagaattttaaagaataaacaaagcctttgagaagtatggaactacatgaaatgaagtaaatatatgaatcatatgtattccagagggagaagaaatgaaacatctggaaaatctatttaagaaaaagctttcttagtctagcatgagatttagacatccagatacaagagtcccccaaaattccagcaaagtatattgcaagaaggacctcaccatgacatgtagccattagactctctaaagtcaatatgttggaaaaaaatttctaaaaccagaaagagaaaagcgtctcattgcctacaaaagaaaccccatcagactaacagcagactcttcagcagaagccatactggccagaaataattatattttcaaagtgcttaaagaaaaaaactgtcaactatatattctgccagaataaccttcatgaaaaaaagaagaaataatgtgttgggcgacaagcaaatgctaaggaaatttgtcaccatgagactggtcctacaagaaatgcccaaaggtgttttaaatatagaaataaaaagttgataccagccatcataaaaacacaaaattataaaacttacaagttatataaagcaattacacaaaggaggaagataaatggcaacatgagaaaatgctatcaaaccacagacaaacagaggaaaaagagaaacagactcaacaaagcaactaaataatgcttaacattacaacaggaacaaatcctgtcagaactaaccttgaatataactggatttaatgctccacttaaaaatatagttcggcagtgtggatttaaaaaaaacatgaatcaactacatgctgcttacaagaaactcagcttattggtaacagtatttataaattgaaggtagagcagtagaaaaagagattccacacaaatgaaaactaaaagaagctatacttatatcagataaaacagacttaaaatcaaaaacagtaaaaaaagacaaaaaggtcattatataatgataaagggatcaatataacaacccaaaatacatatgcaccccaaactggagaacccacattcgtaaaacaaatattattagacctaaggaaagggagagacagcaatgcaatcatattgggtgacttcaataccccactcatagcactggacatgtcattgagatagaaaatcagcaaagaatcacttaacactttaacaggactttagaccaaataaacctaacagacatttacagaacattctactttacaaaagcagaatatgcattgtcctcagtgcatggaatattctccaagagaggccatatgttaattaacaaaaccagtctcaataaattgcaggccagacacggtggctcatgcctgtaatcccagcactttgggtggctgaggcaggtggatcatgaggtcaagagattgagaccaacctggctaacactgtgaaaccccatctctactaaaaatataaaaattagctaggcatggtggcacgcacctgtagtcccagctactcaggcggctgaggcaggataatcacttgaacctgggaggctgaggttgcagtgagctgagattgtaccactgcactccagcctgatgacagaacaagactccgtctcaaaacaaacaaacaaaaaaaagcaaaaaaaatcaaaattagattaaataacttcttgaaatacagcagtataaaactagaaatcacttccaagagaaactcttgaaactataaaaatacatggaaattaaacaacatactactgttgttgtgtcaacaacacaattaagaagcaaaattttaaacattttgaaacaattgaaaatggaaataaaacgtaccaaaacctttgggatatagcaaaagcagtgctaagagagaagtttattgcattaaatacctacatgaaagaaatagattataaattaacaacctgccattacctcaatgaactaaaaaaataggaacaaataaaatccaaaactactagaagaagagaataaccaagatcaaaacagaactaaaggaaattgagaataaaatataagggctcaacaaaataaaaaattggttgttaaaaataaacaaaattaaaagaccatcagttggactaaccaagaaaagaagagggaagatttaacaacaaaagcaaaaatggacaagtgggatctaattaaatttaagggcttctacacagcagcagaaattataaatggagtaaatagacaacctatggaatgggagaaaatatttggaaactatgtatctgacaaaggtctaatatggaccgtctataagaaacttaaatttacaagagaaaaacaatctcattaaaaagtaggcaaaggacatgaaccgactcttttcaaaagattataaacatgtggcaaacaagcatataaaaaaagctcaatatcaatcatcatcagagaaatgcaaatcaaaaccacattaagataccatcttacaccagtcagaatagctattattaaaaagtcacaaaataacatgctggcaaggttgccaagaaaagaacatacctatacactattggtgggagttaaaattagttcaaccattgtagaaagtggtatggtgattcctcaaagagctaaaagcagaactatgattcaacccagcagtcccattattaggtatatgcccagaggaatataaatcattctaccataaagacacatgcacgtgaatgttcactgcagctctattcacaaaagcaaagattaatcaacttaaatgcccatcaatgacagatcggataaagaaaatgtggtacatatataccatagaatattatgcagccataaaaaaagaacaagatcatgtcttttgtgggaacatgggtggagctggaggcttattatacttagcaaactaacacaggaaccgaaaaccaaataccacatgttctttcttacaagtgggaattaaatgatgataacttatgaacacaaagaaggaaacaacagtcatgggagtctacttgagggtggagcatgggagcagacagtggagcagaaaagataactattgggtactgggctgaatacctgggtgataaaataattggtacaaaaaatccccattacacaagtttatctatgtaacaaacattcatatgtacccccaaacttaaaataaaagttaattaaatgagaaatagaaaggggtctcctttacagttgataccacagaaattcaaaggatcatcagagactactgtgaacaactatatatacccacaaatcagaaaacctaaataaagtggataaatttctgggaacatacaactcccaagattcatgcaggaagaaatagaaatcctgaatagatcaataacaagtaatgacactgaattagcaataaaaaatctcccaaccaaaaattcccaagactggtcaaattcacagatgaattctatcaaatctacaaagaaaaactggtaccaagcctccagaaactcttcaagaaattcgaagagaagggaatcctccataacccattttacaaacccagtattttgatgtcaaggccggaaagggacacaacactaacaaacaaaagtaaactacatacccatatctctgatagatatagatgcaaaaatcccccatatctctgataaatataggtgtaaaaatccccaccaaaaaactagtaaattgaatccaacagcacatcaaaaagataatataccataatcaagtgggttttattccagggaaccaaggatgggtcaatatacacaaatcaataaatgtgattccccacataaacggaattaaaatttaaaaccatataatcatctaaatagatgcagaacaagcatttgatgaaatggagtatctcttcatgacacaaaccctcaacaaaccagacatcaaaataacatacctgaaaataataaaagccatataaggcaaacccacaacccacatcatactaaatgaagaaaaagttaaagaatttatcctaagaactggaacaagacaaagatgcatactttcaccatttctagtcaccatagaactagaagtcttagccagagcaatcaggcaatagaaagaaataaaaggcatccagattggaaaagaggaagtcaaattatctgttagttgacaatatattcttatacctaggaaaggctaaagactcctgcaaaagctttctagatttgatacatgactttaataatgttcccaaatgaaaatcaacaaaaatatcagtagcctttctatatacaaatgatgacaaagagatacaaataaataagtcaattatgtttatgataactaaaatattaaagtaactaggaatatatttaaccctggaggggaattatctctataaggaaaattacattacactgatgaaacaaatcatagatgattcaaacaaatgaaaaaaacatcccatgatcatggattgcaaaagttaatgttgttaacgtggccacactatccaaagcaaagtacagatttatgacattcctttcaaaatatcatcatcacgttttacagaataaaaacaattctaaaattcatatggaaccaaaacagagcccgagtaagccaatgaaattctaagcaaaaagaataaagttggagacatcatattagttgacttcaaattatactacaaggctatagtaacccaaacaacatgatcctggtgtaaacctagacctatagatcaatgaaacagaataaagaacccagaaataaagtcacgtaactatagtccattgatatttgacaaagctgatgaaaacatacactggaaaaaggataccctattcaataaatggtgctggccgaactggattgccatatgccgaataacataactggatccttatctctcattatgtacaaaaattaacttaagattaattaaagatttaaatgtaagacttgaagccataaaaatactaaaagaaaacttaaaagaaatcttggatatttgcctaggcaaagaattcaaaagcaaatgcaacaacaacaagaaaatagataaatgagacttaaactaaaataatcaacagggtcaacagacaacttgcagaatgggagaaactatttgcatactatgcaactgaatagagactaatatccagaatctaccaaaaggaaaaaaaccattataaaaagatatctgtacttgtatgtttattgcagcactattcacatgcctttggtattttaataccaaattcaaaacatgtatagaactggaggccttatcttaagcagaacaacttagaaaatcaaatactgcaggttctcacttaaattgtgaactaaagaatgtgtacatatggacataaagtgtccacaatagacactggagtctcagaagggtcagaggtgggtgagggatgagaaattacgtaataggtacaatgtaagttattcaggtaacgggtacagtaaaagcccagacttcactatacaatatatccatgtcacaaagctgctctcacagcccttaaatttattcaaataaaaaataaattgaaaaaaataaactcaaaaattaaaagagcagaagtatataataactttaaaatagtctggttttttttgaatttgctttgcaatttacaataattattttgagaatggagtgcatattatgtgttaactattaaaataaaatgcagtaaattttacccttgtgctattagtcataaaatgcctttttttttctcattggttttcaataacaaaaaacctcatttgattcaacttcacctacatatgaataaagtagccactatcttttaagggaattgggcttcaaacacaactggacaatttttacatattttaaaagaaaagcgtgtctatgaaagaaacacttctctagaatgaacatttttacaaatacaaaaaaagaagtttcacaccctttctacaaagatgaaatagagaacagagcctaccagtatcaatcatacagcctcagttttctaagttaaaagacaagaatgtatttattcaaaatgctcaatgtaggaccaagacaaagaagacatgcacacatgcacaaacacatataactatgtaaaataaaatttaaaactgtataatatagacattaaaattaatgcttttatatatctatatgttacataaattgacaaatttatgtactttatgtaatcaattcagaacatcgtcaagatcagattcagatatgtgagatatttaaacagatctgaaaaaatgtaccacctcaaataacatctgttaataagttctcctgtgtaataactgctttcaaagtcctttctgttgatctctgggttcattcaagtttatactatcaagtgccataaaaagaatacaagatcagaaagggtatccattactcatttgtttatttagcaaacttttatggaacacttaatgctatactctgtactatgcactgtgaatacagacataaatatttaaaaccataagtttaagcatttcaatacagaaataactaaagtttaactaattctaagggaaataagtgttttggagtgtaacaaattcttaatggctaaaagcaatgctttgcaagtcacaaaagaaaaatttttactgatagataaaatggggagaatagaaaacattgtattacctgttaatgtgacagacattgttaaataacaatgtgattaaacaatttttttcacactctcaagaactgtgaagcttcagaaattttgctgtaatcacaagctaagagtaaactcataagcatttcaaggttttatggagattggcagaagaaaaaagacaaggtaagagaaaaaggacctgattaactctattactcacggcagagcaggtagcatgaggttcataatattgtgtttattccccttgtctaattgatggtgatacatataaacatagctaaatgttatcttattaatatccttgttgtattgaaatatagtgcccaaataattatctgcaatgctaattttttatgtatgtatactggaggtttcttaaatatatacatacacatacaaacacacacacagacacacacacacacacacacacacacacatatatatatatatatatattttttttttttttttttgagatggagccttgctctgtcacccaggctggagtagtgcagtggcgcgatctcagctcactgaaatctccacctcccgggttcaagtgattcttctgcctcagcctcccgattagctgggactacaggtgtgcaccaccatgccaggctaatttcccaggacaatgtggagtaatccaagtggatgactctttggttcattacaacattcatgaagagggaattttcagtgtcaaagttcattgaacattgatgcatttaaatatataatctcaccacgcaaactgtggtaattgttattacaagaacaaaaatgacaaattgtgaaacaaaagcaacaatcaaaatagtaacatattttaagtatgtatatgtggataactattctaccaaaattcaaaacaaaatcaattagttggcagttagaagggagaggtgaaaataacgagggcattattattttatctttctcagagctgaatacaaaatatgcacattggtgcatatttatttgaagaccaatttttcaatgtggttccatatgtctcacaatgtatttaattgactaaacagttctacatctaataataaatcctacagaaataattgcatacccttatatgaaagagatttaaaaaaaacttcagtgaaaaatatttcgcaataacaaaattctggactcgcatgaaattctaaacaagaatttggacaattgagttaaatgtgtttgcactaatggaacatgtaaaaaatatatcaggaaaaattttagatgtattcatattataattccacttatatctgtactttgtttaattttaatgagtattctaatataaatgtaatactatatatttatatgtatgtactatatataaatatatatacatatataaaataattgctacatttatctttcttatacagcaataaaattgtatctagttgcagggttcatgagtggcaatctaaattatatttctataatataatctatattataatataattataatataatacttataattatattataattataatataatacttataataatattataattataatacttataataatattataattataatacttataatactctcattgaaagtagatttgggaaggtgatgacattgtcccatggaatatgacttcacatctgaggctagcaagtgaaatatcggttatgactcacctgcaatttcctcctcctggattttggagctatgtttcatgaaaataaagcaaagcttggagggaagggaagaacaatgattgaatgacttcacgagttacagctgttccacaaacctgggcaggtcttacgaccatcaaatattgaaaagacagaaaaacatctaactgtaatgccataaaaccatctatcacaaatccacagccaaaatagtactgaacggggaaaagttaatagcattcccgttgaaaactggaacaagacaaggatgcccactctcaccacttctattcaacatagtactggaagtcctagccagagcaatcagaaaagataaaaaaaaataataaagggtggtaaagaggaagtcaaactgttgctgtttgctgatgatatgatcaaacgtttacctagaataccgtaaggatgcctccaaatagctcctaaaactgataaataaattcaacaaagtttcaggataaaagattaatgtacacaaatctgcagctctgctatacaccaacagcgaccaagctgagaatcaaattaagaactcaaccccttttacaatagctgccaaaaaatataataaaatgcttaggaatttacctaaccaatgaagtgaaaaatgtctgcaagggaaactacaaaatactgctgaaggaaatcatagataaacaaacagagacacatcccattctcatggatgggcagaatcaatattgtgaaaatgaccatactgccaaaagcaatctacaaaatcaatgcaatgcccatcaaaataccaccatcattctttacagaactaggaaaaaaatcctaaaattcatatggaaccaaaaaaaagcatgcatagccaaagcaagactaagcaaaaagcacaaatctgtaaccaatagcaaagacttggaaccaacccaaatgtccaacaatgatagactgggttaagaaaatgtggcacatatacaccatggaatactatgcagccataaaaaatgatgagttcatgtcctttgtagggacatggatgaaattggaaatcgtcattctcagtaaactatcgcaagaacaaaaaaccaaacaccgcatattctcactcataggtgggaattgaacaatgagatcacatggacgcaggaaggggaacatcacactctggggactgttgtggggtgggagggaggggggaggggggagggatagcattgggagatatacctaatgctagatgacgagttagagggtgcagcgcaccagcatggcacatgtatacatatgtaagtaacctgcacaatgtgcacatgtaccctaaaactttaagtataataattaaaaataactaactaaataaaaattattcaaaaaaaaaaaagcacaaatctggaggcatcacattaccttacctcaaactatactaaaaggccatagtcaccaaaacggcatgatactggcacaaaaataagcacatagatcaatggaacagaatagagaacccagaaataaagccaaatacttacagccaactaatcttcaacaaagcaaacaaaaacattaagtggggaaagggcacactattcaacgaatggtgatgggataattggcaagccacacgtagatgcgtgaaactggatcctcatctctcaccttatacaaaaataaactcaagataaaggactttaagatctaacattataaaaattctagaagatgacatcagaaaaacctttctagacattggcttagtcaaagacttcatgaccaagtacccaaaagcaaatgcaactaaaacaaagataaatatatgggacttaattaaactaaaaaactctgcactgcaaaagaaataatcagtagactaaatagacaactcacagaatgggagaaaatcttcacaatctatacatctgacaaaggactaatattcagactctacaagcaactcaaacaaatcagcaagaaaaaaaacaaacaattccatcaaacagtgggctaaggacacgaatagacaattctctaaagaagatatacaaatggccaacaaacatataaaataacattcattatcactaatgatcaggaaaatgcaaatcaaaaccacaatacaataccatcttactcctgcaagaatggccaaaataaaaaaaatcaaaaaataatacatcttggtggggatgtggtaaaaaggcaacacttttacaccactggtgggaatgtagactagtaaaaccactgtggaaaacaatgtggaaattccttaaagaactaaaagtagaactaccatttgattcagcaaccccactgctgggtatttatctggaggaaaagatacaaaaaagatacttgcacacacgtttatagtagcaaaattcgcaattggaaaaatatggaatcagaccaaatgcccattaatcaatcagtggacaaagaaattgtgagatatatatgcatacacacacacacacacacacacacatatatatatgtgtcatggaatacaactcagccatgaaaagggaggaaataatggcattttcagcaatctgaatagaattgaagaccattattttaagtgaagtaactcaggaatggaaaaccaaacattgtatcttttcactcataagtgggagctaagctctgaggatgcaaaggtataagaataatacaatggactttgggaacttgggggaaagggaggcaatagggtgagggataaaagactacatattgggggccaggcatggtggctcacgcctgtaatcccagcactttgggagaccgaggtgggcgggtcacgaggtcaggagatcaagaccatcctggctaacacagtgaaaccctgtctctactaagaatacaaaaaattagccgggcgtggtggcgggcgcctgtagtcccagctactccggaggctgaggcaggagaatggcgtgaacccgggaggccttgcagtgagtggagatcacgccactgcactccagccggggcgacagagtgagactcgtatcaaaaaaaaaaaaaaaaaaaagactacacattgggtacagtgtacactgcttgggtgatggatgcagaagaatctcagaaatcaccacttatttatgtaaccaaatcccactggttacacaaaacctattgaaatcaaaaaagaaaactaactctacattatgtaggtcaaataattatgaggtcttgttaaagcagcttagctttccttaaaaagaaaaaaaacatgaagttgaatcacctatttttaaaaaagtatgaaagggactatgaagtgatacagaatataaatcacagtgaggatttgcatgggttttaatgcataaaattatataaaatagaaatatacagcacaaaaaaaaacccggataaacatgggggagcccacacaaacacaaatgaagacataccctttaataaactatttagtcttcagcagattaagtaaacaagtgtaagtataagatgtgagtaacacgtatgcaggcctgaaaaaatgagtactgtcataacttgttgacccaacaattcttctagcttaaataattggttggtttaaaaaattaatcaggcatgtgtgcaaaaatgtacctgcatttagcagtactgcgtatgacagggaaacccttaagacactttatatccaaagcaacctattctgatattcagcttattttaataaagcaaaatgcttgtttacctctcttattaaataattcagacccaaatctttttgctttcagttccaaatttaatccttttactcccaattccaaattcctggggaaggaagtctgatctacccaggtttgataaaactacctcattttgttgggatacaattgtccatgggtctctcatgtttctgcatgtcatgtgcccagagtcaatattctggacaatcttcacaaggatgtttgtcttccttcagcgtaaatgacagatttgttagctatttgggaaaaaaaaagtctccctcaagggcaaaggctgggcaagtttgctagtatatctcctataaaagattaggattacctaaacttggattttccagctgtgatgcaaactcactacatgtatagcatctacaaggactgtctgcattgtcctggaaacaaggagaactaaaacaaatgtgaagttgtgatgcctgctgtgccatgaaaaatcaagtccattgtttctgactcaagtatcccttagatcctaccagaatttatgaaactttagcaatctaacatgcaagtttacaaaaagcagaaaatagcagaccattcccagtttttgacatcgtgtttaatttgaatattgtattaatgcatagggcaaagatgattgcctggcatacatgcacacatacacacacacacacacacagcagtaagtaatgtactaaattatctatgtgcaatggaaaatacagatgaaaatataatatgtttttaaaaagtctggaaaaatgatgaccaaatgggtacagtaattatctttgagtgttagaattttctttgtttcctattttgtcttttcaaataagcatgtatatttttataacttataccatctcatttgaaaatgtgaaatccttacaattgtgatacatcattaaagtgatattagtcatcacaatgttgtcagtaatcaaacactgcatagggcatttcttccaaatcactatcctaagcttaaaaataacatttgatggagttcatttcttcagcatttttctatatccagttagatgacattacaccttctttatataaatattttttctctctttatattcttttgtacatctatacatttgctcatattttaaatattttaattatttatattcaataggctaccaaattgttttaaataataactttgctgctaagtatacccctgttaggaaagtcagaatattatttaccataatcacttctaggtgttcttgaagcaatgaaggcaataacaaaaatattggctgtaaattgtatagtccattaaaattcaagataagaagtcagattgtatgaaggagctagatgccacatatgaaaattcgtcctagaggagtagtatgtggtaacacattgttctcattacaatgtaagctatgcattaatatgatggaccatttattttaactttgtggcatgaaaattaataaatcatgagcaactgcaaactggtgattttttctttaggcatattttcaaaatatttttaacctggtttttttctggtgctcttcagctaagtcttggaatctactgtgtgacttatgatcaaattgtgttttttacttgatatatacagaaattgtccctcaaattaattttccaaaatatgaagaatatgaaaactttactttgcaggaaatatacttctaaaaataagtatttccttttagaaaagagggggaaaccaagaaaatattttaataaacacgtcttataaatagggacatgattattaatgattaaattctcattgtataaatgacaatttgtagatacagaattaagtaatttgtctaaggttagacaggtaagaattaatagggtcacaataaaatccatgtcttctcattatgtagatggttttccacatggcatttcatagctggtattgtcatgttcatagtaaccctgtatccactcttaaaatgttacaacccttcctcttctaccacatctcaggtggaaaaggagagtgccaagcatgggccatcccttcacctgcatagggcaccaattcacctcagcctttcattagccacggaccaaatccttcatccagttaaagggtagccaatagggacctcacaaggagtacagaaaaccaagaaacctggaattgggcccttgagccgcttgctctggcccactcccaccctgtggagtgctttctcactttaataaatttctggtttagctgcttccttcctgtgtttccttcctttgttactttgtgcagttttgttcaattctttgtccacaacatcaaggacctggacaactcatagtcaccaccttgcttcctgtaacaaaaagacactgcgtaaccttaaatagaagctcacttgctcaaagagtgctctccagaatatgattggggcagattgccatttacttcatgttgccatgttttcttgtggaacatttatgcaaatgctcacaggaggttggagatagtttgaattatggtcaggacaacttattttatagttcaaaagcagcagcctggtcttcactttatgaaatgatatatgatataggtgctgccacctcgaataaacctgaaagttacacagggattctgtggacagaaaaagagtattgccttgaaagaaaaatgccgtaccgtaagacagagctacggagatttttgcagaaaatacaattttctgacaaggttgtctcatcttgacaagacatgaattaggtgttaatactgtaattaggcgtctcattactaataattaaaaagacattgtttacctcaaaaattgattgcaccaatatttgatttacaagaaaataaaggctttaagacaactgcttcaagcagaaagcaacattgtattttaaaagttaaacctagaaatgcttgtttttagaaaatagaaaatatatctttgtattaagacagttgacactttcattgtgttttaaactccctgttttatacatgtggcttatatatgtgtgcccacaatagtgtgtacagggttgaattttgttactaactttctttaataagaggaaaaaaacactaagaattgcaattcaatagtttatgtattacatgcatatcaagatgaaaatctattaaaattggtcaaattactctgctatgaccatgaccattaaccaagaaacactgggtttggcctagtcttaggcatcaccggaaaatgtaaagaatataatgaatcggctcattcttactctgtccagtttaattctacagaaacaaggtaatacaaaatattcatccaagagtataaaatttaatgagaaagattttcagatacacagatatgatgcaatataaatattctaagtatgctattctaaatacgctatgctattcctcagaaccttttcagacttgcgcccctccgaagtcaggttgtctcttccccgaagtcaggccatctcctcctctaccaaatgagactccggtctttataggcacaggatggggagtgcattctgactggtttgtgaatatgcaaaaatggttaaagcaaagacaccactcaaagttgggcacaacagtgtggagaaacaattaggaaagggtaggtatatgtaaaataggtgaagggtggggattgataagaggaaagtgcaccgaacccagaggacaagttctcaatctggtccaaggatttaactcgtaacttggctttcaggctttaaggtgccttcagcttggagatggggtttcactaggtacctgtccctatctgcctaggcatttggctgcctcctgctactatcaattccataacagaaaaagacatgtagcaatgtgtgtgtgaaataaaatagtgtgtgaatgtgagtctaagaaatatccttaacattctcagctatagaatatatacgagctgtagcatatgaggcacaaaaggtaggtggagtatacttcataaagtgtcttagttaaagagataagagtgtttgtggaagcatgattaatctacttcagaaagatagctttagcaccagtgtgaaaatgatttgattgtgaggatcctggtgatgttaaaggacgaggaagctggaggaaggaagttgggggattatggaaactttatgttcagcaacgaattaggatcctgcacaagcaaggaatgttaaaggccagaattaagacaatagtgaaacaacaacagaggaattaatgttctggaagcagtgaatgatcccagtggaatttctgaatattgtgtatatttgtcagaatgtagcaccaactatgcaaatgttcttgcaccaaaaacttgcaaaccacaaaggcaaccccttaattactaatgccagttagtgccactgcagtaatttcctgagtaagcaatgagttcatttctctggcaagttatctcaaagcatggaaaggctgaggcatttcaggacccacgccctgcaaaagaaactgaaatgctctaaggtaaaacagaagacaactatgcaacaagagagccaaattctcaaaggcaatggagtgtagcacagtttgcatccaaagatcaaattcataaagccacacatcaaaacaactattagaagaatgcattctaaaatcatccgcaacaccactgacacagtcaaaatattcataaaccaaacaaaacaatgttcaagcacccacaggtccctatcaatcttttgaagtgcaaaacagccaaggaaaatgcatttttaagataagtgcacctaatatgactttgtaaagtaactttatgtcctaaaatgccagtgttataggtaataaatataaaatcaaggcaataaatattccttcaaacatgcagcagcattgagcagcattcccttttggtttccagaatatgatttccaaaactgcagcagggaaaatacttactttgaacctcctgcctctccaaatccaacataagctggtctggattggaacaattgtcacctatagtctcagcatggaatgtgactgttttcaagattcctttcatgatgctgtcagcgtgaaaacactcaattgtgtcctcagcttgatctttaaatgtcatttttaaaacagatttgaagtaaaagaataccattctctccatttgttcaaaaggagatatttccttcataagtttataaaagtctaggtgttaatgaattactcacctaatatagactccttaaggcatcagcagcagcttgcatcaggcgccctagggagtataggggacttagaaataaagaactatttacctataaatcttgtgcacatgttttcagaagggcaagacttgttcttggtttcaggtaaggtcaacaagcttaaaaaatgacaattcttggaatttctcagtgactctatgagacctatgtaacagccacttaatatatatgttaaataatgttttctgtgaaatttctttatatattaagaagggctttcctgtatttcttattccactggattcctggaaggggactatcccactttggcaaagctccatgaaacgaataaccttgggaaaatgtgcataaaaatgtattactgaaggcattatgttccaatatatgagcctttagtttctttgcttttcaggggctcacaaagctatatattttcagagaactaattgtgttcatttattgcaaattttataatagcaagctaaatatgttggtattttagaagatgaatttgaagaagtaaattgtagagatctttgagaggcaatgtggtctgcattacaatgatggtggtaaaataaatggaaagacttggaaagattcaagaaatgtttgatagacaatgacaagtaaattattgcatgtagtggatgagggagtacacaaagaaaacctcattgttttgggcttgagtaactgggtgattatattaataaccatgagaaaaaaagataaaatctagtacgggaagtattctaataagtgtcttttcccagataaggaataattgagaggaaaactttcctttttgactcagtcatggctttagcagaaggcaatatgacataatagatttcactgtcaacagacaagtttttaaaattttcatctagcagttgactcgtgtgtaatattagtaaagccatttgacttatttgaaacacattttctttctttctttttttttttttttttttttttttttgagacggagtctggctctgtcgcccaggctggagtgcagtggcgcaatctcggctcactgcaagctccgcctcccgggttcacaccactctcctgcctcagcctctggagtagctgggactataggagcctgccaccacgcccagctaattttttgtattttttagtagagacggggtttcaccttgttagccaggatggtctcaatctcctgacctcgtgatccgcctgcctcggcctcccaaagtgctgggattacaggcgtgagccaccatgcccggcctaaaacacattttcatgatctctaaaataaataggctgatgagaccaccccctctaccagttgctaggagaacaaaattagatcgtgtataaagtgccgcttgaaaatgtctatctagtctcaaactctcctgcctttttctagatgtgttaatatgtaggtgaccaaagcaaattgtattaatagtttaaagcagcagtccccagttttttttttttggcaccagggaccagatctgtggaagattatttatccatggactgggggtgagatatggtttttgggatgattcaagtgcattatatttatcatgtactttatttctattacaattacattgtaatatttaatgaaataattatagaactcactataatgtagaatcagtgggagccttgagtttgttttcctgcaactaaatggttccttctgggggtgatgggagacagtggtacctgaagtgtgttgcttacgtccagtctactccaaaattgcttttcagttgttgtcactgcagaaaaccgtgcttcacaaagatagcatgatggaaatggaagcaggcttctcagtgcttttgtggcaatctcaggatattctgccttgactttaatctgaaatgtatggagatttgaagttgtctcaaacatacttttaaggccaccatcatttgtgatctcaagagggtgatcctcttctagcacagacaaagttgattaacctggcttattcacaaatgggctgcagatccattccttccaagtttgggggttttctgtggctgggaagtaatgctcagatgcttgaaagctgagataggtgatgatgtaccaactgggagaaagaagaccctggctcagtctctttcaaaatctctgctaatgtttgaaacatgtcaaaaatcccaatgctcactcattgccctcataattcccatttggctttgaatgcctccactttatctgctgactggaacagttatcatttgcccctgacgtcacagcttgaattcgttgagcaggttgaatacgtcacacaagtaagcaagttttgtcacccattctgtgccactgagttgtgcttccagtggtgactgtttttctaaaagaaatctctggagtggctcttataactccaaacctctggccagtgatctacctttagaaagtcacctaacttctgcagataaaagaagaaacaagtgctctgcctccatctcctcacagagctgcatgaagagacgtgtgagttaagggtgtatagtttagtgtggttgataattttaatcacaccctgcaaaaggttaagttcaggtgacatttttgagttagccagcatttctctatggatgacacagtgtgtaaactcacattcagaagcaatctctttgatccaaatagtgaaaccagaaagcagtcaagtcatggtagccgctccatccatccatatattcagcacaaaaaccaattcagttttcctggcacgtaatcattcaaagacttggatagttttgcaattgcgatattggttggcaacaaaagcacacataacatgtgttcatgcacctcctgaaaaatatgttgcataaaaacaagcattgttgccttgttatcaacattggtacactcctcaacctggattgcataccatggtgattcattaatcctctctaacaattgtgccttaatatcctctgccatttcaccaatttgtctacttatggttctagctgaaagaggaagacgttgccaccttttgaactgcagcctctctgagaagttcatgacaaatgtccttagcaacaggcaggatcaactcttcaccaatagtgaagagcttcttggctttagcaatgcagttagcaactaagaatgatgcgctcagtgcagacacatttgatgaagtggtagtcttcagtaattgcttctgttctttacgttgatatttttttttcttttgaaaaactccaaaggcttgtattttaatgcaggttgcttggtctccaactggggaagcagttttgaaggtttcatgcctttgttggatagctggttgccacatattatacaaagtgggcttggagaaagtgaatcgcctgtagcaatgaactcatgatttaagtaggactcttggtattttattttaaatgcagatttttgttggcagtcttagagtcttctgctgtctcatcattggctcttcccccttttcaaagttttccagtaatgtttgattttaactcattttggctagggttagcttgtgggtttaccaaaaccgtgactgagacaagtgcatagtgtgagaaaaaggtatagatggaagtggtaaataaaataatgagtggaccacatgtggactaaaataagtgtcagattctgacttaaatcctgccaccagatgtagcttgtcgcttgccagtcactaatagggatttgatatgagtctgcaagcaattgacgtattatggtctctgttcagtgaaacctgtctgctaatgttaatctttatttgcagctgctccccattgctcatatcaccacctcagctccaccttagatcatcaggcattaggttatcataaggagcttgcagcttaggtccctcacacacacagttcacaatagagtttgggctcctatcagaatttaatcctgctactgatctgacagaaggcaaagctcagggcggtaatgtgagtgatagggagtagctgtacatacagatgaagctttgcttgctcactgatcacctcctgctgtgcagcctagttcctaacaggccacgaactggtacctaagaggccatgaactggcacccctagtttaaggaatatagagtttttcctgcttacttcaaaaagagtgtatcaaaccaaagtccataccctttgaaactatgctatgaggcttttctcaaaattccatcatgtaatgtagaggtatatgggtctttacacttaggttcaaagttgatggaggccagaaattgtggtagaatgcttatttattgggccacactatgagagtcactacctcaaaagcctttagaaagattatgatacatattaaaatttctcagtatagaaattcctcaaaattctctttttcacattttctttgatgaatgcagagaggaaagagagacagagtgtatgtttgtgtgtgtaaaataagctcagacattatgaaatgaccctgctctgagctgttctgcctcttactacagttagttctgctataacaattgttttgaaaacacaaatttattctagtgtaatggatatattagggtacaatttaagcatggtgtgaatttcctgtttacttatgcatgaattcatccccgaggaacactaggtgaatgcataaaaccacttagctgaactgagctaggtaggaatccacaacagtgcaagcacaaacacccctcaagtatctaccagccgccttagctgatgacatgggttatgagccactcccatccacccctgtagttacagctttccacctgatttcaaataaccctcctttcaccacttcacaattacttgcaggctgaaaccttccaataacctctccctaaagcaaacttcacatctttctcaaggtaaaatacatatttcatgtatttttttacatatttatcaattccttaatgtatatgcaatgcacttttgaccttatcagtttatcattttttcaaatgtgtcccttatgaagttgttgaatgttatacacttcacctcatctccaccttaacattcacgcttttcattgtgtgattttgcatagcacagtacattttaggaatacatatgcctcacagcataattgactgtatctaacaacttgttcaggtaacatgatcctcttcagtactccctgtaaaaggttaaaaatagtagaatcaatctcagagctgttgacaaaattaaaatacgtgtggcgcatttagtatatgccatgcaatatcatagtacttaatacatgttagatattgtgataagcagtatgatagctccctgaaggtatccacacactaatctctggaacttgtgaatattttgtgttacacggaaaagtggactttgccaatgtaattaagactttggatattcaaataaagagtatcctggatgacccaggtaggcccagtctaaatacgtgaacccttaaaggcagacgattttcttaggatgaagtcagaaagatgcagcagaggaaaattcagtgagatttgaaattcttgacaagccattgctgatttgaagatgaaggcgggcaagtgatgtgggaatgtaggagtctttacggacaggctccaggataacagtcagcaaggaaaaggaaattagatttttcccttaacctcaatgaggttagaaccagattcttcctagctagctgacaccttgatttgggcctttcccaacctgaaatggagaagcaaaacaagtccatccatacttctgacctacggagttctgggatatgttttaaactgtgaacttttgggtaatttattatgggaacaatagaaaatgtaagttttattgctattaaatatttctatttttattaagggaagagtacattgctattgggaaaaatatcattttaaactaaaaatgttatattttaagtttttaagttaacaagtcagtcatcagttactaccttaagagcagcatgaaaggaacaaaagaaaaattcctgagagagaaaccttggcaagaaggagagatgttgcaggcaaactccatttgcctcacaaatgtgttttgggccagtctttctttatatgtcgctaaactttgttaaatatttgtatatacttcgggaggctgaggcaggtgaatcactggaagtcaggagttctccaccagcctggccaacgtgggaaaaccccgtctctactaaaaatacaaaaattagccaggcatggtgcgcatgcctatagtcccagaacgggaggctgaggcaagagaatttcttgaacctgggaggtggaggctgcagtgagccgagattgcaccacagcactccaacctgggtgacagagtgagactccatctcgaaaataaataaatagtatgtcaactccaagtcttgccgttagaaagaccataaaaggtttaaacctatatgttagtgtcctattactgctgtaacaaattactaaaacactagtgtcttgaaacaatacaaatgtattgtctcccagttctggaggtctgaagttgaaaatgggtctcactggtataaagtcaatgtatcagagggcatagggctactactggaggcactaagatagaatctacttcctcaccttttccagcttctacaggctgccagcagctgttagcttatagctccttcctccctcttcaaagccagcagtgcagcatcttcacatccttctctaacctctgcttccttcatcacatctccttctctcaccttttccttcctgcatccttcttatgagggtccttatgattacatcagttctacccagattatccaggacaatctccccatctcaatatccttaacttaatccttaagtaaatttccctgtgccctgtaaagtagaatattcacaggttcttggtattaggatttagacattttgggagggccatcattctgcttcccacagccagaaacaaatatatttctaatggaacacatgatttcttaaataattataacagttccattccagctatttctcttaaatcatatattcttgcagttttccatcccctagagtctctttttgcttcaggacatgagtagatagaacctcattaatgagacaataggctggaagaaaggttccaggtgaagactatactagtgagggggaaaaaacaaaaatactgtgtttttggactcctccaatattattccagttgttctacaaacaacacacacacataccagtctatctttctctttatcaatctatccatccatataactacctatctatttagacatttatttttcaaaatgatttatggtgcctcttttggtgtttaattttctaaatgtgcaaacatctgcatttttttatgaaagcctaaaatatgcatcataagcatgccatattattaagcatgttttgagatctaaaaccagttagtgctctgtaaactgaaaataagtaataaggtgtttttatattctctaagccaaatattccaacttacacttttattctacaactaattatcaagtgtctacaaagtgccaggctctattctgggcctggggatttagtaggaccagaaacaagaacaacaggaacaacaaaggctaacacaaatatctgtctttatggagctcacaattcaataagatagctgagcagtaagtaaataaataataaaacaaggacagtataatatgtcacttaatgatagtgctacaggagagtgaaaaaaggcaggaaagtggggctaggggcaggaaggttccaaaggaaactgcaattttaactatggtggccagagtcagatgctttgctgagaaagtatctgagcaaataaaaaggaggtgagagataaagactcaagagtatttcaagaaaagaatctttggtggaggaagtggaaaatcctagagcaggaaatgagatttattctttgagaacattaattccatcttttaactaatatttattgatggcctcaaatgggtggggcactcttacatcagtacacaaaataaatcccctttcttcaaaaaacttatattccaaggaataacttgactttcctttaatttattctactctgtcatttttctgaaaatgagggaaaatcaattttcctgtttatgaaacaagaatagcacgataagcccaaaagagaactttagagattatttagctaaaatgtttaaagtactaagaatcatttttatagaataatgattggccagtataatcaccacattgaaatcttggttttagtttgcttattgttagtttgaattttagttccatcgcatctaggccttacatttgtagggcttcagttggaaccagatgatatttggaacaaaactgatttcatgaagatgatttcctagagtctaacacccagtaaatgcagtcagtttattcaaacattacactgtttccagagtaatgtatgttgcacaaataaaataaatcatggatttagagagaagctgaagtgttgtcaactgggctgtaaatgtttcaacataataaactgtacagtagaatagaagtagctcaaaagttgaagatttcagtttgtgatgcagggaaaaaggatctgatttaggtaggaaagaaaagagaattttaatgatggaaatggtctaaaagaaatcgtatatattacggttgtcagtgtgacagatggtgagactgtatataataaagtcaaaagatattttgacaagaaagaagatggatctgacagttcagaaatcagaatcctgggcagtaaaaaatgagaaaaatataattgaatgtgtgctcagctgatacatagttaattttacacagcccaaggcaacagagtatgggaaatggtcagtagtgttagcagacttgataaaacgaagagaagaggagggataatgtgaaaacaaagcaaaggaagacaacattctaccacctgtaaaatagtattttcagtaaattatttgaaaaaaaaaaaaaccagaaactaacccatctgaatccattcaaaatggtcatttgaacaatacagggctagatttaaatgctattatactttacataaatatacaacatcccttaaagtaaaactaatttttttcacagctacaaaggaaatacatttcattaacactgtttcttaaaataatcctagaaaacaaggtctctttttgacacaggtatttgaatttccttggccattaacatcttgtaactaccattgttttcagatataattctatttaaacaaatctaaaaagtgatagattctttagaacatgaataagttatataaaggattacccctttttctttcaaaaagtgactgtgttattcgcctgatgttatgctaggcttccgtattgttatcacagggacactctcaagtatagcttaaaaatacacttgtccttcacattcttaatacttttaggtcagtatatctgtagcagcaaccccttatgttaaaacctggaaagggtaaaacataatggcttcatactgaaggtttcagaaggggaaagaaaggccctaaggaaaaaaaaaaaagaaactggtttaagaacacacagtgagcatgggcagagtggacacatcgaggcagacattccatctgtgtagtccatgctcttaacaactttgccataatgacttatgagccttacctgtgaaacattccttgtcattatccttgtcagtcacatgtgcatttacaacaggaaaacgagacaaatacctaaatgctttcagaagaaacccaacagtaggaaaaaataccagaaatgaagaatgtctctatgttgtttttgtaaaggacagagttctcagagatattttatgtgtatagatgaaactaaaaacggcactgcaggatgctttaataatctttattgcatcatatttgtgaaaattatactacatcactgccatctgtagtgatgcataaatcacaaggcaataaagcctcctaataaatcttacgcccactctcttcacattattgatcccttttatttgctgatgcaagaactcttccatatgttgatgcagcatccgtgatctatgtgtcattatcctttatgtctaatagcattttctataaatcaatatccttcctctttgaagatggtcctgcagaatgaattgctatatgcttgtgtgagcatcgctgaaagcctggaggtgtggcatggcttgccattccctcattagtctgaggaaatttgtaggtgatcgtttgtggatcttccatgggttttgtcacagcctcaccctgttaactctatgttcctagtgagtagcctcagcagttttagcctcatcactgcactgtgcctagtggtcagcagtcttggatctgtgcttatcatcagatacagccctgttccactacttgacactctccttaaccataacctcctggtggtcccacttctatcagcctccatctgctaacacatcaatcacagaggatttgtttgagactcttaatgtctcataatgttataatcattgttgtttttttttttgttgttttaacatttaatacaaggaaactgctatagtgagaacatatttagtgctgatttgatagtaaacttgaggagctgatttaagcgattgtaggtaaagtcggttatacactagttctctaacccattcaggctgagccacttacagaaaacccaatctgcagtgttgtgttatatttcttttgcctgccagcctctcaaagcatgtgcagttttgacagtttcttttgccttgcctgctagccaagcaggtgacagaacattgctgtaaaagaaactgctttggatagctttcaacgttaaatcactaatgtagatttttaatgttaagcaaaaagtccatggtgcaaatggaagtatgtctgccttcatatttcacagactcttagcctaatatgtgtttgatatgctatcaccttaaaccactaaagccatgtgctgctcaaacatcataaaacatacaatcctatttttctataaagaatagtttacatctgaagtcagatttattttgaaatttcacatgctaacacaaagcattaatgttgagtgggaaaactatagaatctttagaaaggtatcagaataacttcaaaatgaattcagtatttttatgtattattatatacatcatctgatatgcactgaaaggatgaaaccatttaataaaggttaaaaaatagcatttgtgagtcaataatgacttcaaaattaaaacaaataggtaacattctaataatacaagtaatataccacttttaagaaaaataatttgtaaaaggtggcttcaaattttgctatagaaattatggaaagaacaacttaatctcaaaatcttttctagtatacccaaataagctgactaagaatttcaactctagaaacttaacaaaaatgaaaaaacaaatcaaacaaaaactccaaaatacaccaaaaatgtaaaagtgtatatttattagggttaataaataaagaagaaagtaaaagaagagataacacagaatgcttcttccctctaaccacccatttctggtcacagatgggaaaatcttacatttaagatcctctctaatatagatgttgcttgtaatatgtaggatattaatagttccctttggaccacgatgttcttgacaataagtccagtaagtcctacaattccttatatccaagcagaaagttattgtagtagaaatgggtaatcaaatgacatttgattcattcattcattccactcattgaggagagggtttcatgttttgagttactttcctatcgtgttctcccagcccaaccccttcccacccatcagaataggggctaatcccccaaagtatcatatcttattgacttatttactcagactcagagaagcaatgatttaaggcattatgagctcaactggtttatcttcctagagaaatgaaggactgctaaaataagagtcaaaatattcatatgccctagccctattatgaatacaatattaaatttaactcatctattcaggcaaataaaaataatcattgtcattttgacttcaaagtgtcctctgacttactcctccaagtcttatttcagaactaaacagcatcaccatccaccaagacctccagcacagaggaagcaggagtcatcattgattctacttcatcctcaacgttcattttatatccatgtcttattgatttcaccttcagtaactgtttaatcaacctcttctgtttaatcaagctttttccttcttctgtttttacatcctacaatttcctgagagctctcctcataaaacataaaattaatcatgtagctacattgctgatacatttaggtggccttctaatgcctacaaattaaacccaaaacctttatcactatgcaatgtaaacaaaagtgtttcaacatgttccatttataatgaacacttaatgttacaggttcaaaaatacccctattcttcccaagtatgttgacttgacaatatccaagacttttgtctccctcattcttttccttctttataagttgtctttcatcttcttctctgccaaacaaaattcaaccaaccctcgagggcccaattcaaatctcactcttcttttatgagccttgctctatacactctttcccccacatcacctctttttctagaaattctaattatttggatgttatgatgtgtgatgaatgtcttttaacaatttacatgcctgcatgtaaatgagattctggagggcaaagaatatctaattcatacttgaatctcaatatttcacacattgcctagcactggagtttataaatatttattgaatcaagtaaaattctctaatcttttaaatatgcaaacatgatctatgtatcttatttaaataaatatggctcatgacttagtagctaactatagatagatattataaaactatattgtttaaagttctgtcatggtatatttctaccaaaatgttcagatagaaaaagaagagattcagttggaaatgctcttgtaaagaacacttttattctatgataaatagaagaatttatccctgactaattcaaccagaaaagtctttttgtagaattcaattctataaccctattcaatggagttaatgattgtttcacatgagtgatagtaatacattaagatttatagaaggatgtgcaagaaaacatagccgaaagcagatataatatttaaaatataattcctgtagaacgaaaacaaaatctataagacagggctccatagaaacataatgttccatttcaggctttcaaaacagacttacaaatgaaacatttcataaacaatgaataacatgcacttaagaacctcacacagagaaaaattgcaactgagcatgcatgtgtaatttgcactacagtaatcttactttttagcaaatgcaaggaatcctgtcaccgaatggtgagcaaagtgatgggtggcatactgatgttactgaaattctctccagaggaatatggatacaaaaatataagtgtaatgttttgtacatataatttttaattgccaacaaatgtaaataaataatttgaagcttgttttcatcaagctatcgatacgctctttagaagaagccactcataagactgaggaattagacatattaaattcttaaagttttatcttggaggtgggacgatgctcatatttctgcattgcgtaattatgctttttttcagagatacaatttccttcagttttctcacttgcacaaagcatggaattctggtacttaaaaaatttattagacttttagtttgttttatttctttgcatacatataaaccatgggttaccagctgtttacaagtttactcatgaatctcaactctcctgcactgacctatcatcaaacggtagccatatcacctaccagttcctcagggaacacatgttattgaagctacttttttctctttaaatgtgttacaagtagtaaactatataattattttccggaaaaacaatccttgaatttcttgtgaatgaagataaaaatatcagttgaattaaatagtgaaaagtaaaggtgagtcttgtttttatatttacaaagaaaccctaattaattaatcatcttagccaacaacatcttagcacacaatctcataacacaatgtttagacagtgacccaatcctagaacatagtatggacttcatttatggttactgaaccaaaggtgatgacatagattttgtaaaataactcagaggaataagttgtttctttacaaagtagcctaataagtactttgtccaaaacaacctacctaggtaccatgattcctgtcagctacatcatcacttctaattctatctgaagatacaattgaaaccactactgaagcaggaaatttccctgaccccttcacgggtggaaactggaatgcatgggcactggaactagctggctgcttcttcggggcggcaggggtggactcccctggctcagtctcactgcattccaccccttgaggaggggagtgcaggtgaacaggtgcaggagccagggcaagtgcttttgggcattggcaggagcaaaactttgtgcggaccctgtggcagtgtctagtgaggagtacccatgacccctgaagccccagaggatgtgagttacagtgtttttttgttttgttttaaacctgtgtaaaaaaaaaatgtaaactaataaatactaatagctttaaatacctaattcaatgtttcttctctttttatttattttttatttttttgagatggagtcttgctctgtcgcccaggctggagtgcagtggcacaatctcggctcactgcaagctctgcctcccgggttcaccccattctcctgccttagcctcctgagtagctggggctacaggcgcccgccaccatgcctgactaatttttttgtatttttagtagaggtggggtttcaccgcattatccaggatggtctctatctcctgacctcgtgatctgcccaccttgacctcccagagtgctgagattataggtgtgagccaccgcgaccagccatgttacagtgttcttttagttttgccatctgtggacagcttaagtcttaaacagctcagtgggccccctgccttttcacgtgtggtggttgctctccaccagcaagggcaaagagtcagtgtgacagtcttcactgtctgcacccatggctcctgagctcttgttcagtgtccaggaaaaatcaggtcttactaacgaattggagggtggtgaatgtggaggattttattgctgatgaaaatggctctctgtggggaggggagctggaaagcagatggagtgggagggcaatcctcccctggagttcagcagtccttggccagactcctctctgaagccacgttgtcaagttgtctctttgaagtcaagctgcttctcttggatatccagttgcttctcttctctgctctctgctgatggagcctggggtttttatgggcacaggattgggggaagagtgggccataggtggttttggaaaaggcaacattcgagtgggaaaacaggaatacatgttctcacattgggccacggttccaggtttgagggtgggacccttgccaaagacctgccctcttctgcccagaatttccctgcctcctatccttatcactactaaggctgtattgtatcaagaaacccaagtgagataaattatattattgcttaacaagtattcactttctatccccttctgtgaaaggaatatattccctacccaattgatgttgaacgtggctatgtgacttgctttttctaatgggatgatagtggaaattatgtgagtagaatttgaaatgtgcttgtgtgatttgacttggtctcctgcactttgatctttttttcataaaaaggatatgtctcagctatcttcagttttaagaaggatgagaaacaagtgaatgtagttcacagctagaaagcaagcctaattgcgccaaatctaaagtagctgaactcatgtcaacccatagatgagtaagaaatggatgcttattggcaagcaggttggtaagtagtttggtataaaagtaatcatgtttttttgtccgtaaaagtaatggtaaaaaccgcaataacttttgcaccaacctaatacatgccaatgagttttgattttttttttacacaatgttattatggatacaaacgactgatacaccaaggaataaaagcatttcatcaatacacaaggagaagaaataattttaaaagttacttaattgtgaaactattggtttaactggtaaaatagttgtacaggtgaaagtttagttttgttatgcatgtaaagacattaataacagaagattttgaaaagtaaagcatccagtgagaaaatataaaaggaaaatgacaaatatagaaaaatcttaggaatgttattggtgaaaggaaggaaaaactaagagtgaagcttgaaggggtattagaaaatggaagccttgttaaatttttgtttctttttttctttaaaggaataaatgatctaaatatatttacaattagaagagaaatatcaatgaagcaagagccctaaaatgcaagggagggacttattaactgatttcaaacaaagctttggctcagctgagttgtgaatgacactctgcacaaagtgaaagagaggaaacaaacttactctgagacaggaggaagaaaagagtaatgttacagataagttctaaagacataaggaagctgtgatcacctagatatgttgaaatgacaagatagatagcaaacaaaggcacttgtgctagatgacctatatttgccaacatgggataaggagattgcatgactgaatatcttggagaagagcacaaacaacttttacttttacttatttattttttttgagatgggcatcctgctctctcgccaggctggagtgcagtggcgcgatcttggctcactgcaacctcagcctcccaggttcaagcaattctcctgcctcagcctccgagtagctaggactacaggcacgcaccaccatgcccagctaatttttatatttttagtagagacgagttttctccatgttggccaggatggtctccatctcttgacctagtgatcagcctgcctcggcctcccaaagtgttgggattacagccatgagccaccatgcccggcgtgtatcaataacaaagatgatggtgacaagagcaaactgtctgaaaattcgatgttatttatattagtaatactacaaactcttagtcttgttaagattaattccaaaatgtgatcttaacgtaaattcgaggattcatttggggcaggcaattcaatgtctaggatccatttacttctgctttcctgtttttaacatagggcaactacagtttcatcttggagaaaagaaaatcatagattttatcaaataacctcatcttttacatgaacaagataactatttactttctctttaaaaataaagcataatgaaactggaccccttccttataccttatacaaaaattaactcaagatagattaaatacttaaatgtaatacataaaaccataaaaaccctagaagaaatcctaggcaataccatccaggacataggcatgggcaaagactacatgactaaaacaccaaaagcaattgcaacaaaagccccagttgacatatgggatctaattaaactaagagcttctgcacagcaaaaaacaaaaccaaaaacaaacaaacaaaaaaacaaaaaacaaaaaactatcattacagtgaacgggcagcctacagaatgggaaaacatttttgcaatccatctgacaaagggctaatatccagaatctacaaggaacttaaacaaatgtacaagaaaaatacaatgctatcaaaaagtgggcgaaggacaggaacaaacacttctcaaaagaagaaatttatgcaggcaacaaacatatgaaaaaaagctcatcttcactggttattagagaaatgcagatcaaaaccacaatgagataccatgtcacaccagttagaatggtgatcattgaaacgtcaggaaacaacagatgctggagaggatgtggagaaataggaatgcttttacgctgttggtgggaatgtaaattagtttaaatgttgtggaagacagtgtggcgattcctgaaggatctagaaccagaaataccatttgatccagcaatcccattactgcgcatatacccaaaggattataaatcattatactaaagagacacatgcacacacatgtttattgcagcattgttcacaatagcaaatatatggaaccaaatcaaatgcccatcaatgttagactggataaagaaaatgtggcacatatataccatggattactatgcagccataaaaaaggatgagttcatgtcctttgtagtgacatggatgaaggtggaaaccatcaatctcagcaaactaacagaggaacagaaaaccaaacaccacatgttctcactcataagtgggagttgaacaatgagaacacatggacacagggagaggaacatcacacactggggcctgtcggggttggggggcaaggggagggatagcattaggagaaatacctaatgttggtgatgggttgctgggtgcagcaaaccaccgtggcacgtgtatacctatgtaacaaacctgcatgttctgcacatgtatcccagaacttaaagtattaaaaaaaaaaaaaagatgttattacctcctggactggattgcagagaaaactgtaaatgttttaacacactagtgtttctactgccaaattcctgttagctcattaattgcattccatatacacctttgcaaatgtttgccctatagtctgtttataaacatcttagatatggcagaaatttaaaaaaaagtaaaagagataaaaaacaacattcatatgaattatactaatttatttttatttttgaattcttattttttgagggaatcgtaagtataaatttactgtatacctagtggcgtatagtaaaattgtaggcataaggataaaaggaaataataaacttcatagtgctcagcttcaaacccaaacctctaaataacaggacaggctcagatacctcagggatcaggcagataatacaaataaatgaaacaggcaaaaaagagtacagtcttgccaagagaggcaatccctacttaactccaactgattgttctcgtttgaaaacacaaatcacaactgccaaatctgattgttcaggagaagccagaaattctgatgtataacgtgaaacctctagatttcttatatggtagcacaattttctctaaaacactaggtaatctaaataaagctgaccatctatcagtttcagtgctgtgttgtgcaaatgatgaatggcatatcccctaattgtggtattagactgcctctcaccagccacaatttgtaattgcaacaatggcatcaccagataggactctcctgctttgctatgcacacattcctgagccctggagaacaactaactctacaggaaaaagtggaaggctcatctaagccattcttgctagctttcatgactagctgctggcctacaggcaataaattcccaactgctcctgcaagtaggctttagggcctgggaggtctttatctggttcagaaggcaaggctgcttctcaaagcacctccaagtgctttggggcccctgttcagatggcaggcatttctggttaccagcacctgatgactgacaggagcagggcagtcatactcacatccaggagcttggtgcttaacagatggtacactgatttcacaacatcatctactctggggatgatccacttggccaccacaatgatgctgctgacagtggttgaagtcttcttttcagcctctgagcccattgtcatggcaacaagtttttctctcaaagtgtgacaaatcttcaagatgacaatgcagtgggacatgagacccaaggcatcctagatccagtcttcattctccagaatgggctctatgccagagtgggcgatgatgacatcatctagttctaactcagagagctcagattgggtctccatggcacccaagagactcataatgggcttagaatcatagcgctgcagcaggtctcctggccagcagtagcgctgcactcaaaccaccaccaagactgcaaacaaagccagaaagatggtagccagcacgcttatggcaacaatcactgtggccttcttgcttctctgtggctcctgacttagtctcactcatatcctcctcataggctaaattttctgaactgtagatgaccagtcccatggcggtgggagcaagctatattaatttattttttaaagaaatgaagaagtattttttaaataccacaaaatatgataccttcaattacgtttaaaacaataaaacaaacgaaacccttagatgacaaatcctagtaacaatattatattgtggtgcttacccaatcacgaatcttctgcccatattgcagatattttaagggaaaaaaaaaaacaagtagaaacaaacaaaaaaatagatttactgctggccatatggagaaattctattttcaataaataatataattcagaaaagctttgttgaggactaaagcgaataagcactttgtaacctttacttctaagaaacattccttttattatccatgtaagttatctatagaaaaaaatatttctagcatgtttttattttttttttaagttttgtttgaagctttgaagtattccttagcaatttgtgtttggagagaaaaactagatatctggcatatgcaataggcacaacttttagtttgcaagtgttttgatgtgattttttccactgaaaatattgctataagagcatagaaatcagaataagttaaatcaatctccttataaaaaattttggggtttgtgtagacaatctgttgtaagttgtttatgactatttctaagtatttctgttagccatttacaattttttgtaaaagttgaggccattctgctccattttctctaagttctctctcaaggaaaaaataaattctacctaaaactacactagaaagtgtgtatatgctcgcacatgtgtccacatggggaagagtagagattggagaaaatgttcacacggacaggaaggggtattactgtgccctctcagaaataaagaacaaaatcaagaacactatgatttttcttaattttaatatatcttttgagtatttgtatatagtgacattctcattaactatgatttcagaacaataggaattctatatttattattctattatttttctattagttctttctctctaatatatgttgcacagaggtatgcttatataaacctaaatatgttaatgaggtgattaagacataatatgcactatattataagactgaagtgtctagtctaaatgacttactttatggtacagtataggttaagttttctgactttgttttttttgagacccagtcatgctctgtcgcccaggctgtagtgcagcggtgcaatctctgctcactgcaagctccatcttccgggttcacgccattctcctgcctcagcctcccgagtggctgagactacaggcgcctgccaccatgcctggctagtttttcgtatttttagtagagacggggtttcaccgtgttagccaggatggtctcgatctcctgacctcgtgatcagcctgccttggcctccaagagtgctgggattacaggcgtgaaccaccgtgcccggccagttttctgacctttttttctgcctcctgtgcactatcttatttatttaaatttggatagtgacacaactgatctgaaaattgcatgaatatactcctttcagataataatatatccatgagaagaaaaaacacaaaatttgaaaaaaattgtataacttatactttgtcttatttaagtatttctactacatagcaagtaaagtatatgagtttgatttcactttcttaaactgaaaggaaaatgattgtacacatttgaataatatattattgaaaccttaatggtattagggacatatcaaaaaagaaatatttacaattgttacaattgatggatagtgtctgacaaaagtatttattttttgacataaatgtagtttggctattgatgaagttgttaggtagcaatttactaatgtgtataatataataaccaatagatacaaattcctatttcatggaggatggaaataaagacaaaataaagaactatgatcacactgggagactgaaaacataagcatataattagattaattgaaatagagcttttttgagttacatatttcagttacaatcaaaccgatagcttagtccttgaagttctataaaagatgaattaaatctaatatatgcaattggttgtatgctcgaaaattagttactgaaattctcaagccctttctatattattacaaaggttttcttctgatagcatatactactggttaataaaaattcacagtaaattcactgaaaatataacaatttaaattttaacaattttgaaacattccacactggatttgaatttattctttccattcccttttcattacatgttttaagaaacttctatgaatattaccttttataaaaatgagatacttaaatacattacatataaatagaaatcatgtagttaaaaataaaattctatttttgagtattgaatgaacaatgaggaaactactgacttcctagaatattttagatatattcaaaataaaattctctaaagagtggttgaagaaataactgaaatgttaatttcttaaaacagtctttactcttttagtggtattgcactaactctatgactcagtgacaataaaactactttaaagtatttttgctagaatcattacagagtattggttacaaaagcttccccaaacttgttcctccctttggcccattctcgtaattgttactattttatcttttctgtagagtctttcctggtaagtcaaatattttcctgtttttaacattatatttctattgcgaaatgagtcctgcttgaggtatttctatatttttgaattagcagtgtttattaagtgcatatgccagttctcaccactgtgtcagacactgagtcaaggctggactatacacgagtgagcaaaatcagataagggaagcttactattgaagaagacagagaataaggtaatcacacaaagaaacataaaataaaaattcacaataattcctacaaagaaaaattgtataaaaatgtgagggacgtgtccttttctaggaaacagaagaatacaatttatcattttatattaccttatgatgtttcattgtgtattttcattttatattagtatagtttgcctttcaaattgtgtgtcacccaaattgtgaagaaacaatgtaatgtactattttttattcatccctttgaatctaggcacataaaagatgtgtctgtagcttactacctgcatgaagaccaatatcattttttgtgatagaaatcttataataatccactgtgatataaaaagtttctggatgtgcatctttaaaaatcataaaatgcatttctttagcaaaacagcctaatcaaatatcattgatatcagtattcttttcttttcctaattcaatattcagttttctttttttaactgtatgctctactttagtaaaagaccaagttttattgggtaaaatataatttatgatgttatataacggtccattttaaaccaaatgcaaccacgctttaacctggtagagaaaaacaatggtaattcattatccaatgatcattgcaaaacatttctctgaagcaaaatctggaaactttcacctctcttttcctaaagctgattcagccacaaagatggcatcacaagcttggcatttggtgtaatttcattttctgctgtcaccatcttgaaatttttaacatttttatcttggaatgtatgttttgcaagtgaggtctgataggtctgataggacaatggaacatgccagtgagcagagctgcttcctttgtagacatcatgcccagtttcttatgaacacagaattcttgtggatccacaacatgcaggagttcaggaagactcagatctactacaaagtcagagtgttgcatgaaccatcgagtaactgtgataaggaaagggagcactgacattctcaagaggtcacagtttccatttgagcaatacttgctttaactgtggaaataatgcaatgatgttctatcatgaatgaaaaactctccatatcctttatttgttttactcctctgtattaaccaaccatcgatgctcaaagccatggttccttttccttatagtctttctttagcttatcactatgctaaaggtatagaggttggtagcatgtgtactatcgagaatgaaataaaaacaattgtgttagtttgtgcagtatttccaccattctgataaggatttgatgtaatttagatatttgtcccctcaaaacctcatattgaaatgtgatctccaatgttgcagatggggtctgggaagttgttgggtcatgaaagggctggatggggctggatccctcatgaatggcttgataccctccctacagtaatgaatgtgttctcactctaatagttagcgtgtgtctgactgtttaaaagaggctggtacatttcttgcttcctctttccttgtgtgacaggtctgttcttccttcaccttgctccataagtaaaagcttccaaaagctttaacagaagtcaagcagatgttggtgccatgcttgtacaaggtgcagaactgtgagccaaataaacctcttttctttataagtaactcagtctcaggtagctctttatggcagtgaaaaacagactaatgcaggataaaatatgtgttgtggaattttggtgatgctactttcaagttaaaggcccttatatttgtataggaaatggcattgcacaatagaaaatgaacagtttagtctatgttcatatttgaaaattttaatttttctttatttaaaacaacaatagtggcaattttaaaaatatcatgacaagatgagagaaaggccatgcaaaaaaggaaaaagactcaaattttagtaattttttttaagatgtaattttgcccttgttgcctaggatggagtgcaatggcacgatcttggctcactgcaacctccgcctcccaggttcaagagattctcctgcctcaggctcccaagtagctgggattacagatgcctgccaccacatcccgctaatttttgtatttttaattttaaccatgttggccaggctggcctcaaacccctgaccttaggtggtcagcccgcttcagtctcccaaagtgctgggattacaggcgtgagccaccatgcctgtccagtaatttaacagtacttttttcttcctgtttgtacaagagtgtcctttttttcactctactgagctggacctctatagcctcagacaatcaaatactctttttcatcatacaaggtagatgggttagtcatgcaacaatcatttcagtcacatctcagtaaatttatgataatcactattttgtttttgaaaactaaaactattcactcacattaagaaattaaaaccatgctgtgatgccatttactggaggaacttgtaatatagtagtttaaaatctaaacaagagacaaaggtgaaaactaaggacaattgtctgtgtataccaaccaaggaagataattatttttatgagttaaactgcaggtttttctttaaagactaaagtttagcaataatgatcatgaccacatataaaataatttctatggtgctagtatcaaaatgttattaccagaaagatctgtttaggcatcttaatctctaatcgtatcagacagattgcatgtgtactaaagtattcaaatttattttctctatatcccagttgtacctattgttctttgctaggtaattccattcagaaccattacttttctatacaacagaagcacctagaataaaaaccttgattgctttcctgaataatattaaaaaatttctatttaccacaaaattctgtaaggaccttaaaacaataccgacattccttcaaattctcagaaattctaaaatgtaatttacataaatgttagggtcctagaataaccctattagggttccttcatccattttgtaggggcaggggaaatataaacaatactattattaggaaaataagtgaataggaaataatgtttttaaactcttattttatgttaatagttgttacacacattaggctaaggtgttaataataaaaaaatataagaaactcttagaactcattagcaaaaaatcaaaccaatcaaaaatctggtggggggtgtatttctagggagaggtaactaaatggtaattgctaataaaacttactgatttcttttcctagtcttaggaactttcttcaagcatttaaagtatgaagagaaagtattctttctcctcctcatcagaacccccagcacaatctacataatcacaataaatttacataaaatacagttatgagcagttctaatacatttcctaaatcttgaaatactttattctattgtttctactatattttcaaattataaaaaaaatatgagaatgaattatctttgttttatacttcagtattaggtcatggaatctacataatggttaaatgattattagtttcttgtatttcaaacactcattaaaagcttatatattctattcaccttggagaacaggtgatctatagaagcagagcaaaatagtttctgtgtccataacttttaatgctaatctttattttagtttactttggtacctaagcaaacctatattctagcataattaagcagaggagagaccatagagcacctacaccacagaacaaagtaaggtgatggctctactctggttgtcacttcccatatgtctgtgagacacattatcatacatgcctgtcattgcacagtaactttgaacatccagctaaaattccagagtctgtccagaaagaatatgtccactttttttttttttttttttactgagtctcgctctgtcacccaggctggagtgcagtggcatgatcttggcccactgcaagctccgcctcctgggttcacaccattctcctgcctcagcctcctgagtagctgggactacaggcgccagccaccacgcctggctaattttttgtatttttagtagacacggggtttcaccatgttagccaggatggtctcgatctcctgacctcgtgatctgcccatctcggcctcccaaagtgctgggattacaggcgtgagccaccgcgcctggccatgaatgttcttaatgacatctagcatgatgaatccttttcagaaggtttttgattgactttgtctagatctaccagagaaatcactgcctatgacagctgcagccttatgaaatgtatttcttaaataataatacttgaaagtcaaaattactccttgatccatgggcttcagaagggaagttacgttagcaggcatgagaacattaatattcttgtacatctccatcagagctcttgggtgaccaggcccctcgtcaataatatttttaattttttttctgctcagtaagtctgaaaaacggacttaacatattcagtaagcaaactgtaaacaaatgtgctgtcatccacgctttgttccattcacagagcacaagcaaagtagatttaacataattcttaagggccttacgatttttggaatggtaaattagcattggcttcaactaaaagtcactagctgcatcagcccctagcaagaggcaacttgtcctttgaagctttgaagccaggcactgaattctctctatctgtgaatgtcctaggtggcatcttctaagaaaaaggctattttatctacattgcaaatctgttatttggttaatcaattatgttagctagatcttctagataactttctgcaacttctacatcagcacttgctccttcaccttgtacttttatgttatggaaatggcttttttaaaaaattaaacattatgaagcaaccactgctggcttcagatttttcttctgcagcttcctcacctctttcagccttcacagaattgaagacagagagtcagggtcttgctctggattagagttttggctaaagagaatgtcatacctggtttgatcttctatccagatcactaaaactttcttcctaggagcaatgaggctgcttctgtttcttactatttacacgttcactggagaaccacttttaattttcttcaaatatttttttttatttgcattcaaaacctggctatttggtgcaagaggcccagatttcagcctgtcttgactttccatatgccttcttcaataggcttagtcatttctagcttttgagttaaagtgagacacatgtaactctttctttcacctaaaaacttagatatcaatatagggttattaattggcttaattttaatatttttatgtctcaccaaatagagagatttgaggagaggagagagctaaagaagagcgagtttgtggagtagtcagaacacacatttactgattgtttgccatcttatatgggtgtggcttatggcccactcaaaacaattacaatagtagcatcaaagatcactaatcatagatcactgtaacagatttaatgacaatgaacaaatttaaaatatagtgaaaattaccaaaaagtgacccagaaacacaaaatgagcacctactgtggcaaaaatggtgtcaataaaattggtcaaaacagggttactaaatacttcgctatcttgaagtgtaatatgatgaagtttgactgtacttaaaactgatcgagagagtagaatttatgttaaatgttcttcacatacacacaagtaataataaaggaggcagtagaaaaatttgggaagtgatggatgtggttatgtccctgatggtagtgatgggttcacaggtgcatacttattctcaagcttattgagttgtaaacattaagtatgtacaactgtttacatgtcaatcatatttaaataagacaattttaacaacaagaaagaaatactcccctgagaatttcaggacctcagagggaatggctccatgatgcacacagggagcttaatcgtgtcattcattcagtttttcagttttgtcaaagcttctcacattacgaggcaagtatgaaagccacaaaatcaccggtgataaaggaattaggttaactgcaaataagaaaatttagtagtgaatacggaagacttaagattaaaggatttagtctctttcctcccatactgtgctatctgctaagatttacttctttgtctgaggacagagtagacatctaaaaatgacctcatttgaattatcttctagtgaaatgagatggaaaccgaggtgacattcaagcagaaacaaaatgaacaaatgtgataaacctaagtttacagcataagactaatatctgctataaaattacattttaaagatttacttattttatagaaataagtctataatttttttgaaccttactggtagtgcctacagaaccatggggtgatttcataaatatgacatgtgtaggtgacaaaagacaaaaggcaccaggcccaatctaaaatgccttttaatttcacatctggccaaaccacataattgctacaattatgtaaatgaaagtctatatttggcaaacttccatataaattttattggttatagaaatagtaaataatgatttactgtcaattttcaattttttttctaatggtaaagagcattcttaactattgatatttttgaaagttatcttcacagaatggtccatgaaaagcagttctgattgcttttcaaagtatctgcagttattttacagtaaaagacatttttcatctcatgagatcaaacagcatggaaataacttaggatatttgtgaaaagtaagagtgttataaattcattgatttaaatatccaaagttctggagaagttacttgatttttttgtttattttattggaaatactatcacattacataagggttagaatatttagaattgttacaaaaagtgtcagaaaataattgataatcttaacttaaaaggaacaaagcacaataccaaattaataagggggaaatgataccaaagtactgctcttctgtagatgaaatacaagtggctatcaaactttagtgattgttacattactctaaaatagagaatactatcatatcattttctatttctagaataattctataatgcatagatgactctttgtaaaatttggtatacattctctacattcatgtctttacatgacattaaaatattgatgaaatatgtggcttaattggcaatcttggcctaaattaagctattacgaagaatcttatgtttctaatatttaaaaaaagcatattttgccattcaatgagctttagaaacaacacagtttttaagcaaatcacctagtagcattattgaatcaattctagttggtaaagaaatcagaaaatgggtcgtaaaccactggggctccacaccactaatctataaattcaattttccagttaaaagagacttaaatcccaagttgggtaagacttggagtgagaaacagatgctgcttgttttgtgcttctaagccaatacggaatctctggaggctgtattcaagagacccaatcaaggcatcttatcacctgcccaatattgggttattctagacattttctaagactcctctcacatgttcctagccaatatagtaactatagtacagtttcaatgtctatacgcaaccagtatcagaatttacggaagtagactaaaagttaaacaatctggcatttatattaacaaaattagttattaaaactttaatttagtaaaacttgaactaaaaacatgtatgtgtaccaaaatgcatgcacattatatatgcagattaaaagtaatgctagttttagagtgtatacactgaaaaaacagttcccttttaagaagaaataaaatatgattgagaaatttttatctcaggtacatttattttaaatttaaaaagtagagaaaaaatcactttaattatgcgaattgctaaaaaaataatatttgacaaaaattgcacactaaaagctcttaaacattatttccagatatactggaaagatttttcttctcagtattgccaaattatttgaaatagatgtttgttattaaaaactctggaacagttatgaaaaaatttctatgtatattttcttacttctctaaaactctcataagcagcatgaggggaaacagtgtgtcatgcaccctacagccctcgtttgtcctaatgggaagacagagtgcgctcatcatatttgataacattttcacacaatttcaaaaagaaaactgtttcatttttttctttgaaacatttctaaaaatacttcaatttagttttcctaaaaaattctgaaaaaactctctaagcatcacaatgactgttctgagatatgtataataaaaatacatgttattaataagatgttaagaaaaccaggattttaaaagtcagtacataaatgtcaatatacaaaatggcagtcatttatgggcttagtaggtgaatagtgaattaaaatgtgcaaaataaaaaatgcagtttattttgttaatgaatatttaactattttattaaagtgaaatttatataacaaaatttagccattttgagttgtaaaattcagtggcatttagtatatcataatattgtataaccatcacctctatcaaggttccaaaatattttcataaccttccaaaaatagactttactcattaaacagttacttaagcgacaatattttaaaacttgttagccactgtaatccagaaaaatggtaccactatgtataaaaataagcagttacttaagcaataatattttaaaacttattagccactgtaatccagaaaaatggtacccctatgtccaaaaatccagaaggggaaaatttcttatggtttttgaaatcttataaaggttctccattggcaagcattatagcttttgttttgttttgtttatctggaataaaatttgaaagcagctctaagtgtagagaagaatcaaatctgattcccttgaataaagtagagggatatatgttatacatttgatctcattccatttcattgcaagcatcacacatatccttaggaagtccttgagtagtagcctccaaaggctagagtgtaccttagggaatgcagaacaggcactgctgggatataagaagaaaacattgaaagttttatttctcatactttaaattttttatttgaagtattgctgtggtttgactagcaataccccaaataaaaatttagaagtatgagaaataaaagttgaatattgttacaagggcaattaaatttcagcatgagtttcaaccaaaactcgtgttgaaatttaattgcccttgtaacaatattaagaggtgggactattaagcgatgtttaggccataagggttccatcctcataagtggattaattaatactattgtcaaggttcattatctcaagaatgagttccttatgaaaagaagagtttgtcacccctactttgccttctctttgcccttcaccatgagataatgtagcaggaagacccttgccagatgctagccccttgatattggacttcctagcctccagaaccatgagccaatacatatatgttcattaaaaaaataacgcatctgtggtagtcggttacagcgtcataaatagactaaggtttgatttttaaacatttacaatataacactacagtaacacatttatgtgttttttaaaccaaaacaagtcataggagaacatgaataaagaatttaggaatcactggatgtctagtatccatcatgttgtttcatgttgatacctcttaagcattttgaattggctccaccacaaggtctatttttagcaatttccatacagactgtatataggctgatgtgcttttgtggaggataaagcaactttgtcagttcatccatcactaataatcctgatactcaaaatcctcctgtaggttgtccaatgccctttggcatagtcataaatatacatgcaattttatgattataagaatttggaaaacttaatcatttcaatttgctatggctgattaattctgctatggtctatggtactggaaacagaagagtactcagatttctggctgctaagagctttcctgcctggagctgtcttcctcaaagcaacagcttggggaatacaaattttctaccactacaaccactctgcaggccacccatctgtaactattctctgggtagaacaacagttagagtaacatacttttaagttagtttttgtgagtgtaaacttataactggatgatgaaaagcaagtaaaactactttgtaatttttggtaaggatcaatgggttatatcatctaggtccagagtaatttttaactaccgttaatttccagagaaggctttcccatagtcattccattagtccaatgcttatttgaaatcttttctcttctctgcatttttctttctggtaacccttatgttggcgtcatttttgaccttgtagttctgtaatcccagaatctttttggtttgtttttgttttgagatggagtctgactctgtagcccaggctggaatgcagtggagcaatctccactcactgcaacctccgcctccccggtcctggttcaagcaattctcctacctcagactccagagtagctgggattacaggcacgcatcaccatgcccagctaatttttgtattttggtagagaccaggtttcaccatgttggccaggctggtcttgaactcctgacctcaagatctgcctgcctcaggctcccaaagtgctgtgattataggcgtgagccaccatgcccagccctagaatcacttaatagcgccttcatttctctctctgatctgtttgagccattagtgtacctaggggaaagacatagcacattcagggatttacattgaaaattctggttctttatacttgtgctttagggtttgtgcacagaattagaatgaccttctttatcttttacaaagtctctcaaaaaaggaatacatgattgggagtgggataattgcatttgtcacttaaattaaaattctgtttttatgtctgctgatgaacatacactttgtcagttgttggttacttctctttgatgtttttcacatatttatttccaatatctgtcatttataccaaccaaggtagtcccaaataaatgtcatcaagaatacagtactgctaagagtgtggagaacatagatttctacaaactaactattggattagcagtgaaattgtactgtgtgatacctacaaagccaagaacattattcagggtaacttttgttcttgtgctacatatttaaagacatgtgattcaccaggaaatacaataaatgtaataataaacacacatcaacacatttcaaatatgctggcattccagctactctaagtaggaaagttatagagcagcgctccccaacattttttggcaccagcgaccagcttcatggaatacaatttttccacagacagggtgaggaggaacggtttcattacacctcagattgggcattagattctcataaggagctgcaacctgcatctcttgcgtgcacagttcacaatagggtttgcactcctgtgagaatctaaggcattagcattaattggcatttatagctcagtatcatctacattccaaacacttaacctaaagaaagttcaatttgctttttcaaaataactcatctatcattgtgttcccagaaggaagggtatctgtggatgctatggagctagagaagacagtgattgagaaaacacagtggaatctgaagcttctatatattgtaattaaccaagtgggcttgggaagaggagatcaaagtctaaaagagcaaaagaatgatagcatgtataatgtcacatactatttaaaattttttaattttttattgttttatgagacggagtctcactctgttgcccaggctggagtgcagtggcatgatctcggctcactgcaacctccacctcccaggttcaagcaattcccctgccccagcctcccgagtagctgggattacagggttgtaccacaatgcccagctaatttttgtatttttagtagaaacggggtttcaccatgttggccaggctggtctcgaactcctgacctcaggtgatccacccgccttggcctcccaaagtgctgggatgacaggcgtgagccaccatgcctggcctaatgccacatatttaactttgctccaaagattcaggtttggaaccatttagaaaattgtaatttcataatttaaaaaatatggtatacaagagattttatgggcaagtatattaaaccctagttcttatcaaaatgaaaatgagatatacaattacattaataaaaattgtaacagactattgatgtagattataccttttgtacaccatttgatcacctagctctatgctttctataaaatctgatttatttaagaccttgttacaacactcagaattttttaaaagcctatgccttctaatatcaaagaacatggactttagaactacttagattgttttgttgagtcagattagggcccacttgtttaaggcatagctaagcaagaaatggttaattacttacatttgaaaatttatcacatgtcaaatactgcaaagtataggtcacatacttgggttcttagtattcataaaaccatatgaacttcttctgctgcttctacaggttgaataattcaacgactattctaaaaaaaaacattttagcaagtcttgctaaattagaaaatagaaatctttaaaacagactgcagaaatttgattctgttgaacagataccatcaaaaactaaagcagatttgaacaacttggactagaaactatgaacaggaatcgatagcccaggttgtctactctggagtccacagtcacaatcactgtgccattgtgtctttttttcatacatattttgatttttaatatttgagtaactgctggcatttaggaagttagaggctagtacgtaatatataatagcaaatattttaatattgctaataatagaatgccttatagtaattcattacttatatcttttaatattattagaagtattataatttctaatagattattagagttgtgtttcattacaaaattttattttgtcatttgggattaatttgactacagaatataagcaattcatctttgcttggtttattttggaaaactccactttttgtgaacataatatctcttacaaaaaggttccaaagtaatttaatactttattatctagttatttttaaagctatattttgggaatattttgctgaaagctaaaattataataaaatagagagcaaaagaagtactttaggtcagcttctctgttacccaggtgtcaaatgataaattcctagattcttctattggacatagatctaaggagtaataggattagttagactgagaataaagaataaatgaaaaaagataaaaccatggctttgagtttagagcactgagagtagtaattttacagcaaataagagggaaagtaaaaaaaaaaaagctttctttttctgaaatattacagagaagctaaatggtaaataatttttttttactataatatgtcatccaaagaaaactactttagaaaaaaaagaaaagataagagctaaggttatacatttgaatgtgatctgcataaagctggatggatcagcttaaaattacaattttaaataaggcatagcagcataagaagaatttctaggttatttaaatttacattttagggttcttttcttctacgatgttggattggaggcttttagagcatctcatccacttggaaatagcaagataatgcatagagactaacactgtgagagtatatagaaggtatatgggaattcactgaaaagcaaaggacacttcagattttagacaagagaaggtgggtgatcagcatgcatggaggcattcggctgagaaaagtaggagccccagtacatgagaggggcagagtccccctgagctgcccctcccttcccatgccaagaacttggtgcagcagcactgtctctgctccacattctgacaaatttcgaggcacttggagcacctattcttctagattaggagtttaggcccctcctttgctgtgtagagaacttgatgcagtggcagttttcatgctacaagcctgggcatatctcctggcttttggtacacctgccaacctggattaggagcttgagttgcccctcccttcccatgcaaagaccttgttgcagcagtagtttctccactccttgcctgggcagagtttttccaggcatatggcacatttgctcccctggttttggagcttaagctgccccacccctcccacgcagaggagttggtggagcagtgctctttccactccacacttagatatctctccaggcatttgaagcaactatacttcccggttaggagtccacgtcacccctttcttccaatgcagagaacttggaggagtggaggtttctccactccacacccgggcacaagtctgggtgttgaatggctgcccccggactcctcattggagctggtgcttgcacctgcctttgagatacctgtaggtggacctgcctggtccagctccaggcagctttgtcccccactctggggctgagcacagagacaaggccacagggcatagcacagactagcccattgcctgaggaaactgagtttctcatggttaacaaagatcattcatatacccatctctttcagccactgttggctcctatctgtaaacaccacctatttgtctggaggtggaactgcacaacctaatagaaaatctgctgacaagagtgctcagacttgaggaacaacataaacttgccaagacctctgctatcacagccccatatgtggcagcaagtctgctcacactcccaggacatcactactacaaccaggatttgagaaagccaccacacaaggctatctgtaaccaatgaacttatactgaatccttgccatttaaagcacccagaaccaaagccaaagaaccctgcacaacatacattataatcacatcctcaaggatgtgactcattaagaaaaaaattaaaaataagaatagacagtttctccagatgagaagaaacagataaacaattctggaactatgaaaacaaccaaccaaacaaacaaacaaacaaacaaaccgtgttacaagccctcaaaggttactctaactcttcagcaatggatcctaaccaaaattaaatttttgaaataccagataaataattcaaaatgtgatttaaaaaaaactcagtgagatccaagagaaagttaaagctaacacaaataaatcagaaagagaatgactcaggatatgaattaaaaatccactgaaaagacagctttttaaaaaataaacaaacataacttttagaggaaaaaattattgaaggaattacaaaatatagttgaaagccttaacaacagactagaccaagcagaagaaagaatttcagagcttgaagacagatattttgaattaaaccagtcagacaaaaataaagaagaatattaaaatataaacactgcattcaaaaaatatgtgattatgtaaagtgtccaatcttatgagtcataggtattgctgagggagaagaagagtaaaaaggttggactatctatttgagggaatgattgaggaaaactaccttagtcttgctaaagatttaaatatccagatacaagaagctcagagaactccaggaagatacattgcaagatggatttcaccaagacatatagttactaggcaatctaaagtcaacatgaaggaaaaaaaatactaaaagcagcaagagtaaagtgtttaatcacctctaaaggacatctcatcagatgaagtggatttctcaattgatacctcagaatacagagatcatcaaagactactagaacagctgcatactcacaaacttaaaaacctagagaaaatggatacattcctggaaacatacaaccctataaaccagaagagactgtggccctatgttcagtcttaaagggaaaaaaactatcagacatgcattttgtatactgctaaacaaggcttaatacatgaaggagaaatagtctttttcagccaaacaaatgctaaggaaattcatcactattagactggtcctacaagaaatcctcaaaggagttcaaacatggagataaaagggtgatgcttgccatcagaaaaacacacagaagtataactcacaggtcttataaaataagtatacaattgagactgcaaagcgaccaggtaaaaacactatgacaggaacagactcacatatcaatattaaccttgaacatgtaccaagtgttcacttaaaagatagagattggtgtaatggaaaacagcaacaacaacaacaaacccaaaaaacaaaaacagggttcagccaaatgctgctttcaagaaacacacttagctgataaagacattttcagactcaaggtaaaggggtggaaaaagatatgccaatggaaaccaaaagagaacaagagtagttatacttacatcagatagaataggctttatatcaaaaaacagtaaaaaaaaaaaagacaaaagaggtcatcagataatgatacagggttcaattcaataaaaagtaaaacaattgtaaatatatatccacccatcaccagagcacccagattcatacaaaaaatgctactagataaaagagatagacagcaatacaatactactgaagtacttcagcaccactaacagcactagatagatcattgaaataaaacaaagagacactaaacttaaaatggactccattgcaatgaacctaatagatgtctacagaacatgctacccaacaatcacagaatatatattcttctcttgagtgcataaaacattccccaagagacaccatattttaggccacaaaacaagtctcaatgaatttggaaaaattaaaatcacatcaaatatatttttaacctcagtggaataaaactagaaatcaattccaaaaggaactctgaaagctatacaaatacaaggaaattaaacaatctattcctgaatgatctttgggtacatgatgaaattaatttggaaattaaaactcttcttgaaaaaatgaaaatggaaacataacatactcaggcttctgggatacagcaaaaacagtgccaagagggtatttttattgtgttacatgcttacatcaaaaagatacaaagttcaaaaattaacaacatatcatcacacctgtataaatgacactactataaatggctatacattcacaacccagaaaaatctaaagaaaatgaataatttcctgaaaacatgcaacttcccaatattgaaccaggaagaaacagaaatcttaaacagaccaataaaaaggagtgaaatagaattagtaatttaaacatctctctggaaaacccaggaccagtcagattcacagctgatgccaccagacatacaaggagaatttggactgatcctactgaaactgttccaaaaagttgaataggagggattcctcctaactggtactatgaagccagtatcagcttgatactgttgccagacaagtacacaacaaaaaaagaaaactacaaaccaatatcactgattaatatagatacaaaaatcttcaataaaatgctagtaaaccaatttcaatagaacattataaagaatacaccaaaattaagtaggtttcattccagttacagaaagatggttcaacgtatgcaaataataaatgtgattcactacataaacatttgataaaaagcatctgatgaaattcagaatccctttatgattaaaaaccctcaacaactaagcttgaagtaagctatctcaaaagtataaaagccatgtatcgcaaagccaacatcatactgaatggagaaaagttaaaaacattccccctaagatactggagcaagacaaggattcccactttcatcagtactattcaacacaataatggaagtctttgccagatcaatcaggcaagagaaagaaataaaagatatccaaaccggaaccgaggaagtcaaattagctctgtttactgacagttgatcttatacctaggaaaccctaaagattactcccgaagactcctagatttgataaatgatatcagtaaagtttcaggataaaaaatcaacatacaaaagtcagtagcatttctatacatcaataacaaacaagttgagaacaaataaagacctaagttccattcataatacctataaaaacctatggaaaatgttctatgaatacatttaaccaaggaggtgaaagatctctacaagacaaagtacaaaacactgatgaaaagaattataggtgacacaagcaaattgaaaaatacctcatgctcatggattggaagaaaccccaaagcaatctatagattcagtgtaattcctctcaaaataccattattgattttcaaggaattgaaagtcctgaaattcttatggaaccaaaacagagtctaaatagcaaaagctattctaaacaaaaataagaaatcttgagaacatacatacacacacacacacacacacacacacacacacacacacacacacacacggaatactatccagccagaaaaataaaagaaatcatgtcttttgcagcagcatggatggaatgggagagcattatcctaagcaacataattcataaacagaatgtcaaatactgcatgttctcacttgtaagtttgagctaaataatgtgtacacaggggcatagagagtggaataatagacactgggaactcacaacagtgggagggtgaggggggtgagggatgagaaattgcctaatgggcacaatatacactattcagatgattattacactcaaggcccagacttcactactgtataatatgtccatgtaataaagctgcacttgtaacccttaaatctataaaaaatgaaagataaatttatagttcatttatgtaaaatgcattttgtgaatctataagttaatacaaattttataaaagtacattcaaacccacatcaaaataatcacttacattgagacttgttctatttgaaattcttctctagcaaatcattagcaaattattaaatatttttctactccaaacagatatgagtatattctatcataatccatgcatacactgacccccaaaattctttaggtattcaacattccatatttgttattttatatgaaaattttgtttcacaatttgttttaaagtccaattccatatagttattttgaaactttttggattttatatttactttatggcaatgtttaaagtttgcagcagtagaaaaactgaactccaaatgattaaaacattaactttccatttaatgtaagtttgtaggcatctactcattttcagtctgagacttttatttgaataaggatcttgcttttttaagcattagatgcacatagaatatgaatgggaatgggaccatggcagaattcaagccataatgccttatagcctggtttcagataccttagatataagattatttcctcaaatttaaggtgtgctgatttatcaagcacatttatgacatttttataatcacatctataagttttaaataacctttcatgttttaaaggacaaggacaattatatatctccaacttgtctttaattttagttgaaaacagaaccttattaaaattggagcgttatacatgtaaaaccactacagagtgtccttttactcagcacagaatacatcttagatgaagttcacaataaaatattcttacatgaacttttgtcttgttttgaatcataagtgtagaaataaagtcctgaatattttctcatgaaacagataattttaaaataacaataacaaatcaaagtcaaaaaattttctgaatttaaaaatacaaagcatcagtgctttttttttttttttaacagatgtgatactccctgatgaagttttctagggagaaagaaaattttaatagagtcactttggccttaggctcatttatatcccttctttgagacttggtagatggatcttcacatatacgtacagaccccaaactaatatctgatttataaaataaaaaattcttagggtgacattgaaggtgctctattacctgtcttcaatatatttttctatccttacctcttattcacatttcaacattcggttttctaaggaagacatactctgttatgacctgatgttttttgtctgtaagaaatgtgcttccttatcatctccccatagaggaatccttctccaacctgaaaagttagtcctgttgatttctccctgactgtctcaggaaaattgactaattttcttcactgctcccacacgtcttgttcagacttctattataactcttagtgcactgccttggaattatctcttaccataactttctttatcaaaagactaaatattttgtggcaaaagacatgcattttttttttatttccagcatattgaggagtggcacattaaatacacaagtatgttttgactgtgtgagtgaatagtagaatacacattttggtagaaaaactatgctatcacgtcttaatttgtatcatttaaaatgtatgcatctgcttaaccaatggttttatcccactcccctaactgacagaatgaatattataccactgtatcaatcagtaaataagtgggttttatgtcttctcactccacctgttctgttccttcttttactgcacagctacatctacaaaagattaattttttttctttttttctttgtgtgtgtgtgtgtgtgtgtgtgtgtgtgtgtgtgtgtgtgttttgtttgtttgtttgagacggagtctcgctctgtcgcccaggcagaagtgcactggcgcgatctcggctcactgcaagcttcgcctcccggcttcacgccgttctcctgcctcagcctcctgagtagctgggactacaggcgcccgcctaagtttttttgtatttttagtagagacggggtttcaccgtgttagtcaggatggtcttgatcgcctgacctcctgatctgcccgcctcggcctcccaaagtgctgggattacaggcgtgagccactgtgcccggcccaaaagattaatttcttaacacgtcaaacacagacatgtctcatctagtacgcacgagttatttgttgagtgtcagtcttgtgctttgttctttgctccaacagttcattgatagggatcctgggaaaaacccctttggaagcctggacattctcccatttacctcactagccactatactctcctctaaataagttaaaacttctgtgtcttggattaaaagcagactaatacaacttgattacaatgtaggggcaaatgacaacatcaaaatataagaggattattggattttgtcaataaaattgaaatttatcactactggggtactactgcttggatagcctggaacttgggtgtttggttttttttgattagagacatgactagactcaactctacaaaggaaagagtttacgacaatcctctctcagtggcaaactgaggaaacagaacttgcacccagtccatgctacaattattgtgcctatagaaatccaccagtggaattacttttctccctctaattaaggacacaaacccagttttatcattccctccactgcagtttggagtgagaaaaagtcagtacacactacatctcttttgacaacagatttcttttctttcatcaacacccagctaggagaataatgggagatggagctaaagtctatttttgttttattaaataaagagtctaccctttgggcaaagagtaatcaatttggatggggagaaaagataaaactctatcaccaatgatagtagaaaattagtcttggccgggcgcagtggctcacgcctgtaatcccagcactttggaaggccgaggtcggcggatcactaggtcaggagatagagaccatcctggctaacacggtgaaacccggtctctactaaaaatacaaaaaaattaaccagacgtgatggcgggcgcctgtagtcccagctactcgggaggctgaggcaggagaatggcgtgaacccgggaggcgaagcttgcagtgagaagagatcactccactgcactccaacctgggcgacagagcgagactccatctcaaaaaagaaaagaaaagaaaagaaaaaaaattagtctgaagttgtaatgagacaacgggtagctatcaagagatacaggatttggggctaggtgatacttgtttcaagcgagacattcctttggactcatcactaattattgtagtgtgaaatcagctcatggatttagtgacatgatacactacttatcaccacttctcttagtctatttgtacaaagtccaattaataacttatttttaggtatttgtaaatatagttttatgtacataattttacttgaaagtaattctgtagtaaatttgcctactgttctaatgaaaataatgtgtctatataaaacaaattgtataagcaaaatcatcctatttttaggcaaatataactaataatttaattacacttatgctcttagttcaacatgtaatcagttgtacagtaagtgcagaattaacactgagaggttaaaaataactagaagttctacatatatttcatagatatagataaaaatatatttaaaatcaaaataaaggaggatttaatcatctaataatccacaaatgattgcaggaattcactctttctgaattatttttaagaacaatcaagagaaaatattaacaattagcaaagagtaaaaccttcaaaaaattttgaaaataaaaactaacagttcactttataaaatgaatagtgtctaacaggacaacatattactgcttattactaccatggataacacctgtatgtattaatgctataaaaatggtcaaaaatgtctcattacaatatttaaacctttgtacaatatttgaggcaaaaaaatgttttcagcacagaaatgcactatacattttgtgggatttacctttgccatactaatcctacatttctgtactgtcattaaaggtaccaattatgtttttaaaatatattttacacttgttggaatgctgagtacaaactttctaaacaaggataatttgatgcaggccacagtgccctctgtcttctcaccccaaatagttgtatagttttttgatctttcccccatcagcatctgtacttttccactctcctttacagcttctgcatgccataaagcttctcctctctttgacactctaggctggtgaggattttcagatattatcttgtatatagagtgaccagctatccaggtttgactaatatgttcccggttttagctctataagttctgtgtcccagaaacccctcagtcctagacaccccaggagggttggtcatcctgttgatactttctacatcatagcttctgatgtaacgctgccatagagtaaaaatggcatcaagctaggttaaggcagaaagagagagagtgagtccgaagaagtctgcttctacccagtccccttttcttcaggttgctatgagaaatgacatgagccaagatacttatcatggccatggcaaagaaagctgataactgagggccaatgtgccctcccagaagacctataaacacaagctgttgtgcaggacagtcctgaatattcatcagtggatcaacaatgtctttaattgcagcttgtcagttggaagtgatgagcaggtccagtgcaaagtgcattcataaggccaagagagagggctgacattcagccagccatggatgcttcggtgggaaccctacaaagtcagaggctgactcagagaactggtaagatgagacatactgaaagaggctggtggtaccagtgaggaattgaggacactttagaacctagccattgtctccaactctttgatgtaactttctgggagaaggagtaggaaggaagtaggagaagcatgttttttgataacttttactaaaaaaattgctttaaatgacaaagaagtgactgaacatttttctgtcacatttttctaccatcagtggatttgggggtttcgtaactctacttgaattcagttagaactatctgcacaagtgggttgagacctaacaacttaaagccattgcaatattctccaggaaattggaaactcaaggctcaggagagatttatgtggagcagtgagggattaaaagacacttaccttctcaatcaagtttagaaaatcagactgtttgaagatcaatcctgaatcctgattatcacttagaatttacttataacttttccttccctgagaaactgagtcagtttctctgcatttgatttaccatctgtaaacaatggataagacctacgtcctcacaagctttttgtgaagattagcagagacaatgtatatttgaagtatacattaagtgctcagcaaaaatggtattaatgttgaatgattagtattattttatttatttatttttgagatggagtctcactctgtggccaggctggaatgcaacctctgcttcctgggtttaagcaattctcctgcctcagcctcccgagcagctgggactactggcgcatgccaccatgcccagctaatttttgtatttttagtagagatggggtttcaccatgttggccaggatggtttctatctactgacctagtgatcggcccacctcggcctcccaaagtgctgggattacaggcgtgagccaccacacctggctgattagtattaaattcttcgaggactaaagaacaaatagaaaaggtaagcacagataggacataatatatagatgtataaaatatcactttccccatgtataatatgatttatagataacatatgaacacataaaaattaccttttgggggagaaaaggagaaatattggttaagagtataaagtttcaattcgataggagaaaatattcttggtgatctgcacagcaaagtgactatacttaataataatgaatgaatgatatattgtatatttcaaaattgttaaaacagtggattttaaatgttcttaccacaaagaaatgataagtatgtgaagtgttatacatgttaattagctgatttgatcattccacaatttatacatgtaactaaacatattgtactccatagaccatataaaattagtagccaattaaaaattaaaatataattttaaaaatgactttgtaatggttgtcatttgtaatggttgtcatgattgactgctgaaaaaaagtaatgaacaacctcacttaacaagttgcagaaggcaaaagctaactactatatttttctgcactattcactcattagggactcaattcactcattacctgcacagccgtctgctagagtatgatcttaaatcatggagtccctgaaaacccaacttggagcaaatatcagttgcttgttatgtttctctgaagagcaacatgagagtgatgtaacaggaaattggggcttattcctctgcctctgttgacagtaagaaatgattaaattctacaaaaaattcatcttttctttttttctgttgtatttcttgctttctccacacagagaagagcgcacatatgcagatggttccaaaactatttatgatgtatttttacatcatgttggagaatgtaaacacacacacatgcacacacacacacacactcacaaccatggtgctcacccctcatagataggaaagtgtttaaaatttatttggtatttgggtctttttctttgcaatactgattatcctgttttatacaccactatgttattgtcttgaaagaaaacaagcatttatagtgtattgattttagcaaatctatctctagtttactttacatttgattgctctagttttgaaatggaatttatttcataaaatactctgtggaatggcatgttagaaatacattccctgtgcaagtatattaataaagttattgaaagtaacttgctgtaaaaccaaactttctgaatgggaattatgaacacaatataaaacagggtattggattgcttgccatggtcattctttaacaaaccttcagtgcttcttttattttgaaaaaatataaatatttgatataatgttaaatattaccacaggaataaatgcaaaagcaataaagttaaattttaaggaactatttttatgggtgtatcagtctgttttcactgtgctataaaagaactaactgagagtgggtattttatgaagaaaagaagtttaattcactcactgttctacaggcttaacaggaagcatgactgggaggactaaggaaacttacaatcatggcagagggcaaaagggaagcaagctccttcttcatatggtggctggagagagagacagagcaaggggagatgtgccacacacttttaaatcatgagatctcatgagaactcactcactatcataaaaacagcatgaggcaaatcctcacaatccaatcacctcccaccaagtcctttccccaacactaaaaatcccaactggagttgagattttggtgggcacacagagccaaacatattattccaaccctggcccctcctaaatctcatgtcctgacatttcaaaatacaatcaagccatcccaacagtcccccaatcttaacttattccagtattaactcaaaagtccaaatccaaagtctcatctgagacaaaacaaatcccttccacctatgagcctataaaataaaaaacaagttagttacttccaagatacagtgggggtacacaaattggataaatcctcccaatctgaaagggagaaactggccaaaacaaaggagctacaggcccaccaagtccaaaacccagttgggcagtcattaaatattaaaggaccaaaataatgccctctgactctatgtctcacatccagggcacatcgatgcaagaggtagtctgccaaggccttgagaagctcctcccctgtggctctgcagggtacagctcctcctgactgctttcatggtctggcattgagggccggaggcttttccaggcacactgtgcaagctgttggtggatctaccattctggggtgaggaggatggtggccctgttctcacagctccactaggcaatggctcagtggggacactatgtgggggctccaaccacacatttcccttctgcactgccctagtagatgttctccctgagggctccgctttgcagctgacttctgcctagaaatccaggcatttccaaacatcttctgaaatctaggcaggagttccaaaacctcaattcttagcttctgtgcatctgcaggcccaacaccacgtggaagctgccaaggcttggggcttgtaccctttgaagccacagcctgagatgtatgttggccctttttagctgtggctgaagctgaagcagctgtgctgcagggtgccatgtctcatggtagcacagggcaatggggccctgggcccagcccacaaaaccaattttccctcctaggcctccaggcctgtgatgggaggggctgccatgaatgtctctgaaatgccctggaggcattctccctattgtgttggttattaacattttgcccatctttacttatgcaaatttatacagcaggcttaaatttctccccaggaaatggggttttcttttctactccattgtcaggctgcacattttccaaacttttatgcactgttccctttttgttttttgtttgtttgtttgtttagacgtagttttgcacttgtcatcctggctggagtgcaatggtatgatcttggctcactgcaacctcggcctcctgggttcaagtgattctcctgcctcagcctcccaagtaggtgggattacaggcatgcaccaccatgcccagctaattttatattttaatagagatatggtatctccatgttggtcaggctggtcttgaactcctgacctcagatgtaccacctaccttggcctcccaaagtgctgggattataggcgtcagccaccgcgcctgccccttccttctttttaaatataagttccaatttcagataatctctttgttcacacatatgagcatatactcttagaaacagccaagtcaaatcttaaatggtttgctgcttagaaatttcttctgccagataccctgaatcatctcaggttcaaagttccacagatctctaaggcaggggaaaaatggcatcagtctctttgctaaagcatagcaagaatgacctttgctccagtttccaataagttcctcatctccatctgagaacaccttagtctggacttcattgtccatatcactagcaccattttggtcaaagccatgccacaagactctaggaagttacaagcttacctgcatctttctgtctccttctgagccctccaaactgttccagcctctgcctgttccccagttccaaagtcacttccacattttcaggtatctttatagcagtgccctattcttttggtaccaattttctatattagtctattttcacactacagtaaagaactacctaggctgggtaatttatgaagaaaagagtttcattgaatcgcagttcctcaggcataacaggaagcatgattgggaggactcagaaaacttacaactatgctacaaggcaaaggtgaagcaagcaccttcttcacatggtggcaggagagaaagaaagagcaagggaggaaatgccacacactttaaactatcagatctcatgagatctcactatcatgagaacagcttggaggaaatctgccccccatgatccaatcacctcccacctggcccctcctccaatactaaggatacaacttgagatgagattctggtggggataccgagccaaaaaaccatatcaatgggtgtatttcagatttaataaattctgaaaatatttagtaccataccttcagcttttcttcattgagctattggcactattttcaagtaattagggtcaaatatattagctaggctatgggaaaaaatgaaatccccctttttttttgtaaaataatatttgtaaaaaaaacatgccatcacacccagctaactctttgtatttttagtagagatggggtttcaccatattggccaggatggtcttaaactcctgacctcaggggatccgcctggctcagcctcccaaagtgctgagattacagacatgagccactgcactggcccctccccttctcttcccttccctgatctgcccttctcctctcctctcctttccttttttctttctctctcctttattctttctttctctatttatttatattttttatgaaaatatatccaacaaggccaaatgcagtggctcacgcctgtaatcccagcactttgggagactgaggtgggcagatcacgaggtcaggagttcaagaccagcctgaccaatatggtgaaactctgtctgtactaataatacaaaaattagatgggcatggttgtgggcgcctataatcccaggtactcaggaggctgaggcaggagaatcacttgaacctgagagacggagtttgcagtgagccaagatcatgccattgcactccagcctgggtgacggagtgaaactccgtctcaaaaaaaaaaaaaaaaaaatatatatatatatatatatatatatatatatataaaatctaacaaattgttcactgtgcccttccactgagaaacaaatacgagatgatttcacagacaaacttagagtgaaatgtattcattattttctaagtctaatatgtacttaatcatttgaacagaatttgagtattttattattttgtgacaataatttgttacttcttaccttaaaggatgctaaggagagcaaaagaataatttgtttatagtgaaaaagcataggttcagtacagtaaaagaaaaactgaaaagaagtcaattattttaagtctacagatcattgaaagttctgaagtcaaatcaaacagtttgaaattttatatgtgatgatatcactggggttaacctcactttatattcacatgagctatatatttttttgctctacaatcaaataaaggtaaaattgtattttttcctttttacattagttttcataagtgaatttaatttttaattggatgtactaattgtacatatttattgtgtactagtgatgttttgatgtatgtaatatatagtgatcacatcagggtaattagcatattcatcataccgtacatttattatgtctttgtattggaatattttaaatcctcctctagctagttgaaagtatataagatattactgctaattatagtcaccctgcagtgctacagaatgctaaaacttattcctcttttctagctgtaattttgtatcctttaccaaatctctccccatcttccctttccccatactctttccagcctctagtattctttgttctatttttctttttctattttttacctttatgatttttattttgcattcatatatgaatgagaacatgagatagataactttctgtttctggcttattacacttaacataatgtcctccagttctttccatattgacacaaataacaaaatttcattcttttgtatggctaaatagtatttaattgtttatatataccacattgtctttattcgttcatctgttgttggacacctaggttgatttcatatcttgactgttgtggatagtgctgcaataaacatggggtacaggtaatctctttgatatactgatttttttccttttggtaaatgcccaatagtgggattgctggatcatatgttagttcaagtcgtagttttttgaggaacctccatatttttctccatagtgactacactggtttacatttccatgagtggtgtatgagctccccctgtttttgcatccttgccatcatttggtatttttttgtgtttttgatagtagccacgctaactggggtgagataataccttattgcgattttgattggcatttcttgtatgataaattgtattatttgatgaataaattatcacctggagcattctaatattcccaatattaacatgaaataaaatttaaattaacctagaataatgaaaaataacaaaatagcaatgtattaaactattctgtttgattcatgtatttcaatatatttcagaataatcataagagatatttaaaagcattctactgtaaattcatattaagattctgcaaagtatttattaaaaataaaatagaacactttgagaaatttcctttttttgaaatagaaaatataaaaaccatgatgataataaaaatgatttttaatgttgccttcatgtatatatttagcaagaggaatactcacacaagatggacaggggtgatgaaattgaattctattttatgagaaatttaaaatggttgaatcagaatctgatggtatgctttagtccttctgaaaagtctattacttttttggtctttaaagaaaattattggcaaggaattctttatataggggtcaccctatgaaaggatgaaccatttcccttaaatgtgtccctggtcatatcagaaagttttattatcacttcagggtagctctctgataaattgataaagacatatttaactgaatttgcaaccataatatgagccctttggtgataaaggtacagaagcaaagctttcttatgatgtgttttggagtttgagaaaaatcagttttccatgaaccacctcaatgagcaaagccctgactgctagatcatcccttatcacaaaaagggcaggctgtttataatcatatcttctacccttccgttattcatgtctgtgaaggcagcaggagatcatgagacacttgtagggccatgacaaggaagagcctacatatcttacattgatgatgctggcaggaaaagtgttggcaattgtgtatgaatggagctagatcctgttgcttccttgagtcaccttgtggcttgtttgctacactccaagccaatgccagctagtcactttcatattaagacaaaaatagatctaattctgcaggtagaaaataagaacctacattacttttttatcatacttatatgaaaactacatggcgtaatgggacagcaactaaagaaggtgcgcctcactctactattacaggcctaaatcatttctttttaggtttatagatgttctgcagataccagctgaactgtgtgttcttatgtaaatgagtatttagtattatttttgctctaaagaatgcctaactctgtttgcctagctcaaaagcagccacagaaagacagaaataaatgagcacagctgtatttgaatacaactctatagacactgaagtttaaattttatataattttatataattttcacattattaaatattattcttgttttaaaattttaaatcataagtttaaaattgctttcccattacgctatgtaataactattgctagctcacgagcagtacaaaaatgggtgtccagatggatttggcctacatagttcccacctgtgtaatagccaatttagtgactacagacacatgtagtaaataaataaccaggtgatttaaacatcgttttataaatgctaagattaaaaagggcaggatatgattggatcacctaaaaaatgtatccagcttgatcttacagaaccacgaaattcttcctgaaggagatgaaaaactgaggtaggaaagatggaaagaaggcatccagctgaacatgagaataaggtgtcaagctaaaggaccagcattggtggaggttaaggagatcaagagagagcaaagcaagtttaaggaactaaaagtattaaagaagagctaaagtgattttgtcaagactatatctacttttcaaatatgtttctgcttcagatatgtatatatatacacacacacatacagatgtaaatatatataaatataaatattcatttattattgttggtagaaataattttttttacttctatccttatattcctttacataagtttgacaatgacttcaacaacagaaattgcttgtctctcaatctttgttttactgcttagtagattctagaaatgttttcttattagcaaggagtaggaaagcctaccactgaagtttgagagattgttttgagaccagtccctattaatactttcttttgactacctcttaaaagaattatacaagcatatttcaggtggaaaggatatgtatatacaaacaggaatagaaatggtttgtaaagaaatgaaaagttattgttttaaagaaattatatcaaatactatttgttttttgtccgctgataaaaagaacatggaaagctatataggtatgattatttcaaacagtcgtattcagaaaagacaaacaagctattctcagagtagtggtggtgatcactaattgttttaaaaacaattccaaaaggatttatcccatatgaaaatgggttaactcaccagtgtactttaatagaaattgtagacatattgacccataatggttgccagtgcttctgaggttcactgtttcactaaatttcctttaaactcaatcgtcgaaactaggtgcagctttacagtaggtgagtttggaaagactttgaaggtatgcaacatcactatcacagtcaaagtgctctttaaaatgcatcatatttctaggtgaattattattattagtagcagtattcataaaggaacctcaaatgagcttttgcatttacaaaccgaaggtttagtttgtacaaagcattttaaaaatattgaagtctgtgacattagagcccgtctttgtaggttacttccttctacagcacagcagaagtttgtacattcttagaaactcataattatgaggaataaatacttttttgatcaagagggatataatatattgcaattcaaacaagtccaaattgccaaatacaattgttttaactgagcccttgtctgtttgaaatttccttgatatttaacactgatgagcgccaattccccttctgaaacttgctattcctttgattccaggatatctctcattccataatctcattctctttaacaactattcaaattcttcacttttccttctatgctatatatataatttctcaaacttttgctatattattgtatatagtattaatttctagtctcaaatttcttatgtatctatagctagatcccctttcttattcctagtatttgtgattctcctctttctgaattgccaaatatttgcctatgttatgagacttttcaaataactatcttgtgtttttgttgataaaatctacacttttgtcattactttatatgttgatgttcctgtattatttcatattgattttgatttctattttacttaggaatgctctctctacttattttggaattaatttgtttttcttatttttctttagcttacttgctttaatttatccattataaattgctattaagtttactgcatacatttcacattacacatttttctttgtactactttgcataagtttttagtatgtagggcttcattgcaattcattcctaaacagcttataacttctgttttgatttcactttcatcttaggaattctgtaagctgctttcattttagtttgttgttaatttcatttttaaattgttttgtgttcaataaatatggtctaaaagacttctgccttacagaatttattgattatcttgtgctttcatacatgttcattttgctctgagtttattcatgtctcaaaagaaggctccctttttgtctgctgtatgcaatgttctaaatgtaagaactagtcacctcattgcattatgcagatattctgtgttcttattgtttttaatctatcttttgtattcagagagaagttcctatttgattgtattttaaacattttttcatctctcgtgtaaatagatactgctttattatttttcaaaatgttaatataataagaaatatcctgtttcatttagtagtttttcacatggaatccttctttcttttttggcattttcctgttatttttgaccaacaattaattttataaaaatatatctttattcatctttttgagaataatacatggttggtgttttccagtctaactaatctgtttttagggaatccattttggggtagactttcatacattctctcctatatcagctgtcctgtttagcatggtcttcatcttccatattggttgtttttcaaaagtttgtgaacatggttgtctaattagttttgaatatgagtatctgttgatttgtgtaagtagctgtatcagcttttcttttgaatttttgtagttacatagtttttgtatacatttatggggtacatgggatattttaatacaggcatacaatgcataataatcacatcagggtgaatgggatatccatcacctcaagtatttatcctttctttgtgttacagacaattcaattatagtctcttagttattttaaaatctacagtaaactactgttgactgtagccatgctgttgtgctatcaaatactagaacttaccacttttatctaactatatttttgtatccattaactatccctacgtactctgcctcctccactacccttcctagtctttggcaatcattgttctactccctttctccatgagttcaatggttttaatttttatctcccacaaataagtgagaacatgtgaaatttgtctttctttgcctgggttatttcacttaacattatgtcttttagtttcatccacgttgttgcaaatatatctttgttctgttggtatgtagttctcaggatacctgcgtcctaactaggaaggtttcctcaaacttcttctacatggatatggcatagttcattaggttatgtggatacagaaagaggaagagtgacatatcctttctcaacttttcttttccacttttaaattcagggggatgtggacaggtttgttacatggataatttgcatgtcacaaagatttggtgtacagattatttcttcacccacgttttcagaatagtactcaataggtagtttttcaatcctcaccctactcacactttccaccctcaagtagtccctggtgtctgttggttccttctttgttttcatatgtactcaatgtttaatccccacttataagtgagaacatgtggtatttggtttactgttcctaagttggtttgcttaggatatggcttctagctccatccatgttgctgcaaagggcatgatctcattcttttttatggctgcataatattccatggtatatatgtacattttctcaattcagtctaccagtgatgagcactcaggttggttccatgcttttgccaccgtgaatattgctgcaatgaatatacatgtgcatgtgtctttatggtagaacgatttatagtcttttggatatgctcaataatgggattgctggatcgaatgttaattctgttttaagctctctgagaaattgccagactgcattctacaatgggtgaactacattacattcccaccagcagtgtataagcattaaattttctctgcaatctcaccagaatctgttattttggactccttaataatagtctttctgactgttgtgagatggtatctcattgtggttttgatttgcatctctctaatgattagagatgttgagtattttttcatatgtatgttggccatctgtatgtcatcttttgaaaagtgtctgttcatgtcctttgcccactttgtaatggagttgtttgttttttgcttgcacatttcaagttttcaaatattttctcccattctgtaggttgtctgtttactctgttgattgtttcttttgctgtgcagaagctctttagtttaattaggtcctatttgtcaacttttgtttttgttgaaattgcttttggcatctttatcatgaaaactttgccagatcctatgtccagataatgaggtctttactgtaagactggagcatttttgtttacttctgtcaaatcccttatgaattacctttcattattacacatacttatgcattttgttttataaaaatacagaacactaaatacacaaaaactctagattctacccacgtgatcctggttgcacttctgaggctttcccaggattaatttttggggagagattggggaaactgaagataatttttcaaggtgtctcctcttatctttccttataatccctcttcttttacggaataaggaaggggaaacagcaggaaaatgttaacataagtccatagttgtaactgcaaaggcttgtgattggtattatttaatgttgacttgcagatttatctccactcaatctgggagcacacctagacctgcagagggaagggaaagcataaaggtacctgctatcaccatgcatctgcttagtgtggagtagattatagcattagctcaccatttacctccatacaccagtttctcaattcagcaatgggtcctatgtggatctgtggcttaagttagttaatagccagtacaaggacttcattttctgtccttgaacctcagtctgttatgtataaattatagttcctaaaactgaatctcctgataacatgtgcctgctgcttaagtctcagtcagccctaatctggccaatcagatagactccaaattcctcaccttgatttgaaacttcccactgtaaaatttacttttctcagactaaattttgggcccatctttccctgtaactctctcctttcctaaatttatgaccccttatctgacaccttgcctttttctgatatttgacatgcttaaatctaattctttcttctggcactaaattagagtgctataaaatatttgtatttgcaactatttcatgtttatcttacagactcgtttttgtcactagggaaaggtatttctagtgcctatcagataagtaaatagcctgtaaatagggagtgcaaactcgaatgcctagagatgtccgtgacagataatgtaaacaagtgaaactctcctgggataaaacagcaggagggggtaactgctgaaaaccttacgactgtttaaagacattccaaatcaaattatttctaaaaatcagtaaaatatgagtcaacaaacagacaaacaaaacaagtgtggtctgcattgccaccttgagtaactcctctaaaccaaatagacttctgctcatccttgcaaggccacatccagccattaggtaacttcttgtttgcctcccataaaggctgttcatatagttaatttttgacatgcttttacctcaataaaattatcctgaggcaataggatagaagataaaccttggttcaaaccccaactttgccacttaaaactgaaccaccgcacggcaagttattaaattttaggagcttcattgttctcttttataaaacgggcataaaaatgtatgtaataaattattgttgggaagattaaatataatctaagaaagagattataggaaaaaatcaaacatttcatgttaatcctcttttctgtcatacatgttctccaaatattgatgtttttctctaggccacaaaattttcttaagagtaatcctacctatagcagttggaagtcaggaccacagtatttttgaaagacaaatatttacaatctattataaaaatttccaatatcatttttgtttttatttggaaatatcttcatgaattcctattcaatattcaaaacatcacaaatatgtagaaaaggggataaacatcaaggtagtacaatatatctaattttttggttgaatcaaaaatttaaaatatagctgctagctgttttgtgttttgtttctatgtagacttatctctcagtaatgatgatgcttcaaaagaacacatctatatcaggttctatctctacacaccctttactattatcaacttgtaaaatgtatcagccaaacaggacctgctacaggattgctgatgtctataaaaatgcagaaagcactaaatcaaaacgggctgctgaaaaactaaaaatcaaatatcacacaaatcactcagctgcctgggcttagaaagagagcatttgaaagctcatatgtggactgatattgccaattgacatactcggttgttttaagcaaatcttttaaaaattcattgcttgaggagatcgagcaaacctgtttttctggccagatatgcttttcctatttccctggcttatgaagtttcacaggatgagttttaaattactcaggaaatagctatagggtatcctatttacatcataaaagatatactgacagaactgcagggtttacgccaatctataacaccagacaaagatttttcactgtgctgcaggttttataaggagacatttaaaaacatatataggaaaaatataatcctttatatgctatttaaatatattctctggctatctgaaaggctttctattctttgaaggaaaaattctattcccttttttttgctgactactgctctttgtgtgtagttatatgaaattatcagaaatattaaggctatctatatgtactatatttaaagtgggactcttctgagctcatcacatgtctcatcattagcctttcacatatatttcaaataaaaatgtaattatattagtaataatgcttttggtgcttagggaatgaataacacttgccacactgtccagttggtatcttagactaaaatagttgacacttgctgaaaatttttcctatgcttcattagcttactaagtgagacaggaacattcctgtcattgggatctttgctagatttctgatgttatgttagtttattctcatgctgctataaggacatgcctgaggctaggaaatttataaaggaaagaggtctaattgactcacagttcggcatggctgcggaggcctcaggaaacttacaatcatgacagaaggcacctcttcacaggagagcaggagagagaatgagagcccagtgaaggggaaagcccctttttaaaccatcacatcttatgataactaactcactatcatgagaacaagatggggggaacccccatgattcaattacattcaagaactacaattcaagatgagatttgggtggggcacagctaaaccatatcagatgttatctaattatatagtagactgggatataaaatagacaaggcagactgttgtattaagtggaaactctagtttatagatattaacatgattttaggtattattctttataccttagattctcaaagcacttgataaataatgaccctaaattggtggtgaacatgctgttggagtgttgaatccaataaagttaaataaacaaaagaaagaaatggcatctaaaaggacaaaaaaataaggtacttaaggctctgcacctatttttctgtgtttatagtgccttaaatatcaccctctgaccaagaagtaatgaacgggtttggggcttttcttaatgtgttttatacttgctttattgctaatatattgattagtttcctaatgagatcacagcaaagttgttacttctaaataaaagctttgccacaaaggttgcaagtaatgaacactataaactgtatgtaataaaatgtttgcaaatagtcatcctttggttcatatataaggtattctggagaaataaaaacttccatgaatttattttatactttttccagcaatcctaaatgctaacaacaacacactattttaatctgaggaaattgccatgaatttgaaaataatctcaacactttgaaggaattaataaaaacaaagagttgtgtacatattcaattccagtagataatattacagtatcatagatatattaattaagaatatgaatgtttaaggataattcttaagtttcaatgagattccaacccaattaaacaacaaagatatgtttcccttttaaattatctagttgacttaatctattgcttttagaaaaggattgttagaagtaatatgatagtgatgaataacccaaggtttcattactgccaagaatccagaatgtgtttacatatctctcagatgccagaagaacttggacaggagcgaatgccttcatgattggtgaagaatttttcttgccttgactggtaattgtctgaatcttctagtagtgatcttacctcttgttttgaagttgagaatatgaatactcatgaagagaaaaggagaggagacacatttgaattgagcttcaaggtattaaataaaatgttgcttgtccagcatccaaagaaatctgcaaaatctgcaaaatcttaggctccaagcactagtggtctaaaatgaaaataacccaagatatccatcagggttatgcaaacaataggggaagacaatctgcccttgggcattttcttctcttcttttgtcacacaggtctacccagctataatggaatacaactaagagagcttcttgttcgttggctgcttctctctgagaatttaaacatgaatctctcactaaaaaatgtggcttggtcaagagaatgacagataagccagcaactgggataacatattttcgaaacacattaactgataatgaactggtattcaaaatatacaaaaactcctaaaaaccaccaccaacaacaacaaaactacatcacaagcaaaagatcctaataaatgtttcaccaaataagatatacagatggcaaataagcatatgtagctatccacacgatttcttaaaacccatcaacaacaacaaaattacattatgtgcaaaagatcccaatagatgcttcaccaaataagatgtacagatggcaaataagcatatgtagctatccacgctatttgtcatcagagaattgcaaattaaaacatcactacatcacctattagaatgggtaaaacacaaaacactgacaacaccaaatactggcaagtatgcggagcaacaggaactcccaatcatttctggtgaaattgcaaaaatgatacaaccactttgaaagacagtttggcagtttcttacaaaagtaaacatattcttaccatataatccagcaattacactctttggaatttaccaaagtaaattgaaaatttgtgtacactcaaaaacctgccacaaatatgtatagcaggtttgtttctaattgccaaaacttggaagtatttaaaatattcttcagtaggtgaatgaataaatgaactgaagtatatctatacaatagaatatgtttcagggatggaaaaatgagctacctaaccacaaaaatgacatggaggacacttagacccatatggctaagtgaggaagccaatctgaaaagtctatatactgtatgattcttattatatgacattctggaaagaaaaaaccatggagactataaaaagatcagcgtttgccaggagttgggttgggggaagggaagaatagaggaagcataggatttttagggcagttaaaatattctgtataattctgtaatggtggatacatgccattatacattagttatacctattgaacgtacaacacaacaaatgaactctaatgtaaaacatggactttagttaacaataatgtaccaaaattagcttatcaattataatgtgtcccatgaatgcaagatgttgataaaagaggaaactggggtggaaggagggatatgtttatagaaactcttcccacttctcactcaatatttctgtaaaactaaaactgctcaaaaacataagagctataaattaaacattattttaaaatgctgtttgatagattagtgataaaatggagaggctggaactggtttagtaattactagtgctctcctgcctggggatcacctctctccaagggccaccataaatgctaacttatataaatgatgctctctagatttatgcaatacttaactacaaagagatatgaaataacaacatcttaatctcttcttaaactcaagaatgaacacaatccagggcttggtttttgtgctttttgaacatagagactagagattaatatctccatgtgaacatgagctaaataagtagatatctgggagagatcaccaatataaaggaaaaatgacatatgtaaatgaagcagattttaaatcaaaggattaaaaataaccatgtcatttagccttatgtatgtaaaggaagacactagtaataagaggctgaaataagattttatttaaatgtggatttttgacatatgaaaaatataatggttgaagaaaagaaaatggtagatgggatttttaaacatcaggattattactactgaagaaagaattatggatggagccattaatctaaacgaaataactcagaaacagaaaatcaaatactacacgttctcacttataagtgggagctaaccaatgggcacacatggacttaaagatggggaaataacagacactggggactccagaaggggagagggaaggacggggttgagggttgaacaattatctgttgggtacaatgttcattattgggcgatggatgcattagaagccaaacctcaccattatgcaatatatccacgtaacaaacttgaacacatattccctaatccataataataataaaataatcctgcaatgaaaggcaaaaaataaattaattcatctgggatagctggaatcctgtgacccaagtgaagaccatgaaatttataaaataattattaattcttgccaaaaatattctttaaaaaaattattctatagaggaattcaccattttttatttcctttcaccagtgtcttggaattattttctaagaataaattcacaggcaaaggaatgaatgtgtatatatgcttctcaaataacagtctaatgtgggaaattaagaaacaaaaataaggggataaggtttatatttctttacatcacagttgatttgtaaaattaatatgttttatattcatcgattctattgattctaggacagaggtggtactcaagactcaaggtattagaatccttgtctgtcacagggacaaattcttaccaggagaggataggaagtgcctgcagggtagagttgacagatttggcaaataaaaatagaggatacccagttaaatgtgaatttcaggtaaataatgaacattttttttagaataggtatttcccaaatatcgcatgtgtctttcatactgataagctagccccaccacagacctattgaatcagaatttgtggggatagggactaaggcatctagtttgtataaaaattcgtcagtaattctaataggcagacaaggttgaggctcactatgtttaacgattatttatcaatcaaacctcctataagatatatgaaatgacacttatggccgggcggtggctcacgcctgtaatcccagcactttgggaggctgaggcaggagaacggcgtgaacccaggaggcggagtttgcagtgagccgagattgcgctactgcactccagcctgggcgacagagcatgactccgtctcaaaaaaaaaaaaaaaaaaaagaaatgacacttatgaggccatgaccacacaacaaatccagatatggataaccctcagcccttgggcgtcatgttgactatgatattctgtgttggttgatgactgctatcaagttttcaattttatcctggttttctttttcatacattggagaacaagctacaagccccactacccccaataatttcctcattttcaaagtcatcagggaatgtgtgcaaaaataaaaataatgcctgctataaaactgtttaactactgtgtgaaaaattgaatttccaacataactcatattatgtttcctctcataaaacatgaaatggttgaagatgctaaatatggcacagtggatatgaaattgattatatcaggaaatctagtcatctgtttcctggctatgccatttaacttctttgggcctcaatttcttcaccagtaaaacgatgttttgtcttgttgactgcccacttttaaatgtctgtaagatttagtgtttacaatgtctcttggaaacactaaggttggtattcataagttattggcagatcatatgttttaacaagaatgttgtagaaacaaaatagattatcatctgtatttatgccccatacttgtcatctgagagaattcttaaatgcaattcaatgtagattacaaatttgcagtctacaattgataatcacactgtgaaccttccagaatattgaaactctattttagaggaaacaaatgtgtcttgctttaggcttacctgcagaaatagtcaataccctatttagggtcatgaagcaggcacaacgaaattttcatgaatattaattgagatttagcttgcaaaatgaacatggaaatatctctcagatactgcccatcttttaaggactgacactaaagtaaggctttcctttaaataatatttaatagactaatatactctttttccttctaatttttaagctaggataagtgcattccacattaaaaaactgttctctttaaaaaacttaactgcatatgatggtgatggatgattacttttcttcatttcaagtttattgggtctatctcctagtttatttgtatgttttaaccaatgcatctgattatattaatctcaagatgaaataaatgtgccattaaagtccatatgtaaaagaatagtttaaagttatgaaaataggccagttctcaattacatatattttttgttcaccattaagtaatttatcactggttcattttagggcacttgtatttttagtatttacgattcaagtacattacagtagtcctttcttatctggagcttggctttccatagtttaaattaccaatggtcagccatcttctcaaaatgttaaataaaaatccagaaataaacaattcataacttttaagttgcatgccatgcttagtagtgtgatgaaatcgtgcactgccctgtttagtcctgtctgggacgtgaatcatccttttgtccagtatccacaccgtaggcactacccacctatcagtcacatagcagccatcttggtcatcagattgactgtcatggtatcacagtgcttgtgtcctagtaacccttattttacttttattacagaatattactatgattgtcctatttcattactagctattattgttattctcttactgtgcctaatttatgaactaaaccttatcctatatacatatcctatatacatatacatatcctatatacatatcctatatacatatatcctatatacatatatacatattatatatacataatataattaggtttcagtactatccgtggattcagtcatctgctagaggtcttactgccatggggaaggcggaactactctactgcaatcaatttatatcttcattatgtgctaaaggaaaattaattttaagaaattcaggtaaaactatattcacgttctcttatgtggcttttcatatctaaaattattatacatattgtgctgatacataaatacaaattgtaaaatgtgtcctatgtaaataaagatggaaatcagaattcaataatatttcaatggctataccatttaaaaatacacatgtatagtcaatgaatacaatttttaaaatgctataattttttagccaaagcttttatctttcatttgagaacttgaagactgtcagcaaatttcaaaggctttaatcatccaaatttttttaacattccaaagtattaaatattccaaaagtagattcgaactttctttaccccaactctgctttaggaaccctagttcagtcaatgattctcaaaactgaaaattattttagagacagaaagtcttctttgagataaatttaacaaaaatttaatcaaaatattacttttaaatgttatctggaggggagaatatggtatgttcatgaccttacagagtttatgtacatattttgaagcttaccataaactttgcttttaattggttactatatgtgattaacatcaactatcccaacacttaagttatttttataattctcaatattatttgtgatatctttctaatcaatatttttgagttttacctatttttattgaattatctttcttttcttttttgtttctgtaaatttgtattcattgtttattttttaaatttccttccttctactatctttaaaataattgttttttcctaatttttaaattagattattagtgtagcagttgtatatactttatatatatgtccgtgatataagatctattccctataatttcatttttattttgtgaagctttattaagtttttttaaacctttttatttggtcacaaacactaacattgttgcactgtgaataggtaatatggtttgctagctatcttgcttattgtcttccccctttactggaatttaagatttctgagggcaggattttttgactgctttactcattgttatgtcctctgaaccagaagagagcctggcacatcataaacctcaataattacttgttgagtaaattatttcattctagaggtttcagctgtcttagatcagtttttatattactgcttgttgttgttgttgttgttgtttggatttctataacaaatgactgtgtaaattcaagccatcaaccacttttcacacagactggcattttcaaattctcgggttttttttccccttcacttattgcttgtgttggatagaaagttctcttaatatcagtattgctttgttctgatgtgtaaagtgtctctaggtctccagttcacagattgtacagcccttagatcagttgtattcgaggccccttttctgccctctgacttgggagaacacaagatgtcttctgtttctgtaacagtcattaaaatcctgtcctaagctggacatggtggtttgtgcctaccattccagtgacttgggagactgagctgagaggaactcctgaacccaggagtatgaggccaacctgggcaacataacacctccatttctaaaaaatcaaataaaaataaatcctgaactgcaatttcaagaaaatgttctaatgcatatttaagcctgtcactacttcagttgccagcgtttcagctaaaatatacaatctatctttaatttcctttttatttctagccctagggatttctttctttccagcttagttagctgttaaaattttccttacatgttttatctagcatttttatgtgtatgtactaatcaatcttgtttaaatctcacagtctttaagtcttgattggaaatgaatatagccaaatcttgctggcctaaaactgtttcatttctttgagaaaatgtgaacaaattacctaaggtcattttctgaaagcagccataattttcttatttcagaattcctacagctctttgttagacaaaaagattgagcaccaccaggttagaatttctcatcttaaacatatgcttccttattctcatgaaaatactctgtctttatccaaagagattgttcttaggatcccaaaataaacatatttcaccttctgaaacatatttacagtctcgacaataaacatcatgtaatagtatcataacctgatagctaccagtatagccaaaaccaagcttatttattcaacaaatatttgttgcactttgattatttgtcaagcactatttttatgatgtattgtgctagttgctggaggtataaatttaaataaagtagataaagtccttgtcatcatagatcttattttctgatagggaaaactgtcaagaatagcaaatccaggttaacccagacccaactgaatctttcaaaatgtcagtaaatacttctaaatgtcctcctatgtgccagtgtggcaatcaccaacaaaataagaattcctgttgtgtgtatcttatagtcaagtagggaataaaggcactaaatgctgcaaagaattaagtaaataatcgtaactgtgcaaagtataggctgagagaaaaatggaatattttagaaattctagcagaatataactcaggttttacaatgagcccatctagcttagctagactgagctttgacctttagacttggtagtctttactggttctacatttttttttttttttttggttttaagaagcagagggtttaataggcaaaaaggggcaagaaggaagggagaaggaagaagctcccctgtacagagacagaggggtgggcactccaaagccgagagacagaaccccaagtgtggcggaaaccagccaggtgtatatatagacgttggaagaggcagtgtctgatttgcatagggctcaggggattggtttgaccaggcatgtcattcacctagcccacgaaaaagctggctctcccaccctagtcttttaatatgcaaatgcagggcaccatgatgttctacacacatggggatatgcgggggcagtcatgttgccagcaacatgtggggcaggggcactggttctacttttttatcatgtcattcattctatctctcttgacaccataccggggtccccactgggtcatattaggtaatttctaattgctgatgttgattctcagtccaggtttacctctcagagcatctggtccaggtgttatctgtaaatcttacacccttctttaaaacttaaatgtctctcaacatgattttttaaaaaattattccttccccaggggacctgaccttggcatagcagactgtgccttggttagaattttaaccttctttggagctactctagtgataaatcctggggctggcactcagctttctctgacttcactctgaggagatgaggcccttttcatatgctgccaagagagtttgctgagtttcactcttggctttcaattacttgttaaccacccttagcattttgttatcctttttctagaggtcagtagagtttggcaatagcatgcaatccaattgctcttgaagctactatttccctcgcgcttttcaacatcaaaccagttagtggattcctctttcactgatatatcccaattcaccaccagtgaaagttgcatgattttatgagtcccttgtgccagtagaatctagactccgtgtgctcagtagtgcgttcctcattgccagctaggcaatgagaggtctagctcaaagagtagttttatcacttgcattttcagaaaactcctgacataaattaccatattttggattcattatttgattcctatacatgattgattgtttgggtggtataaaattggaaagacatttttcctaaagttttgcaagcattgttcccttgacttatgacttttgatattatacttgagaatttttacttatcctttgcatattatttttaaaaactttgtttttttttctctatgttgaaaagctcagaaaatattttctgttttcttttcatttgaaaatttgaaatggtctcattattctgattgtttccaggcctttgttgagcccttcacaatctaaaaatgaatgaactttagtttcaggaaacaataatgaattattcctttttacttcctctttcctgttatctctttctgaaatattaagaatcagatgtaaactaataatatgtctatatattatttatagataataatacatatataacattttataatatatatatcagtataaatattttattaattttctcattttctcattttacttctgtgtggcttttctttgggggagaatttgctttctgggaaatctgcttaattttatatttcaagctttctctttaattttcaatttttcctattttctcagtttagagaagctctttttctgttatctgggtttcccttttacatcatgcccctttgtaactgttgtttttaaatgggtgaatatgctgcttgtctatctgagtataataattatatttttgaagcttttttttctgtttcctacattgcttacaatttctccctcttcaatgtttctggggttgtttgtttgttttaagtgttagaagatttatccagagatctaacaatccctatctgtctgctcatacttaagaataaggaactaaatatcagattggaagttatttaggcatttacagaattttaaggatctggtacagattaagttgaccaaggagggatccggctgtttcagtaatacctccaactgttaatttttctttccctgaggtgggggagctggtcctacctacggcctggaaatcagaagcttgagtgactgtgatctggcagctgagtaggaagagaggtgtggaccttcaacactcagtgcgtagacctccattaaccccagtttccacacggcactcccatctctagtgatgcctattgttcaaaattgcaaattccttccattttaacatttccagagaaaaacttttcaaaattgtttttaggtgttcatgtgtatgtttgttgcgtgagacgtggtagaggggataacagtgcttggaatggagagtatccaggggtctaaatgcttctaacactgatattcaagtgacttcccgtttcagctccatccacacaacctggccttcacaggcagcaagcgtctccaattctccatcttttaaagagttattcaatggcagtttcattgcttcttaatttctttccctattgtcacttacttctcttgtctgcaaactaaattacaaatgggcatttttaaaaaagatgttaatacatcttttctcttgtgacttcctgtccttgtctcttctttgctttatggaattacatttttaataaatattttaatagttattttgtagtgtttgtggagtttgtagtggtaaagatgtgtttaatctgctacttgtaacccaaaacccgtaagtcacctcaataaagtgattgcaattttcaacctctcattcagcacccccatccagttattcaacaacttattcaattcaaacactggaatatatctccagtcagcccaataatctccatttcctatgctactatacaatgtcaagccaccatagtatttgacctaagtcacaattccagtcttatccacttctattttcaactgaaacaaatgtatttatctttctaaaatacaaagatgactgttattttcctccttacaagatttttaacaatttttctaattcctagaaatactttctaaactgcttcgtaatgcacacaaatcacttgagaccctgattctcagccatctctctttgtgcttggattacattcaatttatgatacatccttctgcctttcttaaccagaggaacatgaacatggggtgaagcatgcacatacacgttctctcatacacacacatgctaacatgctccatcaatattaatgtacttacaagtctataaacatgcaagaatttttttatactggactaccaaccaccaaattgtccactaaaataatgtctttctttatatttttaataccgtagtttagctgtaacccataccaaggtgcccttcctgattctgtgttagacaatatgttcacataatactttccatttatccaaaattatcattatcacattgtatcgaattctctttctccttcccctgtacaccacttcctgtgctctaacctcaagactgtaagcctttcttttttttaaaactgcaagctctttaaagaatccttgtgtcttttcctgtatctaattttaatttctgatatactacatggcacagcagatgctcagtaagtatctgataagccagcatccaatgactactacaaggaaagcgatgggattctaaagttgtatgatatatatatatatatataaatgtcaaaaagctaggggaatatgaataatcttcgttataactagtttgtggtgggaagcaatatatcattagatttgttcttttttttacgaggaagatacaacaaataaatccttataaaaacagccaataaatcatttatcatcatattgattttctcactagatttgttttttaagaaaacgtttatttgctggaagaaactaacaggaatcttttttgctttgcttttgtaagtaaaaacaagtgaaaggaaaagaataggctgtatgtttatagtcaccaaaaagactgcaaaaatgtgacagaaagaagagaataaggtctttaaatatcttttcaaattaaagagtagactggatctatgaataccaaacatcagcggcatgcaatttacccatgtcataaacctgcacatacaccccctgaacctaaaagttgaaaaacaaatgaagtataataattatttatagcatttaaatgatgaccaaatcaaagatgaattatgaattcagttagttcaatcataagacaagaaaaaaaatgtacatctaacaattagcaatcacccgataagatacagaaaaaataattaactttttatgactatttttatttcaaataagtgactgaaaagaaataaatttcagtgggatttttccagtaacagttttatgtcactaaaacaaagacaaattgcaatagaactttcactgtagattttaaataagagtaaaatcattccactttggtttcattaaggccaaatgtagacaaaggaaataagaacatgatcacattttattctcatctgtttcttacttctatgtaaggtttaacttacaaaagtgttatcatttcaaagatacgatttctggtatgtatttgaaaggcaaagtaagaacaaggtggtacattatccagaagcattattttttcttattctttttatttattttgcatttttcttaataaaagaagaatgaaaatgcaggaaaaaatttcctctctacataatttaaaaacatctttcaaattatactttagagttcatttgcaaaattatgaacaatgttttacatgcagtttttcacatgctgaaaacatcagtttttacttaatctccttatgctgtttctttcttccttcctgtagataaaagcctaaagtgggtttgcatggattacagcttttctcattctcctttcatcatagctcattgttttgcataatgtgcataaaatacatataatatatccaatccattttagcctcagatcagagcaagtattgaacttttacaagttttataaaatttgcaaatttcactcagcaagacgaaaaaatacatacattctaatgacttttaatttggtaaataaatgttgttaaaattaatgcatgcacacacacacacatacacatacattaggtgtttgttcattaagacctaaaatttgccatttccacactatattattcacacagaaagggcatcaagcacaatgtaccataaagctgtttaacttctccttaattgggaaaagtaaactcaaaatatctaaaaggcaactttatgacagaatagaaatctgctataaaagcaacattttcatgagtatttaaaattatctctacattttaatagctatttggacaggaatgtgtaaccaaagagaaaacttagaaaaaggcagcatacaacattgaatcagtgatgaattaattgttggcagcaactacaaccatttttgtattgttttgcatttaaaaatgttttaacctgtgtacaaagtgtaaactaataaatactaattgatttaaatacctgattcaatgtttcttaagcttgagacacatattaaaggaaaaattatgctatgtctcacaatattgcattatttccagaatgtcatttaaattagaatatacataaaacatggcattaatcgtatatatttatagtttttatagaaccatatgactggaacaagattttaatatacttttcatagaactacaaaactaatgaagtttaaaataatagtattattatgtggtccatagcattgttttctgaatgaaaaaccatcactcacaatataactatgatattcatcatcctagtgcaggttctgttgagctcatcttgtctgtactgcatttttttccttataatgactgactcaattttctcacacttttgggtattcaaactactgtgaagcctttattcatccattatggtatgatgtcaggtggatataacttggctccacttttagatatacatattaaccttgcccaaattatttcctattaacttctaatgatgaaagtaacaccactaggcagcaatatgatggtaagaagaatgtgtctgtaactcataatgttctggatcagcattagatcatatatttacaatccaaataatcaggaaatatttttttagacatttataaatattaaaatataaaatttagattgttactgtggagaatttttagacaccaagtttatgatcataggcttgcatttaaaaaatagtaccaaaattatacgtgctgtgacagttagttgctacctaaagttaagcagtaccaagctgtgaagagttaatttttaagattaacattaatttggagttctaatatgagatcaattgccattgaaaaattgagaaaatataacaaagatatgattaatacctaaaactccaaagcacagggaaattcaaatattttaggaagataaatctgttttcaatgcagcaaaagcagcatgtacccgtgtccaaaagttgtttatttatttggcatagtcagctattatattgtataatgttaggctaagaaagggtttccaaaggaggattcctttctgtctccctgtttcggtctctgacaatgtcaaagtcataattgttttaatttcatacgatcttgacacgtgtgtgtgtgtgtgtgtgttagatgtaacattaagggaagagctttagtaattataactttaattgttatggctgattttttagaagaatatttccaaatataaaacatatatagaaattcataattatatggaaacataatttttatgcatatttcaaaactgatgtatgaaagtcatttagctaattaatgagtcagaatctcttcctacatttgcattgttacttgtcactgtatgactttagaaataaagccacctcctagtactatttatgagaacagatggaatatgaagagtccaaaaagaaatgattctttactggatattttcaataactatgtaaatggcttaagctttgtatttattggtgtaaatcaattaattccaattgtagctagtgttagctatattccactacatgttttgggtaaattatatgctataaaatagttgaaaatcaaaaatgtaagaatttgatagctaaagtctcacaaaattttaaaaattaagtatgacctgggaggaagaatactgggcagtctttaggaatgccctaatgtcgaggatcttaagtaatagtagggaatgtaaaaacattgagttccgttagcagatgaaaaaaatgctcaaatgcatattggataattttgcctaaatgtggctttaatacatggttgtaaatttgctattgcagatgtaactagatcacatgctagacctgatcaaaatacagtaaatgttgtagctacctttttttatttacggtttcaaattcaatggcttgagtttcaggaataaatattccagtgaatatcattgttcatagttgatgtccaaggactatactaaatttcctcttcttcatctgttttattacataagttgaaattttaagaaaatgttttacaaatgtctttatgaacaattatttttccatctgtttttttttgtttgttttgtggtaagaatatttaacatgagatatactctcttagcaaatttttaagcatacagcccagcattttaaagcacacaacacaatatttttaaccctaagcacaatgtttcaggatctctagaacttatttattttgcataacaaaaactttattcccattgaacagcagctccccattttttccttgccccaggccctggttaatcaaccattctactctctgtttctacaagtttgactgttttggatacctaatataagtgaaatcataaaatatttgttgttctgtgatgtgcttatttcacttagcataatgtcctcaaaagttcatccatcttgtaacatatggcagctatcccacttcaggctatttatgcaaaggaattgaaattaggatctcaaagagaatttttttaccttcatgtccattgcagcattattcataatagcctagctgtggaaacaatttaaatgtctgatatggtttggctctatgtcctcactaaaatctcatattgaattgtaattcccaacgttggtgaggggcttggtgggaggtgactgaatcatgggggcagacttctctcttgctatcatgatagagttttcacaagatctggttgtttgaaagtgtggagcacctcccccttctctcactctctcttctgcccaccatgtgaagatgtgcctacttctcctttgccttctgccatgatggtaagtttcctgtggcctccccagaagcagaagcctgaccagagccaattaaacttcttgtctttataaattccccagtctctggtatgtcttcatagtagtatgagaatggactaatacagtgttcatcaacaaatgaatttaaaaatgtggcatatacatacatattcagcttttaaaaaggagaaaatcctgccatatgtggccattgtttttattccttgaaatgggacaattcaaataatcaattcccattactatgattttctgaaaaaaatcacaggatacataattgagataaagtcttctattataccccaccaaccacccacacacaggcacactgcccaatgctaagcatttattcttttctgtatcttggacatttatactacagggatagaaatagacattaccagccaggtgcagtggctcatggctgtaatcccagcactttggcaggccgaggcaggtggattacctgaggtcaggagctcgagactagcctgtccaacatggtgaaaccctgcctctaccaaaaattcaaaaattagctgggcatggtggcagatgtttgtaatcctagctactcataaggctgaggcagaagaatcgctagaaccagggaggtggaggttgcagtgagctgagatcacatcattgcactccagcatgggtaacaagagcaaaactccgtctcaaaaaaaaaaaaaagaagtagacattgccttttattttgaaattatacatgatatttgtgtttcctagaagtagataaagcaagcaaatatcattgaagaaacgcaagatgaagtgggtggttggttgaaaatagagaggaagtagatatcccgagtatgagagaaggaacaccattcttggttggacaaatatctataattgtttttagtaggattattttatgtttctacatatcatgccacatttttatgcagtatcaaattttgaggactgctattgggtacttcatggaattgaattctgaggaccaaagtcttgaacttcttcatgattaatctctgcatccaggattggcatcaaactttatggcatttcactctcaagggaccgtgtaaacataggtgaaatacctggaatgaccagaatattgtttcctaattgttcttgatttaatacaatttttgacacttttaatgaacttcagtgggcaggtaaactcaatggctggattttagtatcccctaatgagctgtgacagaattttagattagattcaatttgatttggagaaaaataaacacagcggtacttttttcaaacatatacatgctcagatctgctatatgtgaggacctcatccagatgtgtactgagggtttatgcattgtagaatgatagcaatctacagaaatggagagagatgcttttgagacaagagtgttgacctagttgcaggacttgcgtacgtggatgagtctacactgagaagtaactactgatttgaagtacagcactaacgtatgctgaaactaagttgattaaaaactgctcacgcatgaaacaaaataaaaacgcgtacatctggatgttattgaggcagtactgaaagaagacaatgcttctgaaaatccaacctatatccaacttacataattatttattcatgtttgcccaatcatagaagattatgctttttacatggaagcaaactatctctggaatcctttagtgcctcaaatttatatgtagctactgggatgggccattctttaagagacttacaggtttactgatgaaaggggttgtagaataagtagcaaggagagaaacagctgaccagttgcttttctactactacttccaggaagaaaagaccagcagtgtgttctaaaaacccattaaggggagaggatataagacagtcccacaggagtaggagacaggagttagagatttagtagggcaatcaaccacttaaaaatttttagcgtgaatcccaagttatttgatatacagttgagtttaaggctctgaaaataatggacacctgcttctaattctgccaatttttctggagaaatagcagaactacagggagaaatatcagaccgatacacacagacgctatattctgaggtatccaaacttccatatttggtcaagtactgtacgttgagccagaaagagcagaactgactttcctcaaattaataatgtggagttgaatatgaacatttctattacaatgaagagttgttcttttgcatatcctagacaccgtttaagcctcaggtatttttgtgtgacacaaagatgtgtgagagataccaaaacatattactgaagttcaattttacaccattcttgtaatttggggcttagggattatttagagaaattaagcaatgtagaatatttttctccggcgggtggtgaagggaaactcacatcagttatattttcattgtgagtgcttcccatggtagtcacaaacacatccatttctccagtatactgcggaatttcaaacaaggagaaaaatctgatgaagttcagctcctgcctagcaaattctaatcgggttaatcaatatcagccagctctaccttcaaaataacaaatgttgtgacatatgctatgcagagtttggcagcaaacaattgaccaagaaaagaagtaatgggatcagatgtgaggaaagagaaaaataagtatgatagcaagaatacccgtactctttaagaggtaaggcagaagaattaaacatttaaggcacagcagggattgacaaagaaaaaaaaaattgaccttcagggaaggttcccagttcggagatgtgagattattgttaacagacactttatgcctgaacagtttgttatctaaatacatttccatggacccatacgtttgaaattaaatgggtgaattttcagagaaatccttagttttcccagcattgatgtcttcccaaagcatattatattgtgttttaaaataaatgattaaaagggtatatttaacacctcatatattatatctcacctgattgaccaattgccaaataaagcttatctccattttttctgagtttaggattatacttataaaataaaggttactataaaaatttggttttttaaattatactttaagttttagggtacatgtgcacaatgtaaaaatatgtttttatttcccgtaaatacttttaataagacatttaaaataggttaaaactacagtgcctggataaaagtgcttgaatctcctaatcctccatgtaaatcttaaataagcaatatacccgtgagatctctaaatccacaaatgcaaattgtctatttatgttgccaacaagccagatgacattcagagcttcctcaatacccatgaaacacctgcttgctccaattattagattttcaaatgctatttaatatctcatatattacataaattttatggataaacctagatatatatacatatattaaaaccattattttcttcattatattctttataatcgtattaatataaagtaacaaataaatattaagtaacaaattcagaagcagatcactttttttctaaaggaatcagagagaaattttgtcacacctacatatgcctgcatagtgtttaacttggaatgatacaaaagtctttaattcatcaattacactattaattttacatattctaaaattacatactcatatctccctcaagattttcaaggttccttatcttctttttcataaagatgttaaaacataattaatggcttggtgaataattttcatccatacagatataagaagcttaggagatatcaaaaaatatgtttaaaaataagctatttatggatctacagagtccttcccatatgttttaagttactttaagcttttaattcttgaaatgtgattagattaatctaaataaagataaaaagaaagcaagcacatgcgacggatgccatgttatccatgtagttctgtgcatattaattctaaaattgactatgttcctaggcctacagacctggtttgaagattcattctgcctgtttctttgtttctggttttttttttttttttttttgcatcattagcttaaaaaacattgcattaataactcctggtgagttgaactcattgtctccagtccaagtggaggagatccttagtctccttccttccataactctcttcccacttgaactggagatgatgattattgcataaatgctcaggatatttttgcatttgaacccacataattaccccagcctaagtaaagtagtcataatagacttttcattctactcccacatttaatcaatagcagaatattttatttttaccttccaaattctctggatcctaccctgtcttctcccattatactgctttagctggactcacattcccctcaccttgatcattgcagtacttggcactttgtctctttaaccagataaacctctcccaaaaattatttttctaaaatacaaatttgaccatttaactccctcacttacaaacttggaaagttacaaacttcaaaaggaccctctctcattgtttatagaatcagtttcatcagttcagtaagcattttttacaagtctccatcctaccccacaaatactattttgttttacctctactacttttttttaatttaaatgatggttccttgtaatccatcaaatctcatctttctttacttccatttttttcttatgctttgataccaaatatatcaatgtgataagctcatcctttgagattgaggacaaagcatacctcctgttgaagccttacacaatctctcaaaatatagtaggtttaatctttattttttcactgaaactttatgtacttgtagtgtgttgttcttatatactctattccatttgtttacaagtttcactaaaatattgtaagcttattcatttaagacatttatctaatttattcatatgcctttagcatatgttaggttgaaagcatctaacaaatattcattaagtaaatagttaatttaaaaaattgatctatgtagagtgactaggccatatctgatgcaatctatacctgtgctattctgaatatatgatatatattatatctatctataatatatataagtacatatataattaatacatttatacctatgtctgtatctctctatctcaaataaaaaatgttacaggagccaaaagaaaacatttatagttttaaaatttttcacatatttaagtatctgaatatctacataaataaagtagaattggacagtttaatctgcagtttctttagagtaagcaaagtgaatgtctatttctacagaaatggaaaatactaataacattctctgactgtctttctttgtctctctataatatacatgcccacacacaaatatacaaatacattgatctttcaagttaaaaaactcacaatataatccttttatcttccaatatatcactatcaggtttatagttctgctgaactgaaaaattttgggagaagcttagaaaacttttatggataaagagaaatcaaaatcatgcttttaaaattggaaggcaagaagaattttcagctgtataaattggcctacaaaaggtattgctaaagaaataaagtatgctgcaaatgtacagatgccctgacctgtggagatacagtaattccactgacaataagcatcatgagcaattatttttatttccttactgcccaatgtctttgatgaaaaagtactatcaacctagactacagaatgtggcattaaagtttaattctcttcaatcaggtaggcagagatcaaattctgacactggcttttattgtggaagagttagaactttctgaaaatctcttttaaaccactgaagcaaaccaaaaatgttataagagccaaaagaaaacatatgcagttttttttcacatattcaaatatctccacacctacataaggaaagtataaccagagagtttaatctaatttttttttccaaaggaagctttttttttttttaaagtttagtcttgctgcttatttaactctttagattcctgtcttgtttttgcattatcacagttgtataagcaggctttcctataaattaaaacattaacagcagaaaagtaaaataccatataattccatacactgacattagcttttttacgtttttacttaaaaaataaaaataatcatattgatagtttttttgttttcaatgtgaatatgacttatgaagtgtagctaaaatttgaaaatgtagctgcaagcatgggatatatttttgaaaataatgaacaaaaggacctgaattttgaacattttttcacaattgcacgtcagattaatctgctataatagaagcacacattaagcacaataaagtatttatcagtgttcaaaattactattttttacgcccctctcatctgaatgaactgtctttctaaataatgagaagtttatctcattgtttcttttaactaattctacttcaatttttataactttatagttctgggaaatacatccttactttcaaaagggcatcacttccagaaaacatctgaatgtttaaaaaaaaatcatcattttagggccagtcataagtttaaaagactgaaaagtagcacatgtaaatttgtaaaagtcaaatgtaatttttttatataggacaagcattaagcactaaaattgatttaacgaagatacacttttgaagaaaacataagtgtttatatttttctcaccactgataactcaaatacagattaaaaaccatatcattctaagaattgctaaactatatacacagaaaaactgtatttttatcaattcattcaaataatatactatacagattataaaaggtgtggaatgtttcacatccaaagttacttacatataatttaacattttttttgtatccactttttaaaagaagaaaaagctgctgaaattgttatatactctgggttgatgataactgactctgtaaatttctacctttgttgatgaattgaacattctatagctatttagccattatgtgtttttgaatcctttttaatgtattttattaaaattcttttatttaaaatgaaaaggctaatagatgtgtcagaattatatcaaagaaagaaaaaagtacaaagaaaagacaaaatcataccataattttattctaattatttcataatcacctatgacataaattggcaagccaggcttcatgaggagaaagaaggaagtggacatggtagaaagaaatgtaccatacccgtcttaactagtcgctgaggagagattctccaaacaagtttatctttgccaatctatctttgcctatctcatgaagtcccctgccacactctgattaggttggctgtagaccatgctatttaataaatggggatactaatttgttataagagagttataacaaatttctttttctttttttttcttttttttttttttttttgagacggagtctcactctgtcgcccagcctggagtgcagtagcgcgatcttggctcactgcaagctcctcctcccaggttcacgccattctcctgcctcagcctcctgagtagctgggactacaggcgcccaccaccatgcccggctaatattttttatttttagtagagatgagatttcacctctgtggctaacacctctgtgttagccaggatggtctctaactcctgacctcatgatccatccgcctcggcttccctaaagtgctgggattacaggagtgagccaccacgtccggccgagttataacaaatttctgagtttcataaacagtaactaaacaaggtttttgagcgtgtaattctttatgttccagtacctttgctctttcttgttaaccttctcttatcaaatgaagcagacctataaataaatactgtaagatggctaacaaactgccaccaaaataaaaacaaaataaacttaattttatattatcctaatttataaaattcttttaaattgatacttcttcattcatacttcatattttcacactactaatttacctaaagtgttagtgcaaaattaaaatatgcagataagttatttttaacatcatcccttctctgttattctccattaattaataacaaactatctcaagatgaagtttaccagtgagttccctggttaaaatcagttatttgccaatttgcttcatgtaaaaagattttatgtatcatctatctatgtgtctaatcatctatcatttatcatctatctctttgtgaacatctgctgagactagactgatttgccacaattatttggctaaactgatggcagccacaagccctctggagtggctactgtgaagacaccagctgctgtggtgaggcgggcagctccaggtgctggcacaggtgctggctccatgcaaggttacaactggaccagaggtactgcacgtagctcccactgcaggcacccacatctggacgaggggaatgcagtggttcccagaagcttggagatgccatgtggtcctcagaagcttggagaggagcttcattgatcagcagaacagctcttaggaggcccgaagtgggtagttgctttctgtaggcaggttatcccaggagacccagagtgggtagctcctttccagctctctgcagagagcaaatctggagtgggtacctccttttcataggcaggttgaccctacaagtcaaggagactcaaattgggtagctcctttccacagctggtcatccagatgtctctctgagtctggctgagtagggggactgaaggtgtgtgtgtgggggggttggtttatgggctttagaagggaggaagtctgtgctgattggccatggttgggtctggaaaaagcaccatgagttctaaatcccaaagtagactccacctggaactgacagcctggccccatgcttcacgccttccctggcttgaaggtggggcatcaatggggactcacccctttctgcccaggagcctgtctgcctcccaccatcatcaatcatgttgtccaaggcgctcaggctgttcttgtggaggggcgtctgcaggtccatagggagctaccctcagcatccccttggcctccctcttgtgtttgtcagtgcccaaaatctggagggggccagggcggcagagggctggcatgtcagcatcacccaaagcatgggcacacctggccggtcctgacagtgcctgggcttggcctcaaccttgctccaaaattggagcaggtgccaggagtggggaagagtccaggcagcaagagcaggcacttccaagactgtggggccatggggtaggctctccagggcccccagagcacagggatgcctgggttcacagccatggctgggtggctgcagctgcgcccgggagggtagggctctcacccaaccgacttggaagggggcgtggttcctgcctgctccttggagtgtaaccctggctgtgcctcacctactgcagccagtgtctttgcagtggctggtccagatgggccacacctacaatcaaaattatctggaggtatgtaatttattacaataaaattgttatttattaaaggcatcaaattttgctttgagacagccatttgatatttatcagttaaaatagtttgaactctttctctagaaaattcagtatacttggtataacttgtttagtattattaaagattaactttgataggaattaacagtaaagatagtagaactggacatcaatatttacttcttttcacactctagtaaattaaaagaagtgtgacatataacaattcacttttattcttaccaaaatttaaatggtgaaccattttttactatttatcttgccacagaaaaccaccaaactcattaaccatctggtaattatgccaaacaaactatcataaatccataattattagtgccacaactctctttaatatggttaaattgtctacttttttttccttcatttttccttttggtttcaagaaatacagaattgtaattaattagtcatgtttgatcctatggatcgtatatgcgcctctttggcttttggaatctgatgacatactaaagcaacctatgtttgataaaggtgttttaaaccgtagaaaattatttctgcttcatcaaaggaaaggaatttgaatatatctgtgtatttatattttctgtgaaatagtcacaaatatattttaatatacataaaaaattcacatatttgtgattggagactaaaactaatttgtaatttttgaatggacacaatcatcctattaaaatgtatcacatacatattttcttctgctaaaatctatttataagaacttctgaaggaaatacaggtacagctatgatttctcaattttcaaattccaactgcaattttttttgtacatagtagttttccaaaaaatatttgctgaattaagttatataataattagatgaaccatgaaattaactttttaaaattttaatcttattttgaaatcaattagttgcctaaaaaatacagcaattgccaattttcagtgtaagtattatgtgtaaatcagatactctttaatgtaaattcacttggtgaattaaacgagtagtctcattttattttctacatatggcaataaagtaaccttaattgtatccccaaatggaataaacagatgtatttttaaaattgaacttgatgctgttgagcaaacactatttgtgtttgatagaatgaaatctattatattgaatgcataggctttttctgttactcgtttaaatttttgattgaacatgtgatcactaactgtggtttaccatcacatttagtatagctgacattgattttatctagaaaataatctagatttacctttcaaaaataatttgatcataaattattgctaggtattttgaaaggcaaactataataaattctcactactcaaaatatatttttatttatttatctatggaatgacacagaaaagtagaaatcataacaggactaaacagaaaaaggtgtgtaaggtattacattcaaaatcagttccaaaagttatgcaaaagctggaactatgaaaattttaatgaattctaatttattatttaataatatttatttagtaaaattatattttagattgattcaatttgttaataatatttgaaatatctgtaagtatttcaaaaattctgatttggagaactaaagtacaaaaatacataatttttaaaaatcccaaggaaatttgaaattctagtaattttatttaaaacatgaacaaagaaaaatatttagtaagcaattataagggttgtgatagttcaggaggtcatcagaaaaagatttcattattatgagatgaaattgtaaaaaaaatcttacatgtgaatataggaaaaggcctactaatttgatggataaaatataattttaaaattatgacataattactaataagaatacattaaaaaatcaaaataggttgatgttttaaatttgaatctctccatgttgtgaagtaatagtcataaatttagagtattacatgttccatcttttatttttgaaaatataatctctatttaataaaatgtcacctaaactacagctgttaaaataccaacatcattttccaagctgtaaaactaattaacttaaagctaagttgattaatgatagttgaaaatggttattgtacaatcaatatcactaccctgtaaccatcataagttacctaacttctcttagtctttattttggagttttttatctaagcatataagaaaatagcttctgtccttcctcaatatgataccagtatggattacttatctcaaatattttttttaacaatattataggatatcgtggtccctaagaatatataatttaaaataattcacttttactgattttcctgcaatctttttaaaaagaaacttgaaaatgtcaggaatcaaacattaaagcttactaatcttttaacaaataattagtgtgaattaattatgctcagttcaaggtagaaagagtaataaagtttaagtaaatagtaagggcaagaatatgaaacacttcaaaaatatggagataacgaccaaggagaatcaagtctgggaaaaaaaaatcatataagattaaagggaaatttggagctggagggtgggaaagttgtggggatggatgaggactcggtaaggcaaaggcagagagcactatggaaaaaaaaaatgcctggaacagggtttcacatattaaaaacaaaccatctttgtgtctcagtgctttgttttataaatcatttcctaaattctgtgtaatctacagattaaaaaagttatgtataatgtctttgcttatttctgtagtcctctgctgtgtgagtctaatttgaattttagtgtaatttcaacatagcttttacaggttaataaaacttacatgcattaaaatgctattaaagtgttacacatggttaataatacttatggatttctgaaagcagtcattattacactgaacaaagtcattaatgtctttaaactttgcatcaggaaataaaatacaaaatagatgtctaactgcaagaatagtcatgatatctgactataaatatttcttctctttttaccatatatttttttcttttgtatttgatatttcaaataaaatatactgtaataaaaataaatgagcaatgcattggattctggtattgaccttcccactgattgtgacttcagctttgatgactgacagagtacaaacctccttaggcctttgccttgtcacctatataataactaggacactaaaggtaatctctgtaatttccctcagccctaaaactcaattgagtttacagctagaaatgaaatcatcaggtattatattttctgaacaaaaatattttcaattattttaaataacatatatagtttgggaatggcaaagactttgaaaatcttatctattatttgtcatgtaacttttctctacttcagatgtgcatattattaaattggcatttcttcattacgtaatataaagtcaatcacttaaatgtttggattgcctaaaacatacattactaaaaataagtttaggtgtttaaaatgtccattcacttctctataaatcacctgaagtatggttatagaatgatatgttactacacacctaacatctaagtaactgtttatctaaaagaaatactaacttattttgcttgaaatagttaacttttattttatttcagtatgcaaaacatactgcctatgtatttgtccacagtaataaggagactatatgtcagtggttcattcattttactatccagagtcacattccaaacaggcttaagtccttccttcccttccttctccctccgtccttcccttacttccttcctccctccctccttccttcctccctccttccttcctcctttcccttcttcccttcttccctttctttcccttcccttcctcccttcccttcttcccttcccttcttccctttccttcccttcccttcccttcctgtttaaataatctacctatgatcacgatatagcacactaaggatttacagtataaaacatgctttggaagaattatattttcaactggcacactggagcaaggggacactgatgtagacaatgtcatatggtagcaacatcagagtttatcacattaaattagcattttatggtaacaattcaattaggcttatagttttcattgaactttaaaacatttttatagttatataacagcaataaacataatgggtttataactagctttatatttgtatatatcaaatatataatttaactgagacaacatgagatttattttgctttgaaaggagtccatatataaatcaacttataaatttacaaatctgttgcatagaaaataaattcctaacaggttcagtgtctctaaatgtgcctgagaacgttagacaagaccactgaactcaaagtgtaaaaaattatatctaatctgggtttcttggtaattttttttttctttcttcatcaaaatacaactcttctgtgttgatatctgtgctaactaccacagcaaatttatccttgccagaaaacaaagaatctacctatctttcaaaatttagttactgcatcagcaagatttttttaaatgaatactagctatcttaattatgtaccattgtcttagttctaaaataatttaaaataataaaatgttttcatgagaaaaatcagcaatgaacaaagtataaatctgatatgactctgacctggagaggtccaatactcaaaatttaatagtagaggaagatatttaaatagactcatacttgtgtagtaatttgacccttagaccctggcaaccacaacacatgtagtaaaaataggctttcatggatgttcctgtgcattaatgcttgcctctgcccagacatttaatggtgcagccttatttaaaatagtcttaaagacacagaaataattcaataaacaagagtctggcaaatagagttaggatatgaaagtggtcttcggctatatctgggtaacaaccacgaagatcaataaagccgggatataaaatgctagaaactgacacactgagtcaacttaattctgtaacaataaaaagatgagttcagctatatgaactttgaaaaaaatcaaactcttggaataaactaactactctgtaaacagaatataataatatggctttttaagtgggcgttacatttacgatgaaagaaaataatgaaaaactaaggcacattgaaaagtaaaagagattaaaatacacaaatttcagaaaaactagataaaagtttgagaagtaaataaaaatgtgagaaggaacaaaaatataaaaactgaaaaaagtgaaatacatgaaggacagagttttaagtagtgttactcacaatagcaaggatatagaatcaacctacatgcccatcaacagcagatcgataaaagaaaatgtggtacatatacaccacaccatagagtactatgcagccacaaaaaataatgaaattatgccctttgcagaaacatgagtggagctggaagccatgatcctaaatgaccaaacacaagaacagaaaaccaaacaccatacgttctccatataagtgggagctaaacattgaatacacatgatcataaaggtgggaacaacagacaatggggatcactagatgcagaatggagaaaaggagctgaagaacctcttattgggtgctgtacttacagcctgggtgatgggatttttgggatcccaagcctcagcatcaagtaatttacccctataacatacctgtgtatgtgtcctttaatctataataaatgttgaaaatgttgaaatttttaaaaaaggaagcaaaaaaattcatcaaagaaaattttttaagaagtgtgatatacaatatgtaagcaatattgctacccaaggtagactgcagaatgagtgaatcagtatcaatcatctgcataagacaaatagaataattttaaaaattcccctgacttgaagaaataaataacagaaacgtatgacaccacatattttgaataaacacttaaaactccagaaataaaaacagaagggaattaaattataagttctctatatgtcagtcattggaataaatcttttctacatggtttttaattaaataaaagtcattttaacttctgtgaaagaaatgaatcaactgaatttataacatatagcattcatgaaaaaagaccattccttggtttaattttggcaatgacggagatgaaagcaaacttgacagcacttactatatcatcctcagtcaaagataagatctaagaaatttacacttcaccaagttaaaattaatatgtgaatcttacaacacaacaaaatattttaggttggcaattaaaaaaattacaggcaattttaaagggtagcacagtctttaccttttttgtttatttgtgtaatgtcattcagcattaaatttcaattggaaaaaataattctaaaataattataagagcaagcctatggaatattctgcaggtcattaaaggctgaaatatttaataaaatagttttccttgcaagtaagacctcaggataaatacccttaaggtgcaaagttataaagttgagtaattttcccaattaaagtcaaacagaccttagcaaaatcattaacaaaccagcaacaagaatgaagacattaacttttactatgattggcataaactttgaagcaaaaatagtataaagataataacaacaaaatattttaccaggtttttaagagtgacatgattctttttgattaaatttagagaacacaaaatagaactcagaacaataagttcaattttcttctttaaatatcaaataataattttattatgattttacataaacatactatggattaacccttaacccatgaacaaatctcataatttgacttgaaaagcactaccttctatcctagaatatgagttttctttggtaagtaaactatctaaggactgtgttgatttggcaccagctctgacttctcatagtgtagcgtggagtcccagtagaaactgcacctcccaaggcattaccattgacagatcttcaggggcttttaaacacattgaatcagcaatgataattttggagatagatgactcctatttaaatacagtttgaataactttatagcagtaatgaatgcctatgcttatccctgggaaatatgccaggaaaagaagcaggcatcttcagcctgaattctactggcttcatgctgtaaaaaaaaaaaaaatcagccaagctagcctgtggataacttttccctaaaaggaatatttatacaggagcttgctatggtttaggtgtccataccaaaactcatgttggaaccttagtgcagcaatgttgggaggtggtgcctgtacacagtgaatagacctttaaaatagattaaagtctttctcatgagacgggatttgttctctcgagaaaagattagttctgggtacagtggttgtcagaaagcaagcttgcctctcctgtctggtccttcttgcattccagcttccacattcacatctctgccatcctatggtgcagcatgaaaccctcatcagaagccaaacagatgcctatgccatgctcttgggcttttcagccacttgaagcataagccaaataaacctcttttctagtctctgttattctgttatagcaacactaaatggactaagagctcttacagtgcttgatttaacaaatactaacagattgtaaaaatacacattttaggtttatgtttacttattttgataatcaatttttttattgaacaaaatgtatttccatgaattgaatcctgatttttaacactgtatccatcagaaatatacgttcaatttatgattaatgacttagtccaggcaattattaggttataaccctgagaatccttgtagcagtcattttaataattttgttttatataatttccatttgtataaaaaacatgtttactatattttatcaatctacaaaagtacgataaacagaaagtatgttcaaaacacaagatacgagaaagaaggatttaaaatacacacacacacacacacacacacacacaggtacacacacatgtctgatgcatgtgtatatcaaacaaaaatggcatgttaggcaatgtgtaataactaatatctatgtcgtaataataaataaacattgtttgcctatgctaaatgtaagttaatattcttgaacttatatgaaattagcttttatgtatgtcttactagagatacacaccaaataaaaaatacagtagataccaaaatatataagtaggcaaaacatgccctagatattgaacacagaaaatacggaagtgacagtattgtatagaaggcagaatatattagtgtcttaaaaagaaataataaaatatagaaatgataagtatactttactagtaaataactatatatcaagatatacatgataaacctgtcagtaatttaagatatatgacagaaatacagctcacaaattttaacttaacatcatcctagcacaaatgagactgaaaggaggtcaagtatgtgtgtatattttttaatacctgggttcggttattattttaaagttgaacagatagtgactaaattctcaaatgaccaatccattggatatattatataatcagaaataacaaaggaaaaaaattcatctcctaaaatgtttaaaactatacctttaaaaagtggttcaaaaatatagtgattgatagaataatttgcttttataactcaaataaaatttttataacctattaagatctcaggagataggcatagtagtaacagaaatgaatctctggctaggaattattctataaatgtgaaatattagcaaatcattcatttggtataaaatatttgagaaaaagaataaaaacccactttgagaaaggagaagagataaaaaaacaatgataaaatgagggatgatttaactgggaaagcaaaacatgggagtgatatgaatatatgatatttggaaaatataaacaatgacattttgtaattgttattttctaagttgtgcttatatatatataaggtaaaatcttacttcaaaacttagtatttacattgcagagtgcattactagtgggatgtttataagctctcctaaatatatatttacttacttgtgggtaaataaatactgacctgcagtcaaaagtatgtccaggcccatcaacacagatccctccattaagacagatgactgaattaagttcaggctcagcacaattatcaatgcttttttcacagtatgcaccagtgtatccacgtgggcaaatgcaagtaaatccatgtgctgacttctgacagaagccttcattcatacaagggattgatgtgcagtcctagattaagaaatagagaatcaaatttgattattagtataaggttgaccattttaatataattatatttttatttaaacataatctaaaaaactgatgtgcaaacttgtttgacatttccttcctctgttaattgaaatatatgtttatgacagtaagcggttttttaccttttattaccagaaagactgtcaaatattttattgctgatttaccaagaaataaaatcattattaatctttataaaaagatgtatcatgtcagagaactgcccctgcccccaataatggtgctaaagcaaatttcctctgcagataacagaattcactggcccttagtgtctaccatacctctcagttttcccaaaacagccccagttcaactctgctctcctacggtaatgattaatagtacttccattaaatttcaaaggatttctgggtttgatcacatacttagaacaaacatttcacaatgcatttatatccatgtaaaatagctaaaacatctgtaatagctgaagtttgaatccaatcataatcttttaattacctacttttccccatgcatttgtccaaatgtatgtccagcatttctgacacctgtagctgcagaagtgcaaatgtcttgtagagttagaggaatctggataatacctgttactttttaagcttaaaaatattttaaaatttctcatagttttacttacttattcaacaaatggtattttatttattgtaactacatggatgcacaaaatggtgataatatcacccacctcatatggtgtgctatgagagttaaataaaataatggcactgtgtcttaaacgtcatatgtgatcagtaaatattatctttctttcttctccactctgaaggccaagggctcagtcagcctctatttcaatcttttggcacttaatttgaacaagaaatatgtttctctgtatatttagcttctaccatatcataccatatgcttttaagtttacagtttagggtttatatatatacttacagtgtggaaaacacatgtcatagtaccacaaacatggtatgacattatttttcataatgtaaactgaaaagatttgcacccataattctgagaactaatttatggaaagttatgacatcattagtaaaactgtttattttcaagagttttacctaaagataatatcttaatgaacctaaaccaacttgaatcattttgcactctaggtcttgagttcttacattctcaaggataattccatatgcaaacataaaatacttcttcagcgttttaccttgaaaagtgacaattttctagaattattgttcattaattgacacctatgcttacaaatatttagtgactttttaaaaaagtattaacgacaaaaactcataccgacaagactattatggaagccattgcattaatatcatgtatccactggaaaattagatgatgttaaaaatcatcagagagattaattagcgtcatccacaattagaaatgaattgtgcacttcagtataatattccagtcatgcctggaacttagatagtgatcttgtacacccccaccccctacaagtgatagaactaagtatgtttttataaacaaatcctttgatatttgttccacttttgctgaaaacgtgaacttgttaagaaaaaccaagagcacatagtagactatcctgtaggtattgcagttttatttatggaatagaaatgcagaattccacagggagtggcatggaaacatgtttctcccctaactctgtttctagatatgtatagaatgatttattagaaaacattacataaactaattgaattgtatctcccatgggaaaatagggatagtttttagactgccaaaagttctgtctccagggtttcaagaatcttttactaaattaattagaaagcttaatgggaaatacaaaggcaatttctttttagaggaaatcaaattgtcatttaaagttcttgatctttcctggtttaaaaatttaaaaggatgcctttcgttttgttcatcatttatattgctttgctatattctatttaatataataaagtgctttcccaaagagttcactaaagtaatttcagaaaataaaagatataaaaggttgagtatttagagaaagagatggaagctgggaggaatcctgcagaccagggcaatctagacaacagagcttgaccccagtgatatattcattcaacgtgtactgaaaatattatgccaggaaatgtacaggagcatgaaaggaacagggcagtgatatattcattgtgaaattcttagacagggcaaagtacatactgggctagtaaatgtgacagttatctcactgactcagttagttgtgttctctctgagggatgtggtttagatccacagggttgtcctgtgatctcttaactgcctagaaaaggaaattacccaatgtcatctttatcataacatttctctcatggcatcacgttttattttttagcattggtgttttgggtagtggaatactttcctcaattaagatcttggagaaagggaaacagatacagagagaactactatttgaagagtgggaacagaacacggtacctactaagtccctaccattccctctgcaaaggcctattaaccttcacagaattccgtgaactttgtccagttctgaataaaaactgctagtgtagtccagtgtttttaaatgcgtatattcaaaatctcattaattatatgggcttttactttgcaagctgcaggattgggcaatccaaaagactgagaactttgattagacgtaactacggaatctgtagcattgtaagtgatgtggttgctgttggtagtaaaaagagtctggaaaaggaaatgcaacttctcttacccccacttgttttgctcttctgatctaggtttgggctcacttttgcatgagtcgtgataggctttccctaacttagggattcaagatttatgcaggagggcaaataatggaatagctagagaacaaatacctagagaacataatggcatttatttaaacaaaagatacatataccaataagtaataatcacattttgtcagaacaaatacgtaggaaaatatttctaataaacacacaagtatggtagggcacacacaaacaaatgagcaagagggggtcttaaaagtagtgctaattattttatgctagaaatagctagaatgaactcaaacttctgtacctaaaacacagaaagaatttttaagagcaatagacttaaaatatcttaaatatccaaaaaaggatactaattaaataaatatggtgtttccacacaatagaatattaataagaagaaagtagaacaatatatggtagtatagaatatatatataattatatataaagtagaataattttctatgattgattaagtggaaaagcaaggtactctgtgtgtgtgtaatgaatgttcccattttgcaagatcttgtttattttaaagatttgtttctaattaaaggatatcgatattctctaaaataatttgtaggaaaaagctgaccatttgttgagggagatggactccaactcaaaccctctcctggaaagcattctgatggttcaatcatttaatttcaaataaaaagaatgagaagaacttgttaaataagtcccttttaaacctgtcaaaaatcacagaacctttagagtctgtgttcaaataaatctggatacttgaaaataattttctgaatgccagaatccactatgtactaatgaaagaataacaaaaaatagaaaaatatacatgatatacatggcagacaaaatgtaaattatattaaataaaaagctcataaattacagtccacactcagagaaacacaaatacatgcactcatgtgtgcgtactcagttttttacatgcaggggatacatgtgcagccttgttacacgggtgtattgcacttgggtagtgagcatagcataaaataggtcattttttcgaaccattctcctctccctccaccctcttctagtccacagtgcctattagtcccatgtttatctccataggtgttgaatgtttagctgtcacttataagtgagaacatatggtatttgtttttctgttcctgcattaattaccttagttttatggcctccagctgcatccatgttgctgtgaaggacatgactcatttttatcactctgtagttttccatggtgtatatgtaccatattttctttatccaatccaccactgatggtcacctgtgttgattccatgtctttgctatttatacacagttttttaattctttcctttttatttagagaacttacatgagtccttgctttatgttaagtctgctcatagcaatatattcactacgagttaaagcacgaattctcttatttctacttcatctgagaaagtcacgatttttaaattctgtaattagttttttccatttcagtacataacatatatttataatttgatatcttaaaaataatactgcttccatgtaaatatacatggtgcatgagaaagatacatgccatcctcctaagtcttatcaaacttgaaagaaaaatatctgctttctatgctgccctactcactttccttttctgtttgtgtgtgcatatccagaacttaaattacatttttttcactagtcatggcatatgttctctccccaggcatgcatttgctcttctccagcattaattctaatttttaaagcttccttctaattgtcacttggacaaaaaacaaaacaaagtgtattaggtttctctagagaaacaggacgaataggatagaagtatatgtgaaagggagtttattaaggagtactgactcacactatcacaaggtgaagtcctacaataggccgtctgcaaggtgaggagcaaggaagccagtccgagtcccaaaacctcaaaagtagggaagccgacagtgcagccttccgtctgtggctgaaggcccgaaagcccctgacaaaccactggtggaaggtccaagagtccaaaagctgaagaatttggagtcaaatgtttgagggcaggaagcacccggcatgggagaaaaatggaggccggaagactcagccagtctagttcttccacgttcttctggctgctttattctagctgagctggcagctgattagattgtacccactcaaacccactcaaattgagagtgggtctgtctttcccagttcactgactcaaatattaatctcctttggcaatactctcacagacacacccaggaataatattttgcatccttcagtccaatgaagttgacactcaatattaaccatcacagcaattttgcttgtcttgctgcccatccagccctaacataaactatattatttccactcctaaggaggttcacatgtaacaccttgccctatattgacccgagtgctcttttcagttagtactgcctatctttctccatttttcttgcctctttagccttgaaaaacagttcatgaatctcctgcagagtgtgttatctaagcattgcaccatagagaaagctaaaataaatagggcagctagtaagtaagatagagagagatgtagatcactttccatgtggagctggtcaggtaggaaatatatctaatgattattatatctcaatttcttatagacattcaatatctaagatttacagaatgaatgagcaaaattacatatagagtacacttaatgtattagtgaaacatgacaaaattttaaaaaatgtattaaactataacaattattctagatagtactggtgcaaatgaaataaaaagtaaagaaacagaatcgtccaaaaactaacccatatatagaaatctattatatgaaaagtggagcattccaaatcaagaaagaattaacagaccctttgataaaatttcttggaaaaaatgattatacttaaaagaaaccattaagttagattcctagcttttatcaatcataatatattcactatgagttaaagcactaaaagtatcacgaattctataattgtagatgagaatataataatatatttaaaatattacagtgggaaggatttctttggagagcagcaaagcccagttaggaagaaaaaggtaaagaaaaatatgaaaatctcacaattcataagctgtataaagtaagagtgtccagactttataaaagatttgcattttttcagaacctagtagattttatctataatttaaaataagacatacaaatcaaaaagtaaagggcaagtaatcaaaaagtaaaagaactataagtaggcaaggcacaaagaactacaaatggcaaataatagcatggaaaggtgttcaatcttgatagtaacctaggaaaatataaattaaaataatgacaaattacattctcctcatgaaattagtcaacactttgcaaagagtgatttcatttaataggatctaggtaagcggtgtgctcatactctcatcaggtaagtgtggtcttcagtgtttatttggaatactttatagctattaaaaagaatgaatcaggactctttgcattttaatggaatgattcctaagatatacttctaagacaaaaaagtcactgagtataatgagtttgctcttatgttaaaataaaaatattaggaaaaaatctagaatcacataggtagaattttaagaattgctctcataatattggccatgtatgtatatatgtacgcatgcatatatacatacatatgtcaaaaatgtctatttactgatattttaatacaaaactaagaatatgatatttgtactattaagaaatatggttttagacattacttcaggcaatatttgcagtaatgcaaacaagatgtatggttcattcattctctactagggaatttatttattacatttccctttccacatcaagaataactttcactatccagaacaaaataaacacaatatcaacagataattatgctttttaaaactgtgtgtcagaaaatgtgctaattgttttacatgcattatctcatttaattcttgcaataacctgaggtagttactgtgattatttttattgaatagtcaaaacataatttcaaaataaatgtaaattgagaacacacagtaggtaagtagcaatatagagtttccatcttggttctccgtgaatgcatttaactactccatcacccctctctggaagggccacttactgaatagttactgtgtttcatgtacattctcacacatgaccctgtgatgtcagaactagtatagctatgttttactgacgagggagagagacacaaagaatgtaataaaatacccatggtttcacaatgacaaaggcttttagtttgtatgcttcctccctttaccatgttattgtcaatcaaaaatgatttggaagaactccccagtattccaaaaggctcacaagattctcatccaccaagaacggtcacaattctcagtcgaccaacatttttcaacaaatgaggcatcctatataaaataccatatgtcaatcacaccacatgagactcctgaagattgaaagacatatcctgagaatattaaaggtgttgcccacgtcttgatatatgcatccagtatttatattctccttgtgatatctgaattaattgaatcctatgtcatccctacagatccacagatacctctgtctcctaagaccagggaggacgaggcagatggtaaaatttaagccatctgagcaactgttgataatggatacttctaggatttagtttggtggggcggtcggcgggagggaggagaatcgtggaattttctaacaacaagagacaaagaaagaaaaggtgggggaaaaaaagccatgatttgtagttttgtttggagcagccaaagaattacacagaggaaagatgagagaacagttaaatcatcaacaactgtggaagaaatgactctgaaacctacagcaagcaatttgatttttcttttaaattaaatttttgtcatataacttgaataaaattataagacttacattaattttgatcttacattgtgtgctagtcccatctgcatcacatgaacatggatattcattaataagttctgtgcacctgaaacacagaattagaattacattttcaaataagtagatgttaaagcataacttcaagggagtttcaccatttaaacttttctttcctagttcaggtgaaaaaagcactcccatgagcaatacaaagcagagtttattcctgggtttcttatccttgaaggtgactggactgaaaaaacggatcaattttcatttttgccattttccccatggcaatgaaaagaatgaacagttttaaaagataaaaagtatgtctagggcttatgtgagaaactgaagttagctatggccagcctgcattgcaatgagctgccaaccttctttctctcttccctgcttacaaagtaggtggcaggattataaaagaaaactaacgtggaagcaagcagcatgatgcatctgtgatgcattcttctttgccacctgcatcttctagaaataccttcactctagatgtgtattaaccaatattttatccatgatcagagcagttattatacagattcatagagtcataaaatacttttcatacacatagggctgaaagaaccagtttacttaggaacattttaaatactgtgtggtattatctctccatagagcaaataatagaatgtctcatcatcttacctgctagttctattaccatgagcagttacctttaagtatattaaagtctaattaatccacatttatagaaaattactttatgctaatgaacagaaataaaagaagggcagagataatgtatcagtacattgcattagctaaaactggcagcatctgtcatcttaaatgtacttagctcttgttttatgaaagagcataattaaaattatctttatcaactttcccttgatgttaagtcttaaatattgtgagttaaatatactttcataaagctaataataaaaaaaatagctaccttccatgtagacaaggatttgaaaggcaatcattggcgtttgtttcacagtgtgttccaaaaaacccactcttgcagtcacaggtataatgattgatgccatcgatacaaactccatcatggagacagggctctgataggcattcatctagatttatttcacagttgatgcctgtgttggaacagacaaggcaaaacatgaaaccatttaaatacaaaactcttaaaagtttgttcattatggtaaacatcaccaagaaatgaagacctctctctataatgataacttggtatttggtagcaaaagaaaatatatttcaaggttaaatatatttaggtctatgaatgttcagattactaatttaatgtgaatgacaaaaacaaagcacaagcttaatctactgaggagattgtttttagtgtgatgtttgttgagaatattagtgaagtaatgaattatatcaagttgtcactgtgaatactaattcataattttttttgtaatggtctttgagagtcaaacgtttattacctacaagaattaagaatgagtttgaagttttctaaatttggctttagtgagtctattaatgggctccctgagatttctaaatgaaatctaactttggctaaatacctgggattttcaaaggccaagtagcgaatattttttaagcacctaccaagaaccacctctatgctcaactagaggtaccaagccaaaaaataaacttcctgttcacacaaaaacgtttttagggaggtaatcatttacagatagaaaacaccgagatgataacataagcagagcttaatggaaagcaagattgtgtttcgtatgtttgaaatatctggaaagagcacagaaccattgtagaattgttagaataatttctttgcccattacatccattactagcaagcatctactaataaaaactagcattgactgagcacttataggtgtgccctgcccttaaggcttcctgcacattatcttagctaatgctcatcaaaccgataggcagatctcattaaccttaactcactggtgagtattcagagtgtaagtgaaacttccaggtcacacaggccataacagcaaacaagaatttaaatcatgtttcctctgacttgtgcttctgatcattactttaaattacctaccttgcagctactctaatatgtgcataagttgctatgctgagtaataccgtggataccaattggaaaacatggttcttgtagccaatacataatacctagttgtgaataaagataagtaataagcttattacagtgaagaagacaataatgaaaatagctgacatgtgaggctcttactatgtgccaggtacactcaatttcagaggttcatgacatagttttatttcccactcactctccatgactagagtgagttacagatcctctttacattatcttcactctgagaccaatgttaatgaagcatactctacctgggatattgacatctgtgtttaagaggaaaaaagacacttccctttcatgctgggcttggtcatatgacataaaatacaggtggctcttaagtctttcacctacaaatcaagttatacgactaagtccaacagaaatggaatgggaaagaatgtttctcccacaggaaagggcacatatttgtaacaataaaattgagtacaagcataatcaatcaagcttctcacttgtaaatgagtgttacttattggtacatcatacgtttattgggatgatagagtataggcatgcatcaaaaacaacctagccaaggtctgatacatgtttaacattttattactttcaggttcttgataaaaatatcacaaacacattatatttgattagtgatttgggtggttccaaagacaccaccattctaactaggaagataagtgaaaagtctccgtatcactatgtagaatgctggcagagtcagtgctgaaattttcagttaaaaaaagatagatggtcaatttataacaaaagtgtgggggcagggacagaaagtgttaaaagagtttgggacaggatgcatccagcaatgttgggagatgaggagatttgacaaaagacacttcactctgtttttgaaatgttctctccataaaaggcaaacatgtctcagtttagctagagacagcatcatcaagattatcttaggatctttttttcctaatgttttattcattaattaaaattgtggttataatttgactttctaagtagcctccaaagaggataagaatggaataactagccaatgtgagcattttggtctctataaaccattctcatttttaacattatagtccttcagattcacacatatcaaagtcccttttacctttctaacttcatcttattttaatctcacccttgactagtctactttacttacattgacctccttatattttctcaaaagttttaggcatgctgttcctaaaagacctttgtacttttattccctttctaaaaaatctcttccaaatatttcacagtttacatcttcttcaggtttttactcaaatgtcactatctcaatgaggactattcaaccacacaatacaaaattgcattctcgtcttaatccgcaattgccattatcctgttttatgtttccctcctgtaacaagtaatctccttgtagcattccataagatgtattcatcttttttttctttttctctctatttctccatgacaagcttagcttcataaaggcatagattttgtctgtctcattcaaactgcatacattcaaatatttgttaaaaaataaatccttgtcatatacgtgtgtgtgggtttatgtgtgcatgtttttgtattttgttttacagatatctgttattttctcagaaatcccagcctcttcccaaccacgaacaaaacagttcttgagaatctggggaaactgttagtccttgcgaaggtgagagtcagaatccaatgaggcgatggtgatgcctctgaggtgcataactaaaagagttgtctgtgcagccaaggggaaatatttaatgggacctctgctttttcccaccttcaaacaaagacatgttcatgtgtgaaaaaagacacacagttgtggagggtcttggactttggttcacaatgatctcccacaaataattaccaacctattcaaactctaagttattcatctgtaaactatgaatcaaaatttctctactgtagcatagtagagagatattcataaagtgcacatatatatatatatatataaatacatatgctccctgattattataacaacaagattgtttatcttcataggataacaatgctttgacatagcacatctaaaagaaataatagtatttattagacatgatcaaagccttggctaaagtctcagtctcagttttttgcctacattgccttatataccaggtatttcctactggtcattaatttatctaatgcatatttatgtgtcaatcagagttctagactccttgcatagttcccttgacctggcatgcatcactgccacctcaatcacagcatagcagatgattttcacaaaatctaatgatttcattatggacttcatttgacaaaagaagaaccatgttctttctttttgttatgtctaacatattgttctttccacctaccctcctgcctgctttggagctacagcaatagtttatgtttgaaataattttcagcttgtggttctaaagttttttatttcattcataatgcaggcaattccttttttaagcagattggaaggttacctgtgatatttgagtttttttcctatgatcccacttatttaaaaatcctctttactagtccgcctcaacatctgcctccagattgaatattttcacataggaaattacacaatccttttagaatcaagccattaaagttcataaactgataggtttgatcagcaaaacattttcgtgcatcaacaatattataatagaaattatatatattcctattatataaatacatgattttatgtatatatatatatatatatatctgtcaatcagctgtcttttttcagactgtgtttttttttcttactttctcttcattccctttttacccaacttcttcccatttgtcagcgttacatgttttgacaagtttttcaaaatcactttcctgattcttaatttttttcatttcacatatgagaacctcaaaacatactttatgaactctccattgtccccagaaataaatgtagtctccctagcctaaaaccaaattctctgttccaatctttcctttcttgtcgctgctctgatattatcaaatactctcatctcctggtttataaacctgattgaataatacaatcaaccgtggagtttttaaaaatacaaaatcccaaatctgaatctctgagaaataggactgacaagctatatttttaaaaatctctctagatgatggtaaatcatagctaaggaccgctgctttttatcaaactggcttaaaattaaacattctcaatattttctcatatccatgttagctcctgatagttctgcctgaaatgtcatttccacatctctgtttgcagcctgtttttttatttgaggtcttacaaaattctagttaattttaaatattccttttgatatctcccattgcatatcagctaatatcatttatcagagtctctttagggtttatttatttgaattactgtcttatcttccaaactttatcactacttatttgagctcagggatcatacctatttacttttacttcatgaaaatgccaaatacaaaattttcatgtagtaaatgatcaaaatagtcagcttaactactactgaacacatctaaattgtgataacattttgaaaatgactaaaatttacataatagcatgatatttacaaaggacataatcaagttaatacaggcatacaataatttatggacttaagaatcagtgattttaaaaattcaaattcatatttctaaccattttgaattacaaaattaaaaaagtcataagagctccaaaagcaaaatgagagttttgtaaacgtttcttattatgaacaatatttaaattaaaaacaattttaactatcatgtaaaagatttccagataggcagtccagcaaatgctattctatgaggaataatctaggcaaacatgcagccatggtgtttaaaggtgtgtcaatcaaaaattatgaaatgtaaaaaaaatccagaaacaacaaaaaatggatggaataagaataaagttgacagaaaggttgaaattatcagagaaggaatttaaaataatgatttagaacatgactgatatgttaaaaaatatatcataaaaggtggatagatgactgaatctatgaggaatatcaaaagagatggaaactataaaaatattcaaatttcaatgctaggaaaataatacaagatgaagaattaatttaatgagcttatcagtggactggacataggaaagaaccaatgaacttgaagataagcaagtataaattaatcaaaaggaaacacctggaggtaaaaagagtaagaaaacagaaaagagcttctaagacatatagaataatatcaaagtttctaactgacttgcaactggaatccctaaagtaaaagggagagataatatgataggagaaatatgtaaagagataacggacatggatttgactaaattgatggaactctgtagcagtttcaggcagtatacaagctattttgctgtttggagcatatatcttagaagactctatggtattaaagatatatgtagtggaaaatatgatgcatagattttatagtagtgccagaggaagaatcatagactgaggctctggaccaaaactaaaatatatgtagcagagaattatcctgaaattgagaaatggcttctggcatgtctgggtagttgtagagatgaaacacctgaccatgggacatcaagtatccatgtggacagaactgccaatgcatttggcaagaccagtggcaatctacagtaggtagtatattgggaattgtgtatgagtatgccagagatcacagatagttgcactcctaagttatgtacttctttcgcaacagaagctcatcctaagttcatactgtttctgtctgggccctccctggtggccatctgaaggaaaaataaaaaaagtctgaggttggttcatggatgggttgacttggtatatgggtataaactggaaatggattgctgcttccttaaagccttattaagaggttacccaagaaggtaaagcaaaagggacatccttcggatgggcagatcttcagtcccatgatgtggtcataatctttgggtggaaatagcctaagagaagaatatgcatggagttataggtagtggcaaatgacatggctggactggaaggcaaaatataagactatctgggtcagggaaatatgagaaagaagcatatattggactgataggagtgggcatgaagtgtgaagttctctgcaatgcatgttaatgcagaagaggcattaaatagccataaagaaataactcagccagttaacatctgtccttctctggcatcagccaccacaatggtggtacaacaggcatgaatagagtagctagagtggcaaatatggaggcctgtgcatggacccaatgtatgggctcctctgtcccaagaattagttaggtactgcttccctcagatatccaatcttccaggaacagagaccatagccactacacacttaatggtcagcctttcttgcttctcctgccaatagatgtttggccagaataactactcaagggcttatgtagtgttgatccatcaatatgagagctctcataatatctcactggaccaaggaagccactttacaacaaagcatagtagcaatcagataacgatagatctgttggtttcatgatgtagcacaccatccaaaaactactaggtgtaactgaggtgccagttcggagatgaaagcttttggggatggaacactaaattatagaatgcggtatgcactctatatcaataatcattatatgatgctttgttcccaataggtataatatatggaattgggaaccagggggtaaaagtgagtgaaccgatgtgccatccttctttgtgaacaattgggaaatttgtgctttgcattcctgaaaatataggttccaggaatctagaggcactgattaccaggggagggacccttgcgctagagaataccactagaatccctttttgaaatgtatggttgttgtaggctctttgtgctaagaaactatcagtcaaggaaagaagttccttattgtgatatggactgaaatgtttgtgttccccgcaaattcacatgttgaaatcctaacccctaaagtgatgattaggtcataagggcagagccctcatcaatggaattagtgcccttataaaataggcccaagggaaccttccaccatgtgaggacatggctagaaggcacaatctaagtaccagaaaatgactttcactggacatcaaatctgctgccaccttgatcttggacttcttatcctctagacctataagaaataaatttctgttatttataagctacccagtctacgggattttgtgatagaagctcaaatggactaagatacaagggtaagtgatgctgataatggggaggggggaagtaggacactgttataaagtagggacaaggataaaaatatgtgacattaaggtgatctactgagcagagtcttcattgtcattcatgaacaaacaaaaaagtcatagccttactaggagattaactgtcaggcatgagtttctagattaattcaccaggtaatccagtaggccagcatattttctagccaaggatgagggtaatataatttgcacaggagaggaggaagagaagtatcagatgcagtaccaagatcaactttggtgacagaaattggagttcttcccagtaatccctgaaagtgatcttgtctatttacccaggaagagacaaattataattttgggtatctgtttccagattaggtgtacttattttagaaagcaggtagatctgagcagcacaaagggttgactataatagataaagtaatgagcattccaggtccccattcagaacagcaacactcaattccacaaatagaggagtttcctaccaagttctaagtgcaattcttccccaggaattgaattttgcttggccaaaggggtctgccttgcccaagtttgggcctcccctctgctgtgcaatgagtgaaggcgactcagtatgggtcaactatgaaggggccatccccacttcatagttcctggagggatcaactgaggcttctgttataactacatcttagctcaacatcttcctttcccagtcctacttctctttcccctcgcaggcattgctgttgaaagtagtcactgataactcacctacatgtaaattgcagtctctttcttgggaagcctaacctatgaaaaagtttcctggaaattaatcttttccataggaatgcttttaaatttttttgtcaaaaaacttaggaaaaaatgttgaaagtgtatgaagtagttactaggaaaatgtatatcattaataaaaatattggcggtatatatcaaatactggattaaaccagcatagatttagcatttgattaacaatcatttgctaatattttcattgtttggaaagaatttattagaatattatatctgttttcagaagctctccaaggaacttttactgatgctttattttcctgtctataaatatcccaggtttggacagatgcttttaaaattcattacagtagtccttagaggtttggaaaaggacaagtatcaataaatatttgatgatgaaaatgatgatgataatgatgttcatttaaatcttatttctccttatattttcctacctcttttatgaaaagaatgggggcaattcttcaatatcaggccacaattaaatgaagtcttctctctcttagactttgttaccacaagaatgcggccagttgttagaggacttcacagtttattgtaaaagttataaaaacaattactatgtcattgtaaaaaattttaaagaagacattcaaaatatccttcacaaaattgctaagacaagcaaaaacaatattctgattcatattagttactcattgtttttagatcattctaaatgagtgagtcaagaaaggtatgtgaaatgaggcgtgtgtttaattaggcaactatgttgagagctttggaaagtgagaagttgttcaaggtgaagagatgcagaatatctctaagtacaaacaggcatatgaggattgattaaaaatgaaagatattagacaatagaagtaacagtttatagatgagtcggacttctgttctaattaatacataattacttattatttgagggccctgtgtattaactctgattaacatgttaaaatattgtcaaaacttataaacttcacacattcatacgcatgtacatggctataatttatcaactaacattaatactaatacaatcaggaaattttatttcaaacaaatgattctaatccttgctaatataatgcagaaaatagctcattatttaaagtactgtttagttcctaggttctgttatgattaaaataaacactgcatgattctatctgtatgaggtatctagtcaccaaacttatagacacagatagtagaatggtggtttctagaggctaggagtgggagaaaatgcgtagttgttcaatggcataaaatttcacttatgcaagatgaataatttctagagataagctattaactatagtacctatagttaccaatatagtattgttcactttagagtattaggataggttgcatgttaaatattcttaccacaaaaaagataaataaataacacatacacacaaaaaagaatatgagaaaatttttggaggtgatgaatatgtttgttatcttgattttggtgacagtatcatggatatatgcatatgtcaaaattagtcaagatgcacatattaaatgtatgtagtgtttttggatatccattgtatctcacgaagctacaaatgaagtcttattaatcacatatacaataatgatttctacctcatagggctaatgtgagtattaaatgtgtctacacaaagttactgcaatctaagtatttcaaaggacattctttagttcaaaggacattctttagaaatgattgctctaagcttgtctaaatgagtgcctcaaatattcttatgtgcatcattgagctccaaccattagaccctgccacattccccattccaactcataagaatgagaattgagatcattaggactaattttatggcttattacatataaacattaatgcacacaactctgtttctgattatgcataccttatttcttgtacttcaataccacaatactatttcacttatatgtacatcacaatctttacatggtaaagtatttcagtaggactacactgaataggattgaaaaccagcttgccatcaaaacaattctttaaatgaataatgattttgtgaaaacattcggttttaggtaacctgtgtgtagctaggaaaacattttaattatgcttaaaatgtgaattataggacaattttgcttcagataaacaaggctgataatcagtgggatgtaccggcatgactagtgtaaaaatattgaaatgttaagtaactagccattgggtgttgctgttgctcacccttcttagcagccccaacatttcttctgtgactatgcagacttcatgagctatcaagtgaggcatagaaacatgaggttatacataggtcaaaacaatcattacataattttattattacctctgaagatacatataacaacaaaaatgtgtctcatatcagtgagctcatgtgtaaattttttgaatcaaagtagcttgtaattttttgtattttgtaacaattagaaatgaatgagtcaggctttaattgccattattagttaaaattatatttccacataaggaaagtacatgataagcactgaaatctttcttttataattaaaaaaatgtaagattgaatggcctaaaattatgttattagaagatgacaaatggaatcacttttacagaatcctggggctttgaacaaaatttgtgacattttacaatgtatgtttctcttatttctgacaactctaccaagtaactggagatcaatgaaaaattctaattttaattcttcatttgaatgggccccaaaccagggccttgatgaaatttaaggattttgtttatcctctccaggttaggcacagacacattctgacataaagactgatttaggtccaatgagtcaatcgaatgcattcaagagaaaccctttgggaaaacaaagcagacccagcagtcactaagatcaagctgtgagccagaacactcagagtggaaaataaatgttctttatcggaaccaaaaagcgatctgaaacttacaaaattttggaggtattctttaatttaaaaaaagctcatgattacaaatataaaataaggcacaatatgttagcacaaccccttctgtgtaaagaggttaaagtttaaacatattagcttcatagtaaattcatttctagttgctactatttttaatacagagctgcatgaaaaaatggaaaaaattgaaattaatataatgtctactgttctccatatggctaattccatagtttacttaagtaggaagcacactttaaagactaagtcaattttgtcatagaagtaaaaatccataattaaaaaatccagtgacctagttaatttgagatttaattttccaaaattaagaaaacatcttattggaggtgcttgctttaatccttaaatcaatagcataacattttatttattcaaagttataggcaaaggcaatggcttataagctgcacctaattcatagtttgataaaagagtattgtttctagagtggcattttaaaaatactaagtctctataatgtttaattttaaagaccaggtgaaataaaatgttaagtgataatcacaggactttctatgttgtatgttttgattaacaaacacaattcttagttgttaatttgatttatgcataaaccaacctgttaagttgatgttaaccacaggaaatagataaggctaactgatggttgtactattgagagacagtccaatatcaaataatagcaaaaataagctttgaagtaacatcttctgatttaaaatgagtggcccaatgtgtgttatgcagaaataaaaggagtttaaagatgtaaagttatagttttgtactagtaaatgtttaactggctcttggaagaaaaaaaatcaggaagcaagggcttatttataacatagtttaattcccctgatgcagtactcccatcttttttatttcaatgtcctgaaattatgtctacaaaccaacaaagtttataaaaattaatattcagctctcatgagcactattagctttctccatcacaccactggaaaggtactttcctaagtattaatttggggttgagcagagtgttagagaactagaaacatgtgcataataaggatgaggagaggcaatagagattgttgttgagggagctgttgaaatgatagaagaaagtatgtggtgtgtgtctgcatatgtgtgtgtagcagacaattcctcacaatgttatagactaacacagtcactaattagcataatgtggctgagaatttaaaaaaaacttgtggcaatattttaataccaagatgacaatacaattatttcattatcaacactcactgaatcttatgtactaggtaagcactggtgataaaagcatgacaccagacttaggtaccagttgtgtccttattttacatagcaaacatagccacaggataatatacaacctcttgaagatcaggctgttgtaaactgggttaatagatctgggtttcaacacatagagtcaattatgagaatattcactgctaaacatttgaatcaactgtgtacatattataacaaatttaaactttattctataaaaatagaatgaaacaacattgaaaactatgtgccaaggctcgagacaatgagtgcagtaacgtggtagtattatcagttcagttgtgaatcagtaagacctaaattaagatgatgatattagcaataaaaataaacgatgtataaaagacatctctacttcttttgggctaatggtcaaatgcctccctttcctccatttttattgtaaaaacatattaaaatgttttaagttgagtaaatacaagcaaatgaaaataatcgctcaaatctcataatcgtaatttttatatattacttatgttttaattttttccacatgcctccatacatacatacattggcactttctcaatgtaaaaaataattacttaaacaattataacatgtcatgttttttttcatttggtgacatggtcttcagtcatatcattttaatgattgcaaaatatatacattcttctatgaggaatacatatcatgaatatattatgatttattttatatatatatatacacactataaatatatggcaatgtattcttccatgaataatatatacagtaatctaatttcaaaataatggttatttcaacatttcaccaataaaaataactaatgaagatctttatgcatacacacacatatatttttgggggttatctctgtagacaatttatgcagggaaatatttttctaggcaaaattttcatgtcaaatgagtattttagctcactactgtttacctcactagcaggcagtaacatgcatattaaaatagtgaagcataattttaccaaaatttttttcataaaaaagataaaaattttctattgaaaatagcaatatccagtagcgatgaacatgcagtcaaatgagcacatggttacaatctcgattggtctgcaatttgtgaaaacttgccaaaatgtagaaaacggcataatttagagagcaattttagtgaaatgctgtaaataatctcttcaaatgtgataaaagacaaatataataaaaatttcacacatttctgtgaaattccacttttgaaatgtgcctaggaagatgattatttcagtggtttgaaaaaagtgagacattggaaaatatataaatgtataaactagagacacattaattatagtatagcctcatgatgaaaagtttgacagttattataaaaatgctgtggaaatttaatgaatggcatgggggatttccagaatatactgttactaaataagaattcatgtgatcaaatcctatgaactgcataaaactaataataaatccatctttaataggttatagcaataaaaaattgttattgttcactttttgtggtaggcattttgtaatctttactttttatgttttatctgcaatttccattttttatcttgtacatgtattgtttttaatgagaaaattatgttttaatgggttagactctagatgcttaaaaagcacttgatatttgacatctcttcataataaaaatcctcaataagctaggcatagaagaaacacacttcagcaaaataaaggtcatatatgacaaagccatagctaacaacatacgaaaggggggaaaattgaaatcttttcccctaagaactgaaacaagatgagaatgtccactttcaccacttctattcaaaatagtactgacagttctggtcagagcaatttggtaagagaaagaaataaaaaacatcaaaatgaaaaaagagtaagtcaaattgtcccattgtccctgttttcagatgacatatatatataatgatatgtatatgatagatatatgatatatatgatatatgatatgtatatgatagatatatgatatatatgatatatgatatgtatatgatatatatatatataggatatatatatatatgtatatcctaaagagtccaccaaaaaacttttggaatcaacatatgagtttagtatactgcaggatacaaaatcaacttaccaaaaatcagtggcatttctatatgctaatagcaaactatctgaaaaagaatagacattgaagactaggaagggtgggagagtgagaggagattgagtgataagaaattatgcaatgagaacaatatacaccattcaagtgatgactacactaaaagtctagacttcaccaccttgcaatatatgcatataacaaaactgcacttatatctcttaaatttatacaaactttaaaaaaacgaatatttttgtgtgctttatatataaccaatttgttttaaaataatcacagtgattcttacagtaatgttactatttctgcttcttttgttcaaacacattgatgtattattgcttagtcttttatttttagtgtttctgtgccatttagttttacatgtatttcataaatatagcatagtttgggatttgactgtgaatctgttcccctttctcatccactttctttttaaaataacatttaaactgatgagcctaaagattgagaactgacttatcagatcaagaaaataagatatatttgccaaacttaatgctgatgtacatttttacattaattctttgtgtctgaagatccaggaccagaagtttctaaggccagcatttcaagtggtatctggttctctatctattcttttgcctagggatgctggttaaatgagagtaaaacagtgcacacagcatttgcaggcttgctgatctgattgaaatttctgtcattaaacattttcatttggaaatttaatgttttgttagactaaatgatatgtaacaatatggctataatatagtgagtcttcctctctttctgtttctctacacacacacacacacacacacacacgcatgcacgcacacacagagctgttatttgataatgcataacaaattactgcttatgtgattttatttcattaaataaatgctatcagaattggtagacattatctttccataaatttcctgtggagttgtagaactgaaattcattcactttgtttccttatgctccacttacaacatttttgtttaatgcctgacttggttagtgttgactcaatacctatgatacaattttttgcattttaaatatgagccctaagcaactaggaggagctgcagctccatggtaaattgtaatctgtattgggagttcaatattaagaaacagtttagaaaaatatgtgacatatagaatttaaggtgcaggcttaattttacctacttctcaagtcttaccaattatatattttattcataacagaaattctgtcattattcttgatgattaacatcttgtaattaaaaacattttgctatacttttgagatctgcccttatttctgctgcattgatccaaagcaatcatactgaattaatttttgcttgagcagttcactataaatacaatgaaaatcgatcacttcattttgaaaagctagattggatacataaatttcattagtcattagataattatcaattccacatataatttttatagatcctaccagttacataataattttattaaaaatttactataacaaaaatacccaaaatttcattacatggtctttcagattttgtgtactgtgactctaatacattttacttctatataacagtgttcctttatagtacaaatttacagggaaaataagcttattaaaaagttgccggcagtaagacactgatacaaaatagtttttaacatagagagttgtatttaatttgtttaaaagtttagactaggaggcaagttttccctttttttctcctaatatgtactgtcttagcctgtttgtattgctataattatatacttgagcctagttgatttttacataaagtaaatttatttatcccaattatggaggctataaagcccaagatcaaggtgctgacaggtttggtgcctggtaaatgctgctctgttttcaagacgatgccttgttgctggatcctagaggggaggaaccctgtgttctcacataatagaagggatggaaggacaaataggaagggtctaccttccagccttttcataaggcactaatccattcatgagggaagagccctcatgatttaatcacttccccccaaatccccacctcttaatatcaccaaaatggagattaagttttaacacatgaattttgggggacattcagactatagcatatgcatatggacatatgcatacatgtaagatcattctaagtagggcactttaattttactcacgtgatgtgtagcactacatagttgtggttatgaactcaaatatggagtcaaataaacctgattaagaactttgcttttgctacttattagttcaggtgaacttaattttgctacaacacatccgtaaagcagtcataatatctactttacatattattgctataagattatcatggtgtttaaaatggtcacatactattattattatctaggaatggggtaagtaaagataactggtgcctcaatttgtaacatgtgcaataaaattaatccataaaaagtgaaataataaaaatgtaacttgcagtctatgatttctgagtgctctgcagttctaatagaggatgttatgaaaatcaataataaaagataggatttgagaatttcttcttctctacatttgaattaatgggttgattcccagctaacaggccaagtgatgggagaacattttagattccttcatatccacatgttttcaaattccaagggaaagatggcagaggacttcgaaactaatggatagcccttaaatttatgattcatttgttgtggataacactgaaccctcattgctcgttgagaactaaaggtaaatccatggggtatagaatcataaagccactggtatcaaatattttactataagaaaaaagaatgtagatggtaacaagtgttaactgattgcttaaatgatttcttttttataattgaccttaccccattaaatatgatctttatcactagaatgtaaaactgtgttgtccaatactacagttttcagcacacacatacttaaatttaattaaaagtaaattgaatgcaaaattcagttatttagtcagactagccatttcaaatgctaaatagacaaagaactacacagcacacagcagaatatacccatcataacagaaagttgtattagacagcattgattaagaccattgctcttcaaactttatttttttcttattgcccctgtacaaagctttttaaatatttttttctaatcactcttcatcatcaaattttacagccaaagatacatgttttatgtacctgtgtctaatacataaaaatagtaagatcccagaaaccttttgagaatgcatgatgtagacctatagaaagagaaaagaatcagtccatagataaacactatgaaaggcagaacaacacttaatcatgtgttcatgttcaaaacatctatgaaccacttattaaattttaccttcctaaatatgcaaataaatgtaattacaataaatgttaaggtaaatttaagagaatatttaactctattactgtattattttattaatatgcaagtgaaattaccatgaaatatttttcatgccaaatataaaataagaagattagatctgtgttatttatatttctaccatcttcttgtgaatatctcaggtgccaggaaatgtagttgatgctgggaaggctaaaggagatagaatagttcttggtcaacaaattttaaaaggctgatgtaaagataatgtaagtatctaaatttcccaatccgaaatccagaacattgtctactaaattatattgctttgatacatcaacaggaagtgatatgctgggtccagttaacactcactctcaatggccaactgtaaaatgttcaaaggttttgggagacaattggcactatcacattggtagtttaatatcagctatagtcaaaatatgtgcaccttggacatgagaaagaaaactgtgaatcagggattttagtttgctgtcagataaatgattgctaatcattcgccaacacatcactgtcaaacaccttttacaaaagaacaagattaacttctcatacccaattatcctaattccacagtcctttattaaaaccatggaaatcaagcaagtgatggaaatgtcaataagcccaatttcttcataaattccaggattagatggctttgtctactagaaaacctgctgaaaactcaccttaagtgagattttaatgatgtttggcaccaaatatcatcagtgtttgcactatctgttactctctatcagtaaaactaacatacagggcattaatgctaatagtgttggttttacaattaacagtgaactacacgaagataaatttgtcaggagcgcagaatttacataaggtctggaacaacttttcctggtctgggccagcaaagtgacagaaaaacaaaagagattgatctggtatgccattattttcttttttctgctaaaccaaatttccaataaggttactgctgataatactggttgatatggtttgtctgtgagtccccacccgaatctcatcttgaattgtactcccataattccgtgttgtgggaggtaccagtagagtggggcactgctgaaaagatacccaaaattgtggaagcgactttggaactgactttcaggcagaggttggaacaatttggagagctcaggagaagacagaaaaatgtgggaaagtttggaatcttctagagacttgttgaatggctttgacaaaaatggtgatagcaatatgaatgctaaggtccaggctgaggtggtctcggatggagatgaggaacttgttggcaactggagcaaaggtgactcttgctacattttagcaaagagactggtggtactttggacctgccctagagatttgtggaactttgaacttgagagagatgattaagagtatctgatggaagaaaattctaagcagcaaagcgttcaagcagtgacttgggtgctgttaaaagcactctgttttaaaagggaaacagtgcataaaagttcaggaaatttgcagcctgatgatgcagagagaaaaccccattttttgaggagaaattcaagctggctgcaaaaaatttgcataagtaacaaggagcagaatgttagtccccaagacaatggggaaattgtctccagggcatgtcataggtctcatggccacccctctcatcacagacccagaatgctagaaggaaaaaatggtttcatgggctgggcccagggtctccatgctgtgtgaagcctagggacttggtaccctctgttccatctggtccagcagatgtatggaaatgcctggatgcccagggaaaagcttgttgcagtgacagcgccctcagagagaacctctgctagggcattgtgggagggaaatgtggggttggaccccccacacagaacccatactgcggcaccacctagtagagctgtgagaagagggccactgtcctccagaccccagaatggtagatccactgacagcttgcacagtagacctggaaaagcctcagacactcaatgccagcctgtgaaagcagcccggaggtgggctataccctgaaaagccacaggggcagaactgcccaagactaagggaacctatctcttgcatccacatgacctggatgtgagacatggagtcaaaggagattattttgtagctttagaattttactgccccgctggattttggacatgcatggtccatataactcctttgctttggccaatttctcccatttggaatagctgtctttacccaatgcctgtaacctcattgtatctaggaagtaactagcttcctattgattttacagactcataggcagaagggacttgccttgtttcagatgagactttggactgtggacttctgggttaatgctgaaatgagttaagactttgggagactgttgggaaggcatgattgattttgaaatgtgaggacatgagatttggaggggcccagggtggaatgatatggtttggctatgtgtccccacccaaatctcatcttgaattgaattcccataattccacgtgttgtgggagggacccggtgggagataattgaatcatggggatggtttctgccatactattcttgtggtagtgaatacatctcacaagatttgatggttttctcaggggtttctgctttttcatctttctcattttctcttgctgctgccatgtaagaggtgcctttcacctcccaccatgattctgaggccttcccaaccatgtggaactgtaagtccaattaaacctctctttcttccaagtcgctggtatgtctttatcagcagcatgaaaatggactaatacactggtattacttcatctctccatattaagtgagtattttagattagtataaagcaattttgtgtatatcgtcgttcttaaatttctttttttctcaaaatagcctttctcacccagcactatgataaatgagtgagactaaaaccatgtaatttagagtttttatgctgttgggtttttttttttttgagtagaagcatagtttcagtgcttgatactcaataatgaattctttctcaaaatattttccaaatataccaatcatgagatattgcttccagaaacatttttctggtaatattatattttaaagattttctgagcaagtaaatctgtctcttatccatgggtaacatctttcttcaatatttaaatttttgtagacccttctttcacctactagttctaagtgaattataaggtttcttggttttctcctgatgataccaagctttttgaaaccctctttaggggaagctgatacttatttcatttggacaaactcaaattaatagtggaaatggatgagtagagttcctgttccaactttggacttttatactaacaaaatcatttaacattattttcactttggaaattaatgcattcaaatatatttccttctctcaactttatttcatggtaatttcaaaaaccattattttgctgtgatgttcagatcaaagtttcagcctcatccacctcaattaatttttagatgactgatattatagccatctactcattagctattagacacagacacataccctatgcaactcagcattgtaaattgttctttataaaacacctaatcaaataaattttagtgtggtggctcacacctataatcccagcactttgggaggcagaggcgggaggattgcctgagcccatgagttggagaccagcctgggcaatatagtaagacctggtccctataaaacaaatttaaaaattagacgattatggtggtatgcacctgtggttccagctactcaggaagctgaggtgtgaggatcatttgagcctgggaggcaaaggttgtaatgagccaacatagtgccactacactcctgcctgggtgacagagaaagtgcttatctaaaaaaaaaattaaaaataaaatttaaaatatataattagaatccattcttggctcttcccctttgtgtatcctaaacatactaagtttccttgattctaatatacacatcttggtcttagaatctttattcatcttccatggtgcataaaataatggtgaatcctatcattgatagcacattagatttgttgaaatataattgattttattcaagtttcttccaacaaaaaataatctctctctctctctctctctgtcattttagcctactcctaggccttttctctctccctgttttgctcccaacttcgggaatttcttgactccacatcctgtctatacaggtaactcacgaaaattcatttgaagtcatttctttcttctaagcgtcagatcctctttttgatgacttacttgaaatcccatatgattttattacttttaagtttaaaattaagtttttctccatcattccttctaacaaacatctcattctcctgactcaaaaagtaaaattctctcttccttttctaaactttcctccctatgtaaattacccaggctcaaaattgtagaggtaaattcaatttctaatacttttataagtctgctgctttaactaacttttttcctttctgttttcactggcataggtccagaccaggccttcatttttatttaaaatcatctaagaaactcttcttttgttttcttcaacttaacatatgtttccaaatttttcaaatcaatcatcttatagaggcagttcctgtaaatcgatttccttgctcagagactttcaataactctctgtttatccaaagtaaagtagaatccacatttcttatttctgattaatactggaaaagtaagtcaaaacttgtcctaccaataatgggctttgtggaaggaaaacataaaacaaaataattatgtcaagcctttcattaaaacattgcaatgtgaaagaacagctttaaaatgtgtgttctgcagggagaatacagattggtgaaggtcaatcatagttctggttattcctagaattgaatactgttcacgttctcaagactaatgggaaactgaggctctattagttacataatagaaataagaggcagccagattgaggttgcacattagtagcttttggttagataatttgagtttagaaagaggggtggagaaaaacaaatgggatctaaattatctcaagtataagaagaaaaaatttagttttattggagctgtgatagtttgaaatcatagttgatatagaatagacaatataatattattctcaaaagacatacaaagccatttcttagctttactttcagctatctgttatatattctcaaagcaattgttaattaacatttcagtgagaataattttcccaatataaaatctcattgattttaatattaaggtaaatacattatattaagaattgcttgatgtggtaatgcagtgaatttaggggaagtatttcattatctatatgcaactattatgaaataaattattgttttttattagtttactcaaaaagtaaaataaggccacataattaatcattgcatgtgttcacttgactggacctcagggtgtttaaatacctggttaacaactatttctgggtgtgtatgtgaaggtgtttccaggtgagactatcattcaaatctgtaaactgagtaaagcatattatcctccccagtgtgaatgaatgcccatcatccaatatattgaaagcctgaacagaacaaaaaggcaaagtgaattctacctgcctgtctgaaagctggaacattgattttctcctgccttgagacttggacttggattgcaacttatgccactggctgttctggtctaggcttctcatcctctgtaattgcaggagataattccttgcaatacaaaattcccctctctctcttctctctcctgccattctctccatctctgtgtgtatgtatatgtatattatgtgtgtgtgtgtgtgtgtatcctattggttctatttctctgaagaacgctaatacagattaaatgttaatgccaatcaaaaatgatttacaaaaatcctagtgaatatagttactacacttaaatgactataatggtaagcaaatattctcttaagtagttaataataattattttatatctcatatcctcatctttaattatcttttcagcagcacagtttagaaaagtctgagtaatctatgaattcttacatgctatatccaattttcctaaaataatgtcttgtaagtccatctccgtttccctggcaactgcctgagctcaccatttcactacaacccaacagtgtttttaaaagactcatcatgtcagcaatatcctttttggatttacactaacccctaccatgtctatttattttctaaaacaaacaaacaaaaaaaccatactttttttgccaaagaaattccagttattttcccttttcccaggggaaaaatgaatcttcatcacagacaaaaccctttgattcttgtttaccttcttaccctcactgtgaacaatttgtagagtggaaccctaattacatctatcaatgctgattggaaatgccacacttgaaatattttgggcgcttccttcctaccttctccaattgtgacaatgtattttcctttgaatctgaatatgtgtgccattctgtttttgcatattttcctaatacagtagtatagatagtttatttgtctataaatatgttcttatagctaccacattgggtcgaattatttatgtataagattctgagctcattacaaccctctgtctactgccccagttcctgaacacatgctgatctctttctctttaatacatgtggagaaaatgattttgattacgacagctttcaatagataattgagtgattggctcatgtaacttttcctctttccttcacattttttcttttattttttcagtctttaagaataatattatgtttttttataatttctaataacaagattatgctttgatcatttaaaaatcaaatgtttatatatatttcaatggttcctcttgaattgcagaataggtaaacagcaatcatgcagaaatttgaaaaaatgcatatgagttaagactgcttttatagtaaagctagtgaaaagcaagaggcacttctggggaagttttcagttaactgcattgctaggagattgaacagagagactgataacgaatgcgtgatgttttcaaacaatcaactcacacaggagacaaaattatgacatatagtttgtttccaatgagaatgggaggggcagtatagcagatcaggtggatgagctgaaggataaatgtcttagttgtactgaacaagcgaatgcagctggtgtaaatagcgtggtctgagtaatagtacacagaacaagtataggagagaatgataaatttagagattgccaccatggatcagaatatgagtccatctaatgttaaattcttcctatggcaataactaatatttagtgttccaaaggaagatgaaaactcaacagactgtgcctaggcaatttattcaatgttatttatcagatgagaaatttctgttatcagtcccatataaaatctttgaacaacttgaattatgcagtttgaataccctaatatttttatgctggcagaactgcaaatcatattgatgagcataaaggtagtgaagcttttaaaataatccctaaataatccctccacactattctattttcatttaccatcaaaaaacaatggttattcacatctagtgcaatatatatacaatttgaatgcattttgacatcaagcttgggtcacaatacatttaaaaacatgttaaagagaaaatgtattagcattcatgtagccaatacaatactagcctgctttacagaatgttcatgtttactgactttatatttttatatttataatttaattaatataatttttaaaatctctgagattcttagaaatatccagttggttatataagacaattctactaaaataaataaaagtaggttttattagaattatagtcagaggtaatggagtgaaaaaaatatttgaaactagaaatgtcttgggctttagtctttctgttgtcacattttagatcaaaaatatttggggagtcacttatccttcagtagatttctatttctgcatatttaagcagacttagcagcttaaacaccatcagtttattagctcacagttttatatattagaaatataagtgggcttgactctttttctccttagggtcttaccagactaaaattagttgttggccagacagatcttttctggaggctctggggaggaattttttataagctcattcaagttgtgcttagaatccagttccttacaggtagattgaacatgcacatttccttgttgagtgttaatcacaggccaccctttgttgctagaggcaacctgtgtaccttctcatgtagtgccccccatctttaatatcaccaaagaaagacttccccttatgttcaccagctggacaaaattttctactaaaaaaagaaaggtatgtgattagattaggcccagccataggagccccttttttatataataatttaatataatcatgggagttatatctcatcatattagtaggtttcactcacactcacagggagaagattacaggaaggcagtatttatggaagtcattcctacaattttgcttattacaggagccgatattttatctgaaaaaattgagattaattatatcttccatgaacaattgttggtagtagtagaagagctaatgtttagactcacttgccacatcataaacagcgaaattactaattgttctgataaacatttgaccctcatggatgcatattttatttataaacaagaatgtatgttagcacattctttctatattaactataaatctatctccttataatttcccccagcctttgaagtcaaacagataatatgtaatctctcatccatgtttattcactctgtggcattggtccagcatttgtagaaactccatttcatgtaaggcactcagtgctggggatcagtgaacaaaaatacatgacccccataatctcagagggtcctccctgaagaagtaacttgaaatgagatatggtagaagttaattaggtgaatagggaaagaatgagcctttcagaaataagcataggcatattagaaagggaaataagacagcaggaggaattaaacagctagaagactgaaaattattcaaaaagtgttacagtattagatagaaaaggtaggcagaacttgttacaggtagctgagagggagaaaagacagtaattgaaagccactaaagttttttaaaagttttttaagcatgaaggtaacataatagacattaattgtgagaataaaattattctatttactatgcagatgaaggtaaattagttcaaaagtaattaagaagaccgatcagatagaatattagactagttttgtggtaatagagatagacatgatttattttgaaatagctagatgacaaccaacataattttattgtaaatttaatatagtagggaagatgcaagggatattaggaatttcttcaagattcctagttggcatatgttgataatttgtgtatcattaactgttttaagttcaaagcccagcagtttaaacttgtgtacattgtggtggtttggcagtatttaaaatgagatatcaattagcatatttaacaaggtctggcatttagagtggagcagaaacttgagaaaataacatggaagcgactgcacatggatgaaatggagctgccaccatgcatggagaaggtggagaacctgattcagaagtcaccaaagagggttcagagttctgaacatcaagccagaaagaattattcctatgacttgaggcaatagagttttccttgatgacatctggacttgttgaaggccagtggctcctttgtttcgtgattttttttaaaaaaataaggacatccatgcctatcccaccataaaatgtcagaagcaaataatttatgttctagagtcaaagattcacatatggagagaaattttgcccaagatgaaatactcagagcttcattcatacctgatttagatgacttaggtaatacttgggacttattgatttgatgttatttagattaaattgtagacttagagttggtgctaaaatggattaaacttcagcctaaatgtccatgaataataaactggataaaggatacaccatggaatactatgcagccataaaaaagaatgagatcgtgtccttttctgggacatggatagaagtggaggtcattaactttagaaaagtaacacagaaacagaaaccaaatattgcatgttcttacttgtaagtgggagctaaatgatgagaacacatggacatatacaggggaaaaatacacagtgtggcttttcagagggtggagggtgggagaagggaaaggatcaggaaaaataactaatgactactaggcttaatacctgggtggtctgtacaagaaacccccatgacataatggtgatctgtacaagaaacccccatgaataagtttacaggtgtaacaaacctgcaaatttacccccgaacataaattgaaagtttaaaaaaagatttgaggattgttgggataaagtacatttatattgcttgtggaaagatcatgattttggggtagccacaatgtagacagtagtgggttgaatagtgtcctccaaaatctgtccatcaagagcctgtgattgttcatttcacagttttatgctgtgatggttagtactgagtgtcaacttgattggattgaaggatgcaaagtattgattctgggtctgtctgtgagggtgttggcaaaggagattaacatttgggtcagtgttctgggaaaagcagacccacccttaatctgggtggggaccatgtaatcagctgccagcatggccaggatacaaagcaggcagaaaaatgtaaaaaggcttgactgtcttagcctcccagcctacatctttctcacatgctggatgtttcctgccctcaaacatcagactccaggttcttcagctttgggactcagactgacttccttgctcctcagcttgcagacagcctattgtgggacattgtgatcttgtgagttgatactacttaataaactcccctttacatatatatgactaatacacgtctaccataaacccatgaatgtaaacttatttgaaaactgaatgtttgtagatgtaataaagttaagatgaggttatactgaaataagatcactcataagtccattgactgatgtctttataagattgggtgaagacatggagacatagatacagggagaaatggcatgtgcacatgggagcaacaattaaagtaacatgtgaaaaccaaggaacaccaaggtttgctggcacccaccagaagcaaggagagagtcatggaacagagtcttctctagacccttcagagggagcatggtccttctgaaaccttgtttttacacttgtacctaccagaactgtaagaaaacacatttccattgttttaaatcacccagtttctggtacatggttacaacagccttaggacactaacccagaaaatataggaaaagataaggcagacctacagtgataaatgagaatatttttgtttctttcttgccttttgttcacactatgaaattagagagacccaaggtattgtatgataaatgtgtagagttcagttgattaaatatagatatctctcctaaagatcctttcatataaataacaacatattataagttttaaaacttacatagaaataaaacttatgacaattatagaacaaaaatgggagagaagaaagagaagtatactcttgtaaagtccttatcttatgtgacatggtatactaatgacagtacactgtgtaactgtcatttatttgacataaatatcaaatatttgtagtatgttaaacaaaagggaaggtggaaagtctatgtgccattagataattttgtgtccagggctttctttttccatgcagaataccaggtttccaaacttcacagccgactatgagaagcttctgttatactttttttgttcaaatttgcctcaaccaattgagattattttgcaagtacaaactttaataattactaccaggattaatttgggtcttttgaaaagggaggacaattaagcaagaaaaatgctaagggttcaaacttatctcagtggagaagtaaagcagcttggtattggtaacgccgttgttaatataaagtagaaacctaggcaataccattcaggacataggcatgggcaaggacctcatgtctaaaacaccaaaagcaatggcaacaaaagccaaaattgacaaatgggatctaattaaactaaagagcttctgcacagcaaaagaacatcagagtgaacaggcaacctacagaatgggagaaaatttttgcaatctactcatctgacaaagggctaatatccagaatctacaaagaactcaaacaaatttacaagaaaaaaacaaacaaccccatcaaaaagtgggtgaaggatatgaacagacacttctcaaaataagacatttatgcagccaacagacacatgaaaaaatgctcatcatcactggccatcagagaaatgcaaatcaaaaccacagtgagataccatctcacaccagttagaatggctatcattataaagtcaggaaacaacaggtgctggagaggatgtggagaaataggaacacttttacactgttgctgggactgtaaactagttcaaccattgtggaagtcagtgtggtgattcctcaatgatctacaactagaaataccatttgactcagcaatcgcattactgggtatatacccaaatgattataaatcatgctgctataaagacacatgcacatgtatgtttattgcggcactattcacaatagaaaagacttggaaccaacccaaatgtccaacaacgatagactggattaagaaaatgtggcatcatggaatactatgcagccataaaaaaggatgagttcatgttctttgtagggacatggatgaagctggaaaccattattctcagcaaactatcacaaggacaaaaaataaaacactgcatgttctcactcataggtgggaattgaacaatgagaacacatggacacaggaaggggaacatcacacacgggggcctgttgtggggtggggggaggggggagggatagcatttggggatatacctaatgttaaatgacgagttactgggtgcagcacaccaacatggcacatgtatacatatgtaactaacctgcacattgtgcacatgtaccctaacagttaaaatataataataaaaaaaagaaattgtatttctctttcacttaccttcaattttttttttatatctgacagtctatttcaagatacaggtttctgttggggatcatactgtttctggaggaaaaatattaattaatttgttgtgaagtgatagtctgatgataatgaatcctttcggcctatttttcttttgaaagatattttcatttagacttttgtgttgacagtttttttaaatatcattacttttaaggtgtcactattgtcttctggtttacatagtttctgacaaaagtcaactgtttttattttagtttttattataatgttttcatattctctgtctgccttcaagattatctacggtttgcatcagttttactatttttatttagcactctgtctctcccccatcccccaccgcgtttgtgtgtgtgtatctgtatgtgtgtgtgtgttgtactcatcctgattgaggttctctgagctttgtggattggtgtatgttttttaccgtttttgtagaaatcttggcctttatcttttcaaaatttcttcttccttgttttctatttttgctctggaactccattcatatttatgattgactgttttatgtcttttcatagctcttcagtgttctgttcagttttccttttctctagtttttttcttatttttcgcttttattccaaaagaatttttcatctctgatattgttattttgtattgagtatactatttttagaacagttttgtattagttttagaacagtttaggggtttacagaaaaattgagagataccttatttcccctatacatattttctcctattatgaatgtctaatattagtgtggtacattaaccacaatgatgatccaatattgatacattattaagagttcatagattatattagggttctctctatgggttgtatagttgtttgggttttcacaattgcatgatgtcatgtatccaccattctagtatcatagaaaatagtttcactactctcaaaatcccatgtgctttaccactttcctcccctcccacatttattcctgatccttttacagtatttataatttgccctttttcataatgacataaagttagaatcatacattatgtactctttccagattggccttcttcacttagcaatatgcatttaatgtagctccagttcttttcatggtttgatagcttaatttttaaatcattgagtaaatttccattttactgatgtactggtttgtttatccatgcacctattataggatgtgttgggcttccagctttcaacaattatgaataaacctgctatgaacaattatatacacaattttatgtgatacacatttccaactcatttgggtaaatactagagaacattattgttggactgtatggtaaaattatgtagagctccataagaaagtgccaaactgtcttccaaaatggttgtgccattttgcatctccaccagaaataaatgagagttcctgttgcttcacattttcgccagcatttggtatcatttggtatcaaaaaaatatcattggtatttttttttcccagaaagggtctcactctcatcacccaggatggagttcagtggcacaatctcagttcactgcatgctcaacttcccaggctaaggtgatcttcccatctcagcctcccaagtagctgggactacaggcgcttgccaccatgcctgggtaatttttgcatttttagaagatggcgttttgtcatgttgaccaggctggtcttgaactcctggactcaagcaatccacctgccttgacttcccaaagtgctgggattacagctgtgagccatggtgcctggcctgcccatttttaaaggactttttttcttattctttcatttaagagttatttgtgtattttgaatataagtttcttaacatatgcacgtttcacaaacattttatctcattttgtgcttgtctttttagtccttcacaatctcaaacaacagaagctttaaacttataagtttccaacttatgtttttttttcttctctcatggatcaagctctagttgctatatttaaaaacttcatgccaaccctaggtaacttaggttaataaacactaagattaatatttctcctatgttaattttcagaagttttatatttttgtgttttacatttagatctataattctttatgagttaatctttagaaaatatgtaaagtttatatctagattaattattccttgtggatgtctagttattcctgcatcatttgcttaaaaaactattttattgagttgcctttgctctttgtaaatgatcagttgactatatttttatgggtctatttcttggttctctagtctgttccattgatttgtctatacttccaacaataccataataaagtatagtaagtaagcttagattgttggttttagatccttttatctaatacatgcactgaatgccatacatttccctataggtactgttttcactgaatcttacaattttttaaatccctctctccttttgcccaacctctggtaaccactatgagttcaacactttagattccatatgtaagtgaaataatgtggcatttgtctttctgtgcctggcctatttcgtttagttctccagtttcatccattttattgcaaacgacagaattctctttttaaaaaaaggttgaatagtattccattgtgtatgtacagcacattttctttatccattgatgaaattcattcatgaagacttaggttgagtccatattttgtctatcatgaataatgctgaaatgaaaatggagatgcagatatacttttaacatattgatttccattctttcggatatgtattcagaagtagatatgctggatcatatggcatttctatttttagtttttagaggaacctccataccattttccatatggatttactaagttacattcccaccagcaatttacatgagttcccttttttctccatgtccatgccaacattggttctctttcttttttgttttaaataaaagccattctaatgagagagaattaattgtggttttaatttgcatttccctagttattagtgatgttgagcattttttcatatacctatcgaccatttgcatgtcttcttttgaaaaatgtctgattttatttcccatttttaaattaggttgttttcttttgtttgagttgtttcagtttcttaaatattttggatattaactccttatcagatgtatgattcacaaatattttctcccattctttgggttgcctcttcactttattaattagttcctttgatatgcagaaatttttagtttgatgctatctcatttgtttatatttgcttttgttatctgtgctttcagagttatattaaaaaaattattggccaaaccaatgtaatggagattgttggctatgttttcttttagtaggtttacagtttcaggttttatattaattttcaaaatttgttttgagttaatttttgtatatggtatgagacagggatccaatatcattcgtgtgtctggatagccagtttttccagcatcactgattggggagactatcctttctctattgtgtagtcttggcacctgtgtaaaaaatcgcttaagcataaatatgtgggcttttttttgggttttctatcctgttccattggttgatgtgtctctctttttatgctagtaccatgctgtttttattataattgctttataatgtgctttgtaataagaaaacgtaatggtgtcagttttgttattgccacttaggatttttttcctattcagggtattttgtagttccatccaaatttaagataatttttttattttcatgaaaaacaacatgactaattggtatttatgctgtttcaagtatggttcaatgtacacaaacaataaatgcaggataccaattaaataaaattaagaaaaattatatgaaatcatctcaatagatgccaaaaaacctcatgttaaaattcaactgcccataatgatcaaaagaaaactttcaaaagattaagcataaagggaatgtacctcaacacagttaaggtcaaatataacaaacatatagctaacatcattctcaatgatgaaatgttgaaagctttttctctaagatcaaggataagcatgtccatcctcaccacttctttttaacattgtattggaagatgtagccagagcaattaggcaaaagaaagaaatgaaaagtattctaatagaaaatgaagaattgaactgtctctatttgctggcctggtaatctcatatatagaaaatgctaaagattccaccaaaaaactattagaactgataaatgcacttagcaaatttacaggatatactttcaacacaaaaaatcaataacatttctatatgctaataactacccaaaataatatttaaaaatatttatatctaatatatttatatttattaaatatattaatatatttatatttagttttataaatagatttatatttataagaatatttaaatattcttttggatagttactataaatcccatttacagtagcatcaataaaaatattacaacatgtatatttaaccaaggaggtaaaagacctgtatattgaaaactttaaaacactcatgaaggaattgaataaaacaaaaataatggaaatatatgccattttgatatggtttggctgagtctctacccaaatctcatcttgaattcctacatgttgtgggagggacctgatgggaagtaattgaatcatggggacaggtctttcctgtgttgctctcattatactgaataagtttcacaagatctgatcattttaaagaggagagtttccctgcacaacctctcttctcttgtctgctgccatgtgagatgtgcctttcactttcccctgtgattgtgaggcctccccagccacgtggaactgtaagtctgttaaaactctttcttttgtaatttgcccagtcttggttatgtctttatcagcagcatgaaaacagactaatacaaatgttattgatagaaataattaatattgtgaaaatgttcatgtgactcaaagccatctacagattcagtgcaagccctataaaaatttcagctttcttttgattagtcttagcatggtatatctttttatatctcttctatcattcacttttgaaaacattaatctctctcattgaaacaataactgccaaatttgtagcagttttctatttgtggcagtttttctttgtttcttacttttaaaaaacatattgtcccttttttctgtgtcttctggatccagtggtgcatcttatataactccatttgatctctctttgtgtatactatccttcctttttgaaaaatattgattgctctagagtttgcagtatgtatttacactaatccaagtgctatggaatccttgggctgtcactttgccagccagaaaactctgtggccagtggtgccattgcccaagtcttggtcagggccactgggcccacttggcatggcaggctgtgctcagctcatgctactggcctagatcccatgcctgccaaggttgagcagagtggcaagggttttgtcagcaagcgagtgtggggtcgggccactgcacacagccaggcacactggctgtggcagggctggaagctccaggcaccagcactggtgtcagctccctgtgtggttgtgactgggccagaagtactgcaagcagcttccatggctggtaccagggaatgcagtagcacctggaagttggatacaccaggacctgcagagccccaaagagggtgttgcagccctagcttggggagctcctaggtccgggctccctgaagggccacagctgttttctctttcttgttgcctgcaacatggtgagcaaggggtgtttttcagccctgtttgtgttacagctctttcagctctgccactcagtgggtcctgagttcttgtcccatgcccaggaagaaagaggtaggtagacaagtggaggatgagcaaggtgaagaagagctttattgagcaatagaacagctcagaggagaccaacagtggatagctcctcttagcaggcaggtcgtcccatcatgtcctggagtctgattgagttctgggtttccgcctgcctcagaggaaaggaagtgtgtgctgattggactatgggtggctatgggcaggcccagaaaaagcaccatgagttcctgctccggtctacagtactgacaacccagaccccaggcttcaggccttcctggcttaaaggtggggcttcactgggtacctgcccctttccacccaggaacttgtctgccttctgccactgttcatggtgtccaggctgttcatgcccaggggttctggcaggccagtgcggaactgcccttagcccctgcctcagattccctcccatgctcgttggtgcccaaagtccagagggggctgaggcggcaggggactggcatgtcagtgctcccctgagcatgcccacacacagctgggttgcaacagcacacgggcttggcctcaactcaactctgctcactggagggggcacaaggaacaggaagaagccaggcagcaggagcaggcacctctgagccagtgaggtcaggggtgcttcccagtcccgagagtgcagagatgcccgggtccacagccatggcttgggtggctgcaggtgtacctgggaaggtgtggctcctgactgctcccagcccccaagagctcagggatgcctgggttaacagccatggctggacagcctcagctgcagctgaggaaggcaaggcttccaccctgccatctcagaaaagggcagggcttccacctggtcctaactcctatcacaagtccacttttaaataaattttttcaaagggattttctgaaccttataatataacattcccacttcctccctctcatcacttattacattgctgtcattcatttcacttatccacaatgtacataatacatctttgctattattaacaattttaagactttgaacacttttaagaagatattttgttttaccttcatttactcctctaatgcttctttctttacatagattttggtttctgaccatgcttctttctttacgtagatttcaatttctgaccaatatcattttttcttctctccgaataattttttaacattgtttgcaaaatagtttactggtgacaaattatctgctttattatttaaagaaagtctttatttctctttaatttttgaaagataattttgctagacagtgacttctaggctggtgatatttttctctcaacactttaaatatttcatctcactctctttctacttctctgatttcgcatgtgaagtcaggtgcaatgcctattcttgttttcctataggtgaggtggtctttcatttccccctctgggtctttttaagagtttatctatgtttttctgtaatgaattctgcttctgttcagctgcaattctctgaattcattggtttctctagttttgtgtatgaaggtttgtcttgtcacctcaattatctggtggacttcagttgtttttcagctattcattttgttgttgtttcaatgattatgggagtgatgacctcagctttttgtgtaagagcagaaaacaatttttgatattgctcaatatttctaaattttccatttgactctttcttattcctacatttctgctataattgttcatcttttcactcatattatcttttgtttccccaaggtcttttaatatattaattatagttattcttaacttcctattaaatagttccaacatatggagtaatcattcagtcttgttctgtggattactcctcctctgtgcaatggctgaggtttttaaaaattattattatttttttgcaacttctatttttactgaatgccaggcattcgtatgtaatggcacagactgaggtgaatactcttcataactgaataagaaaatatattattcaattttctgctaatttacattgtttctgataagaaatcaaagttaattctaagtgtttatatgtatatattcaaatataatttggctacttttaagatagtttccttatcattgatttccatgagacttcgtgatacgttctctgtatttattccatttaaagttgtgttgggattttggaattctggatatgttgttttcagcaaatttagaaaaaggattggccaatagtttttaaagtacttcttctgctctaatattttaatcctctcaaatgttaattccattattcttttattagctcatgtaatattgtcccataggttactgggtctatacatatttttaactttttcttctctgtctgctttaatttgaaatttgactattcaaattcccacatattttcttcgccatgcattgtactattactttcatccattttagttttagaaagcatattatattttcattatcaagaaattcttctgagttctttccctttctctgttgagacttttacctatttattcattattcccactagtttctttacatttttaaacatttttgcaatatctgttttaagtagcacatggcaattcaaatgtctatattctctgaatctgtttctattatctgttttacttcccagatatagatcacactttttttcttcacatactttttaaaaaaatttatgctgaatagtaaagatatcacagtatataaggtttgcatattttattcctttaaaaatcgttcagtttgagctggtgggctgttaattgctagtggcctgacttgttgcttatcaagcctcctttgggtgcacttagaatagctctcattatatagcaatagtagctttatttttaagtcatgatcatctttcaactctggctggtcagatattcatctttcaacactctgtggactctaaacctgccatttatctcatagttttccaggaattttctgaaaacccttatagaatgttgtctatgaaagtgcaggtttgcattcaaccaaaaatctagggctcgtgcatattttaaattattatttttttcctgagaagctgcctcctttctaataccttccctgtaagtccaactttccaaaatttccaaatcaaccctgcaatctgatctctattatctgtatggattctaattccctatgctacattttggaaactagcttagaaagcaaattggtttcaatgtgacagtcatctcatgtgtttctcttgtgtcacacatcagtttgtaggtccattgaaaagcctttaaaatatattttatccaggttttatttgtatacagcagaagagtaagtccaatgactgattatcaattggatccaaaagtctggttactaatcataagtcatacatagatctattaaatgggattttgctaaatggaaggatatgtttttgtgacctcatccactgtcccccttggtactggctaaattatatttttagatttatattaaaagagagtttcataggccaaatcagagctaagttggcacaagtgctattgagaaggcaaaaataattttgagaaatacagaggtgctataccttctttttttttttttttttttttgacagaatcttgctctgtcaccaggctggagtgcagtggtgcaatctcggctcactgcaacctccaactccctggttcaagtgattctcctgcctcagcctcctgagtagctgggattacaggcacacgccaccatgcccagctaatttttgtatttttagtagagatggggattcaccatgttggctacgatagtctcgatctcctgaccctgtgatccacctgccgcggcctttcaaagtgctgggattacaagcgtgagccactgtgtctggcccagaagtgctatgactaatggactcatctgagattgagaattttaagttgacttagaaaggttaataatggggcaggcgcagtggctcacgtctgtaatcccagcactttgggaggctgaggcagttggatcacctgaggtcaggagtttgagaccagcctggccaacatggtgaaaccccgtctctactaaaaatacaaaaattagctaggcacagtggtgggcatctgtaatcccagctattcaggaggctgaggcgaattgcttgcacctgagaggcagaggttgcagtgagcctagatagcgccattgcactccagcctgggcaacaagaaggaaatcctgtctcaaaaaaagaaattaataatgttatttgcagatatcaagattctctatagacccaacttttctgtcttaggatattggttgctttataacaatctatatatttattcaaaagccaattatctagggatatttctgggctgtgaacaaaaatatctttctactttcaagtaactcaaataaataccaaggtgtggaaataaaaaattgcatatatatacacacataaagtctaagaaatttgagattatggtaagtactgttaagaaaataaaagagatcatataatagatattaaatcagtttataaagaggaaggactataggaggtgatttctaagaaggcaatatatgagctgatgtctaaagaagccaagtatgtgaacgccattagaaatgcaccccaggcatagaggagaaaaaacgaagtgttttctaaagagtgagtgatttttagatatgttacaggaaacaaacaaaataaagtttaatataggtgtgcattggaatgcatatattgaaaaagttgtcagtgtccaagtcttataagccttttcagtcatgttaagaaattaacttttattttaagcacagcaggaaaatcactgaagggtttataggggtaaagttatttattaaatgtatatttaaaattatgttcatttttttctgctatctggaaaagggaaggtaagaatgtagaaacacagatatctgttgggaatctagattttaggactcaatgaaggataatgataccctagactgatgtagctgcaataaagggaagaagtaaactaattaagattatttcattgtgtaaactaatagaactttgtgatggattggatgtgggaatgaagtagagatcagaatcacatatggttccaagatttatggtgtggtatttatggaagcttttactgaagtggaacagaaatcagaaattttaaaaaattaattacagacagtttggagattctttaaattgaaagtgttaagtaaaagattatgatttattaccagaaactacttcttgtctattttttgattctcataatcttatttttattaccatattacatttagcaatctgcttaaactgtatcatccattctttgcatgttcatgaaaatacatgcaatctgtctggagagatgataaaagttaaatctttatcatgattatttggaatttactgatactggatttctttcactttaaagaaaattgcctctttctattttagggaaatatttaatacagtcctactacagttgattaattgcatcctataggcaacaacaaatttgaatgtctctcttagaccttgagatctgtttcaatcaccaaaattatttggttgtcattttataaagtagagatataagaatgaatagcttctcaggttttttctttaaatttgccaatataggtcacgcttccctatggtttattatttattcaacagcctttaaaatatttaaagcaatagaatttttctgcctgtattgaaggaacattaaatgtgctcaaaaggcctctagttagatataatttttatgattcccaaactgttttttattttttagttatcattcctgctattagagttctaccattgaattgttattagataatatttgtagttctactttatattaataaaatatatttttgtccaaatatatctttaaagatgaaatttgtgatttttttcaatgacaagttctgctatgaaacaaatactttaaagttgctccactgtcctgagaatattaattttccaatttcaataaaaagagcagatggttaacattaagagtgatgaaacaggagatttaaatggttttacaataaaaaatgaaaacaaactcagttcatcattagttaaaagttacacaattgatctatcaccttcatattccaaaaatgtatacatatgcctggtaagaaggtaaatttattttctgggtgtggaatacagaagaacttttaaagggagaaaatattttagaaaggagaactcactatgcataaataaatttagaacatagctatcattcaataaatgttaattaaatccagatatttaatttgaggcataaaaatatcaaaaagaccatgtgtcttattttatttccagctttagatgaccgatttcctacaaacttattaaaagtttatagagaatttgttcatttgtttttattttagttttctacagatgaattatgtttcagaaaatgccaaacctgaatttcagtctcaaatcctctaccatctttttcacctaatacaacttatttaaatttgtcctgtcttctcaagtgtaaggtggaaatatgcttaattcagaatgttgagatatcaaatgacaaatgccttcaaattggtccacagtaggaactcacaaacattctatctttttcctattgcttttcttgactaacctatcaggcaggtgatcctatgacacatagagcaaaaatctgtccatgtcctcaaaaaccattatcaatattccattgtcaatgaaatctgagttctctatagatgcttatcttcttagcctgtttatcttatctttgatggcaggagttatgttctagatgttacttgtattattatagtatgtggtccaatattcatttactaaaccaagctgtttttatctctgaattttctgtaatattgataaaaacttcctttgcttgaacttccagaaaattccaagtctatgttagaaagccatacaaaattaaattctacttttgaaaataagccttcagactaagtgaattgtaattatttgtgtatatttcctggtcttttatcttcaatcaacacttgttataaaatgaactttcattagacaactgacattagacaagcttcactaaaagtatcattaattttgattttatttcttaaataaaaagcctgtggataattaaaacccttgtatatcatttagaagaagctctaataccatggattgttcgaatactcataaaatatataaagaaaagatggcatatttcaaaatcttgaaaacattgtctttattaattcatttacatatcattttaatcttatttaaattatatttttattttaaaaaatcacttcaagtcttctgatgttagtatttgtttgtttatttttaaatacttattgaaccctttgaatgtgacaagtgtggtttataatcctggaaattcacttgtgaataaacacaaatatttctgtactcatgtagaattggatatttttttctcattttcatagtgacaattttttctaacttattaaaacataaatgcatgttacaaaatattaatggagaaagcatgtaaaatgccactaaatgtaaattttctgttacagcttcgttatacctaaatacaaagccaatgtttccaatgattatgtaatcttatataactccatcatattcaattaactatgaattataccctaatctatgacttatgtggctagactattacgcaaaacatttaggtattattcttagaattaataaatttttgtattggttacttgataaaattcttgctgtatcaactaagtgggttggattgattatacataataaaccagagaaggtctccatatggaaggaggatattcagaaaagttcaaagatgggggagaatactattttctaggaagattaaacattttgtcatttcattacaggaacatatttttctgaaggtgttgattaaattatacaaacaggccatcaggttaaaaagaattacaatttgagtactacctttggaatttttctatcattctttacatgattactacaaacggacttgcacgagactttttaagctcagtgttctttcccttttgattttccccagtaaataataatatttcactgtctaaagacttccgactaaatatacttaattgaataagtaagagccttttaatcctttaaactgtaatttattaattaggtaatatgctagaaattgagttttcttagatctcagttgtgacttctcagttatcattttatcataccttacacttcattttatattttatatgaaaggattctcttatctacttatcactcagatacatcaagggagtggctctatgtcttgtgagcttaacagaaataactaccatgttccataaacatgaacatttgttcagactattataatccatgctcagttgtttttatttattctgaattaactaaaaatacaagttcctcaatctcatctaattcttttttgttttcaacaaacatgttttcagcatctcttttatatctggaccaggggatacagggaaagtccctgccctcatggaactttgttctcaagggaagaactaacaatcaaaataataaatgagataattacaaactaaggtaatgaatgagaagaaaatttaaaaaaaagatgacatagtgaagtaatttggggttatttcatcataaagagttcccttttaagagaaaaaaaatcttagttgagacctgaatagaaggaaatggccatgtgcacatctgaggaaaggatatttctgtagaagaaacatgatgaacaaaatctccaaaggaaaatagtgtagcatgtttgagaaataagcagcagctcgtgaacttgcatgattaaagagataatgttttgatataatgttgagagacaagccagagataaagcagattataaaagatcttgagaattaggttaagttttgactttattctaacaaaaatgagagggcattcaattattttaagtggggagttataagatctttttttttcttttttatgtaagacaagtctgtaaagaatttattggagaaaggtaagactagaagtaaggaggttgactgagaatatcactgcagtcatacaaaaaagagatggctattatttcaactgaagtgattaacagtggagaaaaaaaagacatctaagatggtcttttaagttagaactgaaaggatcaggcactaaatacgagggtgagagtaagaaaacaatcaatcatagtttccatgttgttttcttagatcaccggatggataatggtttctttacacaagatgagtaggaacatataacactgaaattccacttttaggtatataccaaagagaattgaaagcctgcatacaccccaaatcttacacataaatattcataaaagtgctattcataacagctgaaaatgtgcatattagaaagtgattgtgaatactcaaaagtcacaggcttagaaattacttgagaagaagtttacaacttagggtgatccttgatacagagtcagcttacaacaattaaaaaactaaaaataaacaaaaacaattacccccctcctcccccctccaaaaaaaaaaaaacaaaaagctgggaagtgggagaatctgatttgcagatttacaacattataagatcaaaatatccacttttcaacaaacatcacaaggcatagtgaaagaaggaaacaggaaaagatggcccattgaaatggaaacaaaaaacataaccaacagaaccttcctgaataatacctcgtggcagatctaccagacaacaattttaaaataattttcttaaagatgcttaagaagtaatagaggatgtggagaatgtaaagaaactatatgaacaaattggaaatatgagtaaagagatagcctaaataggaactaagagaaattctggagctgtaaactacaataacagaaatatgaaattcactggagggacttaaaggcatatttgagcagaccgaaggaaaaaaatagtgaatgtaaagataagacaatagaatttatgaattcagagaaacagaaataaataaagtttgaagaaaagtgaccaaagcctaagggacttgtgggataccatcaagtggaccaacatacacactgtggaagtctcagaagaagatgaaaaggaagggacacagagaatgcttgaagaaataatggcttaaattatcttacattcaactgagtaaagtcaaaaatatgaacatccaagaagctggcttatttcgctcaaaattaagtttctacgatttttctgctgttgtgtgaattacaattattgtgattatacaattatatagacatctaataaatatcttttacataatattatttgcataacatgccatttgcataatattcaatgttcccattaagaccctaatggatattttaaggaacaggccatcattaaactttttttctgctaggttttctcacagttgcttctcaaaaaaaaaaaaaaatcttgttttggtcacagagtggaaagtacctgtagatctacttaatatcccttttgaaaagattaggagggcattgtggtattggagttaaatgtctctaactgactacaggtaacacatgttttcttttaggcctgaaattaatgctatgtttatataacttcctaaatgaaatacaatacttttgggataaaaataaaagtcatctcttgctcttagagaggacaacagagtaaaagaaatgttctgagctgataaataaaggtaggtaactatgtctgctctcttggagtcaaaattttctctaaaggtcaacaccatactaaacacaatgctaaaaacacaattactaaaatgctagtcagctcctcccaaactctgtacaaattttgcagatgcagctttgatttgttttattcctcttgagagaaggtaggtttcaccagagtatttttgtaaatagtaattttccttagaaaattaaatctcagatgtttaaaggttaacagggtctttctgttatggctctaaaggataagccaaccaaggattgacaacaaagaatttgaaaaagaaggcaaccattcatttgccaatgaaaagagcagaaggctgagaggtgattataaaagtctttatccagaaatagataactctggacaaaagtagcaaatgaagggagtggatatattaaagatggagaatcttgtttctactgtcctctgaagttatggtggtagcaaattcaaatttatatagtagccaggtaaatagcctaaataagtacagttgacaactcatatgaaagggagagtgtatgtcccatctcaaggaggtaatgactcctcatagccagcctgttgttaccaaagtgaaatgtatgcccaatgtttacaggtcttctacattgtaataagaagcaaaaattaagggtatcatgtaatgatctaacttataaatattatctcacctttataaattatcttgcccaacaaaacagatccagactatattcaacctgtgggccacatttagcaagctgcctaataattaattaaatgttgaaaaccaatggtgcagtaagtcaaaactcctatcttctgatgatagaaaatctggctggctggcgatttcttgctgaggacataggatccagcccaaagtttctgaccacaacacatggaagtggaagtcaagatgcagaagaaggagaccatctcttatagcccctctgcttccagggagtggtagttgactcccctgtgtttagagatgagaaaatgtaaatcaatatctcacctttccttaatcctcacccactttaaagcctcagttgaaatctagagttccagcatcatcaaaattatgatagtgagagtaaacacaggaaagctagattatcttagagtctcaaaggaacataaacagcatgagtcaggaagtctaacatgttctttgcaattcccccagtacctagacaagttggcatgttgtaggagctccataaatggaccaggaagtataacaggaacttcaggagtgcagtcacacttagtaaagtgtgacttgatcaatatgctcacatgattaaatttgtttcagccagataacagtgggaactgttatgaaaaagactaagagatgaaatgctaaagagactaaaacaaggtaagatctgtaaggaaataacaaggaactaaaatagagcattgtattagactgtttttacactgctgataaagacacatctgagaatgaatgggcaatttacaaaggtaagaggtttataggacttactgttccacatggctggggaggcattacaattatggcagaaggtgaaaggcacatctcacatggatggcagcaagcaaagagcttgtgcagggaaactcccatttttaaaaccatcagatcttgtgagacttattcactatcatgagaactgcacgggaaagacccatccccatgattcaattacttctcaccgggtccctcccacaacatatgggaattcaagaagagatttgggaggggacacagccaaatcatatcaagcagtgaaattaattttccactacaacaccagaggaaagaatcctttcaaacatgggagacacttttatgtgaaatccaaagagttgatcccatagaaacagagagttaaaaggcagttgccagaggctggaggaaggagcaaggtggagaaagggatgatattgatcaaagggtacaaatttttaattagaatagaggaatatgttgtagtgacttatcacattttatgggtgccatagttaataataatgtattgcatatatcaaaattgcttaaaaatagatttttaacattctcattacaaaaaaaattatcagttagtggggagatggatatgttcattagcttgactgaatctttcaacaatgtttacataaataaaaaaacatcatattgtgcctcataaatatatacaattactatgtgtcaattaaaaataaataaatacataaattttacaaatgaaaaaataaatgtggcacatttttttctttttgcattagaaatattagggccaagatttcaaattgcaaatgtcttcaaagctctttgctttctaatggattatatttctatttattttccccattaaaagccacaattaaatggcctggtagtacttcaaaactttgatttttaagtgtctttaagatttctttaaatttgaccagtttgtatgaaaccacagcacatttcagctgaataatgacagtgcagaaaggcactttgttacagataaaaatcattgactttcggagatgccatcaatagtcatttagactagaatatttcagtctcaaaagtaaagatattttctcctttataggcagcacattgcattttacatggttgttaagatttatagattcattgtctagcttccataggtgaagtaatttcagactcacataaccaaaagaggtagaatttcattgtatcgaattctcttttcttccctttctactcaattagtgaaaaatctgtttttcaaattgtaatgtctcagatactgacagtaaggatttccatactttaaaaagtatgcagtatgctccatacctgggctttgggcaccttcactggattccttcctgttttgatttttaaactcattattttagtttggattctgctgaaatcagaacttaagatgggggcttgtgtgcagtaatgcatttggtagatgattttaggaagtaaaattgaggagctcgggacatgaaatcagagaataacgaagtcagtagaagaaatcttattatggttactatttgggcaatgactaaataattacataatgacctttagaaagttaataacatataatcaggattatccataagtaaagctggtgattagaatatttataaattaccttccatccctagttgtttgaagggtgtcttaggagcactgacttcttgtattttgagcctgaacgtgcctgtatgctaaggtagttcacatcgtgtatgaaaagatcctcaaagggagcaaagacttgatataaggaactgccatgatgaggcgagctgagatcactcagtacagctcattccaaatgcagtactgctcattccaaatgcaactgaaatcagaggctgaccaagaaagaggatgtagcctggagcaccagagtcatttgctatgtttactgcaggaagtatcaaggcctgctttctagaaatatacctgtaggtctgcctccctccatgtactctctgatcttccccattcaattgaccccaatcttccaagaagccagttgtgtatattttgcttggaatgtgctttgtacactcaattcttacctcaatttgcaccaatttgtgtgtgtgtgtgtgctgaggaagttggagaattaaaatgttcatgctttgggacataggtattaggtgtgctcttcataataactttgccagaaagccctgcactttgggaattattgagcttttgtgattacatatggcaatgtaatcttgtattttgagttctcacttatggttagaacttcagttgggtgctccgggctatatcttcttccttgtccagcctctgatatcagttgcatttgaaatgagcagttctgagtggtctcaactcacctcataatgaaagttccctatgtaaagtgctcgctgagtctttgctccctcttgagggtctttttctatacataggagccatccatgtatagaaagaaactatgaacaactgaagaagaagaaacactgaacaactaggaataacaaccacatcagagcctaacacattaaatcatccaataactataatttttggtaccactggtctttaattaggtcattctaattaaaatgttcttacataatttgttctgtaatgttaaaagtgtattttaatgttctatctattatatataatttatctgaggccaattactctaaaatatgtgatgccctagaaaactaaatataggtggataatgacctataaatatatgataattgatgtgtttttaatagacattacttaatctcaaatcattatcttattttgtagagtataaaaattaactgcttcaagattattttatattatataaagaatcaccaatgataaagttacttgtcttaatttgctattggtttcaatttagaaagatttattatgagttagtgaataatataaaaagtctaaattttgtgttttacttcacctctagatttactataaagaacaattttactttgtaatattacatcaaattatatcctatctgaatttaaaattaatgttatatactcacatatattgtattttaatttagaatgaacctgattcacagggttgtaaaaaattatctagattgtttgccacagtttcaaaaagtcagcattttaaaagtcagaattttatttcttattggttactaattttttaaatgttttttattggcagcatgagaagaaaattaaaagagaaaacactttatgaaaaactataatcactaagcagttacatgtgttaacattcaaaaagtttaaattgtatacaattaaaaaattaacttacttgaagtgaaatatgattttattttaaaaatttttgtgtgcctttaatgtcctaggcactcttgtaggtactgcaataaaataatgaacaaaagagagaaattcctgtgttcaaggagatttaattcaagtagtaagagagaaaataaacagttaagtgacagacttattaggaagtgctaattgctaggaagggaataaaaggtaattgaatagagtgacatagtgttatttttatataatgtaggtaggcttgtaagagaaacttctatacaaagcctgataaaataatacagaaaagcatgctatcagagggaagtgatacacacccagatagaatagcagaggccaacactgtggaattgagggagaaattagattagagaggtagctaggggccatattatacaggatttagcagaccaatgtaaggagtatgtgctttgttcaagtattttgggaagctacggaagattttgaacatgggagtgaagtgatatgctttaattttaaaatgatcactctgggtgctagatagtgaatatattttaacatcagaagagggaagatggagacaaattaagatgtcatatttcaggcaagagatgatgggggcttagactaggatcattgcaatataggttgtgaaagtggttgaattaaaatgtattttgaagatgcagccaatgggatttgctgatggactgcatggagatgtgtgagcaaagagttaagaataactccacagttttggcctgagaaactgggtaataatgatgccatccactgaggtggacaacactaggcagaacacagttggaataaatcctcagtactaatcagtctgaggtattatatggatacctgaatgaacatgttagtagttatttgggtatatgagttgagagttcaggggagacacaaagattcatagaacatatttgggaattattagtatatttatggtattttttaaatggttgaaattcctcaatcagtgaacatatctaaaaatagaaataatgatgatctaaacaattatgcgatccactaatagtaagagaaaacaatgatgaaattgataattgcggaaacatggagtgcaagtttacaaggtattttacataaacaaaataggtaaaatgctactgataatatgaccacaatgtggaaagaaaatggcaatggagaataattagtgacctccaacaagaagaataccattttaatcttgggattaaagcatgattggaagtgggattgaaagagaataggtagtgaggaaatggatattcaatagacagcaggtttcaaaattcttttttttaaacaaatcgagtagtagtttaacactttttacacattgtagaaagattcaaaaacaaaatgaggaaaaggtaaatatttattcatatgctgatagcaagtgatatagtatggagagaataatttatgctggagaaaataaatgcaggataaactttccttaacaataaatgaggctgggtgcagtggctcatgcctgtaatcccagcactttgataggctgaggcaggcagatgacttgaggtcaggagttcaagaacagccttgccaacatggtgaaaccccatctttactaaaaatacaaaaattagctgggtgtggtggcgagcacccgtaatcccagctacttgggaggctgaggcaggagaattgcttgaggtggaggttgcagtgagcagagattgcaccactgcactccagcctaggcgacaacagcgagactccatcggaaaaaagaaaatatgataataataatggagagaatccatacagcagtagggcagtagggttgacaatagacaggaatgtggaaaaacagaaaatgtagtctatgaatgcagatgcgtatagtttggtagttgttagtgcgaagataaagaagctttcttctgatggcttttattttctcagggatataagaaacaaagacaattgaaacttcaatagagaaaggattgataatggtgtaaaaagataaagctagaatagtaggctaggatactcggaaattcaattgattcagaagaagcaggattgtcaggcagcaccaagggctttcttgagatttgtggtcaagaaatcaaggtaagaacattcattctcattctctctctctctctctccctccccccactcataatttttctctgtgtgtgtttgcgtgtgtgtgtttctttaagcacatgcattttttttctgacaagtaagagtgattttaataatgagtcctataatgtaggctgggaacatgggaaataaggatttttttttttaacaagagtcaaaattggcagcctgaaaatagcattaatgagcaattcttggaagacttgtattttcctactcacctcttcagctaatgtcatgccagcctcttggtcattgctctgtgcttctttcctgctgcaacttctatcctcctggtgtttattttgccctgtgctagaaactgcattgatattttactctctgaagttccattaacacgcatttttgtttgcattatagaatttcactaagggtttgaagaaataatttagagcacggtagaaaaaataagttgaattttatgtgttgcccttttagcaatttgttggcttttttgaacagaactatctaactggcccttaggttctggctcaccaaatcttgtcaaatctattttctcactgtgtatgtcctcacctctatctccacctatcatttcctatgaaggggaaaagacccaccaataatgacatttcagctttctaaaatacaatagctggctttgatgctcactcacaaatagtatcaaaatcaccagtcaggcattcccattcattcagatttttcagttagcattttgatggttctctcttagacattaaccgatattcaaggattttctcatattaaagggatatctctaaataaatagatacataaacaagaaaatagcacatacacgcagaaaaaagaaattctgaaacactgaggcaaggcaggaaaaaaacatacaaaaagcttcataaatattattttagagaaaatataagatattttgtttgtgaacattgcagaatgcgctaaaaatattaggtaagatagacagttttggggaactgaaatgaaagctaaatattaacaatgtaatagaggcactggaaaagaagatgtaagtaaatcctcaaatgagcaaaaaataaaattagagaggaatattgatatatttacaatattattgacaatgacttctgactaataacatttttgatataactatgtggggaggaaagagtaagaaaacatatttggttagggggatagggataagctaagttttaattatccatagaaacaattagatatgtgaaacacagaagagaaaagttcaagaaatggtagtataattgtgccatttagaaatatagaggtaaatatcagaagtattaagagtgttgaaagaagttgcttctggaagcaggtctgctgtgttttatattattctcccacctcctcactcctgctttatacaggcaaatcataccttttccagagctgtcgctggtataacacctctttcttcctagtgtcattatagaattagttacctgattctgtaactgttaagcatagtcattgctaaacacagggccctcattacacacaggcggaaaaagcaaagcattttgaggaatctgtgaatttgtaagtcctttaaaatcagattagtctttgtacattgtatattttttcctaatacctcaagactgcaagactgctaactatagctaaaattctgaggtgcttcccctatttaatttatgatatgatggtgcttttttatataattgtatatacatgctatgaagattctaatgtcccatagacatatcaaagcttcttttttgctttactctcttcttctaattattcaattacataaaaatgtaaatatcagttagtaaggaactatttcatctttatatgtaattaagtgtaattttggttcttgatctctctctacctctccctctctatacacatttgtatatctgtgtttgtaccaatatattataggcatcttgaacccaaacctaatcaactttttccgtagctttcccttaatgttccatttaaattcacttccccaactccttaccttcatcctggtccccataatcatttgtttttaatttctttttagaatttttcctgtggaaagttaataccatataaggcaattaagctattatatctcatatatatctatatatacatatttatatatatttatttataggtttgtgtttatattttacacacatacttatgtataagagattttatatatatatatacacacacacatatatttctatacacacgctctagtatgtatattatactggccttattttatatattatgtgtgtgtataatatataaaataaatgtgaataaattttttttttgatcatagctttctgtcagaactttgagagttaaatcctccaacccttctaggaagtagtattgccattctctgacacacctggcctgaattgatgcctgaatcaattcagaatttactacatctattgagacactttgtccatcctgattactgcataacaagttcacctcatgtctcatgctagtgcattaatccaggtgcaaaaactaccccctaacaattgtatgtgagctgggtttttgtacccttatcatcatttttttgacattaaaaagaaagctcatttctttcaatatgagaagcctaaaatagagttaactgaaagtcatacacatgagaacaagttattgattgtagtggcaggagactaagtgccgaatgatgttgtataacagattcactgtgccaagtctaaatgtctggaatatcatctgtgggaaaattcaacttcttattttagccactgtattttaatattttagcatttttttgttagcaaaggtaatcttatctggatgaatatattcagttatacatttttttcatatctttggaaatatctccgattactttacatatttagttggattttgttcaatatctctctttaccgtaacataagctcctttagggtagggaaccttctctgttatgttcaccagactttactgagagttttcaacaaggcttgggatgtaagaggcacgtacacatttgtgacattagcaaatagaaaatgcaattgcattctgcgtccattcatggttataactcaataaaataagatattggctattaaaatttgcatctggatagtaaatctagaatataaatcttcaatgtaaactctgtaagttttattccttctttgcaattgttcctcttgccatttaagctgatttaagggcttacttaaataaacattgttttaagaaaagccaaggacagtctataaaataagttaattaaaagtactattaatgtttgtaattcaatgatataaacatcatttttcaaagtgcaatttcaatgtgtaagatccagcttttgataaaagagaaatggatttgcgagttctaagtgataaaggcaattttataatgaggttttggatttcaaatgaggatgagacagcttggacatagtaagcaaagcccatggaagagaacatggacatcaagagtctataccagtacacagtacccaaataccagggacaatgtctttctccattgcgtccagattaaacagagcaaaagagtgacggatctctgaataaaaaagatattcaactccaaaactgatataactgaattttgtcttgaaaaagtcacacatcgacttggcacattgacattttcttctgttagatgaaattttacccatacattatatggaattcattatgacacaaataacatatatgtttgcacatttgagttgtgaaagtgaattttaaatcttgtcacataagggaaaagtggttgagcacaattcagttgcctgtttaatgtagctcctgcctacattaacagaaaaaggaaatggtaaatgctatgttaataatgttgctgtcgttgacaaaaaaaaatgattactattaatctaaagctaaatataatcaaataccaaatattttcctaaatgtttatatctatagacttatagttatcaatcaaacaaaaaataaacactaaaccctttgtgtttaaattattacagatgcataatgtgtaattagaaatttgaagttgcttttacatcttttatttcccattcaattaattatctttatattctattttaatatatcttgttaaactaggaactcagctgacatattgtaccagagtagactaaactttgatggagagaagagataaaatggtgagcaagtagatttggggagtctcctcagacgaactgataattaaatcagaatttcacaaaactataagttcagtggataaaatgggtgatatagaagaaaataacagaagccaagagtctaagaaaagattcctatagaaagttgcatctgagttatggtatgaggatcagtacttgcaataggataaatggggtattttaggcagcagaaacaatataataataatatctttacaataaccaaaaatgtacaattgatcaattgtccatattttcccaaactatgcttctttatacatgtactcaaggcagattgttttacttcttatgtagattgggcatttggcaaaaaatgtattcagaagacagcttagttatctcaagcagaaaatattataactgaatatagtcatacgtttgcatgtgtatatgaaacatatccaagaaaaaatgtgcatcgctttgaagcaaacataattatattttattattctgaactattgaattgtatatgttttctacatggcattattatcaaagttattatttctgagataggacttaggcattttaaaaatatttatacttttctagtagatatataaatattaatatagatataaacacaaatgtagacatgactacatgtaatcacatttaaagtccttaagcacaagttcataaacttttatctacagattaataatatataatcgtgtctagttaagaggagacttcttgctaaatgagtgaatattttagaaagcaatataaatttatttatattcatctttcctatatttaaatcactaataattaaaactcaaattcgtaagccaatattctttaggaaagacaaagttagacaacactgcaaatctactgataaactgatttatatcttttgcaagataaaatgcaagcctttgatcatatgccatcacttgtgtacttcctgttcattaaattcagtcaactcactaccactacgtgtgtaaatttggactctgtgatagtgtttaattaaaaatactctagataaattaattatagaatggctttaaatagtcaactttgtaaatgtttattatcttcttccaattctagataccacaagtcttcataagaataagaaccatgtcagccttgatcatcacaaaacctcaacagctaatagaatacaaatcataaaatgaagaagtatcgagttaatcactgatagcctgtgtacatattatttaatgtgttcttcaaagaatgctctgatttagataattaagaatcataaactttcctggtcagagtcttgaaaaatttatatccttaataacttggttaaatgtattcataggtgtaggcaaagctaaatttttctgaataatatatttggttaccaaattttaacacatttaatattgtatttaatgttattttaactttcctctctatcactaataccattacattcaaattttgtttttttctgatggagcaaagctagagtagaaataaaactggaattagagagggatgtgtattttggttccggctctgtcactaccagatgtatgatcttgaaaaatatacaaaagtataacatccttgtgttttaaagtttaagattctttaagtaaaaccttgcagtgtcatgactctcttgaaatggaacaacctaaaaatgaatagatttgaacatctcacaaaacagtaatgctttaggagccttgaaaaaaagatttccagagaaggctaagaaaaataaatgctattaagtgtctgagaataagaaaaagctttatctgtccatgtatgaaagagaaggtcaatttgaatgtcaaaagagtatgtacagaaaaacaaatacatgtaactttcttgagggggaaaacttctttttgaatgtccagtcatgtatctttcttggtttgaaaccaaactgtaacacatatttcataatattttttctatattcaactgtaaattctgaaagtggtacacttttaatttcttatcttccactgaacctaaaaatggacatgtgagcagttttgctcagtgacatattagcaggttttgattgttattctaaaaaggttctccttatagaaagactcaatacagttagcaccactcttttcctttgactcaagtgtagaaataatgacttaagtcattgcagtagcaattctgaatgcatgaacctataatcatgaattaaaaactaagaaaaccattaccccatcctggtactgtcaagtcactggaccaacaaccattagctgtctacctacagaattcttattatgtaagaaaaaatgaaccctatctattaaggataacaattaattgagttttcttttacttgtagctgtaccaatatgcaaacatatattaaaacatcttaaatcatgtgccactggtaacatcttagataatatcattttaaaacaatgctaagtaccatattttgaaatgaaattaaagaggttatcaaaagaaaaataaagaacatgttaatctttcaaatgttgatacatttaaaatatcagagcaaggtgttataacaaataattttacaaaatgtgtttcttagtcatgttgagctcagtgtgttgtttcttattttaatacttctagcagcagtaacaacaacaaggtgaatggcattgctgagtggatatatatggttctacattgatagctcaataattttgaagataatgggcaatgtgaaacttagaaagtaaactgttttatagttgaaatttaatgtttcttgtatattatatgtaatgaactttgcagaaaatgatactttttgggaaatattaacttaatctgatagtttttgtgtatatgagatttgttaccaagattacctctgaagccatcaagatttctcaggaaagacaccttcatatttctttttaaggtcacgtaactttctctcaccttttgattacttattctctggaaatacttctagttcctttccatttttgcttgccaatataatttccatgtgtctagtattattttatccctgctggcagagaacctaatattagatgtatttaactactcatccctcaggatagaaatccatatgattttagtgctgcacaaatcagatgttaataaactgagatttgagatgtaaatacattattgtaatctctgtgggaattgtctgaaaaaatacatatgaaacaaaataacacaaaaactatattattgttagtcccatatcattaatactagtatgccaaaactaaaacaatatagctatttgtattttgtaaatgcaatttctcaccagaaatttagagggctaatgcctctaccttctataagctccctgatgacttttgcctttatgtttggataaaatttatgctgtgaaataattgatactgacagctaatgccaatcttcttttgctttacatttaaattcacaatggctgtctttttatgtaaatatttttaatgctaagcatattctagaaatgacagttttgtaacagatataataatgttatttctgttagattacccatacagaaatacttttttgtatattatagccatgcaaacttactaaagatacatttactgtaaaagataaaaatgtaagataacttaaaatctaatcttaggatttaataaattgaagataaaacacataattttacttcttattaatttcttttataagagacaaattatctcttgacatttttgccctgtttgcatctggcagattatttcaggttttggagtataaatatgaggtttctatttgcttgcagacagaaatatgttgctgcacatgggacagatatggatttacctgtataaccaggggcacagaggcagttgtatccatcagtcctgtagacacaattttcttcatctagacaaggtgagattttacatttatttacatcaagttcacagaagggcccatggtactcaggttcacaattacaaaaaaatctggagaaaagtggagaaatgaggaatagccatgtaacaatgataatcatttattatatatgattcatatttatattttaaattcaagacattcaacttaattgaaataaataatatatgtatttcatttttttctttgaaaaaatatagcaattctccttgcaaaattttgttctgctcaaatgttctttatgtgtgaaattttgaaaaacaatgtgttgggtaaataattactgtaacctgataaatactagtatcaaaatatagatgaggtcatgtcctttgtagggacatggatgaagctggaaaccatcattctcagcaaactatcacaaggacaaaaaaccaaacaccgcatgttctcactcataggtgggaagtgaacaatgagaacacatggacacaggaaggggaacatcacacaccggggactgttgtggggtggggggaggggggagggatagcattgggagagatacctaatattaaatgatgagttgatgggtgcagcacaccaacatggcacatgtatacatatgtaacaaatctgcacgttgtgcacatgtaccctgaaacttaaagtataataataataaacaaacaaaaaaaaagaaataatttccaaaggagatattaaactgatcgaaactgtatacttagcaaaaatatctcttcatagtttttccttttagaagtctagataaagaagctttagcaactttccataaaatgtttttgagctagatttctatttagattttttaggaaactcttcctaattaacttcactcatcattttataaccacagaagtctaacattccccatgctcctccttttacttcttcaacctacattaattaattgagcgccagacattagtcatgtacccatattcaagtgtaaattaaactagagcttgcttttgaaagtctcaggaacaggacaggaatacagatatgtaaacattacagtaaatacatgtcaattgagacaggtcctgttaaagcatggctagctgctagacaagaggtgacagaaaaggtcttactcagtattaataaagaaggagcaggatcagtgttttaaaattctgaatatgaatgaaaacatgcagtatttttctttctgtgcctggcatatttcatttacaataatgtcctccaggatcatgtatgttgttacaaataacaggacttcattctttttcatggctgaagagtatttcattgtttatgtatactacatattttttattcattcatctcttaagtaaagtaagccagacagtaggggagaggggataggaaagattgattgatgggtgcaaaattacatgtagaaaggaagaataaatttggtgtcctattgcacagtacggtgactgtagtaaacagtaaggtattgtatattcaaaagagctagaggagaaaattttgaatgtttgcaccacaaagaaatgatgaatgtttgaggtgatctctatgctaattatccttattcgttcattacaaacgaatgaacaaatgtgctgtaatacaatgtattatgtagtataatgatacaatgtattcatgtatcaaaacaacacaacaaaacaacacataaatatatcaattatgtgtaaatgaaaaataaaattaatagaaaaagaaagagtaaggaatctttgtatcagttggacagaaggcattaaaatgtcatgtgcaatgggatactgggtgaaagagtagagtatttcccaagagctcttcatgtgactagggaattgactataatcacctttttggagtaacactaatccaaatactaacttcttgaatttttgttcaaatagtcaaactgtttttctccattgtattcattttgcgaatatctccccatctagtgagaagtaatgtaatgaatctgctaaatgtcttactaaaatcaagatatgtttgttaataatactgtctttgctactttgtgttctcactgaattaatgatgatcccaaggaatcacagaatagagagaaattggacacagaattctcagaaatagcagtgaaaggtatctcaagaaatgatttgtttcatactgacaaatttaaaaatgttatattactataaaaacaatgactttcatttcaatttatgtatttctttcatgtacttctgacagttctattatatttttagaagtttcaaaatctactttgtattttgaaatattgaatactagaaaattatttggtgatatcttgctttttcagtgatttatgataatcaccaccaattgtttcaattttttttaaacagtagtttactacttaatttatagaattttctctctctctcattttgaaaatcagaaaatcataacatcccttgtcttttgctccccaaattttgttttcggtgattttcattatcttaaatatacttacttacttgttgcataagttaatgggaaatttttgtgaaatgtctttttgtcatgatgaagatgtgggttttgctgagtattaatttttttttgtctgtatagttatcttgaagatacatgaaaggattcagattctgacacctacccataattcttgttttttcaattatgatttccttctgaattttgccttttgaaccctttgttagtttttactaaatgttattgttgcgggaagtcagggaccccaaatggagggaccgactgaagccatgacagaagaacgtggattgtgaagatttcatggacgtttactagttccccaaattaatacttttataatttcttatgcctgtctttactgcaatctctaaacataaattgtgaagatttcatggacacttatcacttccccagtcaatacccttgtgatttcctatgcccgtctttactttaatcttttaatcctgtcagctgaggaagatgtatgtcgcctcaggaccttgtgataattgcattaactgcacaaattgtagagcatgtgtgtttaaacaatatgaaatctgggcaccttaataaaagaacaggataacagcaactgttcagggaataagagagataaccttaaactctgaccgccggtgagctgggtggaacggagccatatttctcttctttcaaaagcaactgggagaaatatcactgaattctttttctcagcaaggaacatccctgggaaagagaatatgcacctggaggtataggcctataaatgccccccccccccaaggtgtgcccatctcttatggttgagactgcaggggtaaaatagaccccagtctcccatagcgctcccaggcttattaggaagaggaaattcctgcctgataaattttggtcagaccagttgctctcaaaaccctgtctcctgataagatgttatcaatgacaatggtgcccaaaacttcattagcaattttaatttcgtcctggtcctgtgatctcgccctgcctccatttgccttgtgatattctattaccttgtaaagtacttgatgtctgtaacccacacctattcgcacacttcctcccctttgaaaatccctaataaaaacttgctggtttttgcggcttgtgaggcatcacggaacctacagacatgtgatgtctcccctggacgcccagctttaaaatttccctcttttgtacgctgtccctttatttctcaagccagctgacgcttaaggaaaatagaaaagaacctacgtgaatatcagggcaggttccccgatatgttatattcatttttttgcttccatgcccatccttcaaatgtatttactctaatttaagatgaacttctcaaaaagttctgcttttttgtttgctctttaacatttatcatgtaacttattttatgaatctcaaatatgtaccttacgcttctgattttgaaagtgatatcacacagtaaataaacatacatgtattatctcaagacttatggaagtttatttttctaaagtttttggcatacagacaactatgtgaagaattgtttttaataatatgaatcataatgatcctttcttctaagaatgctttgcttctacttcaataacctctctttcctttttgctttcaatcaagaccattattttttcttactttctacactactcctgaaatctgaacttttcaacattgcaaaaatatgctttacttttacataaattccaaacattattaaatttcaagaatctgttaaaccacagatgcctgttcaactggaatgttgggggtccctgctttgttaataatgatgcaaaaaggccctgggattctagagtccatttggacattttctgaatggcatctaaaatttcatagagattaaaaaaaaaaaaatcatcgacattaacagcagccctggtgaaacagtttacagaaaatattcaacttatatttcttactttccaccacactaaacaatatgagggcaaatttgtgcgaaaataacattttactctacaacagagcaactacctttaatccttgtctctgctttcccagaaaaatttaaatgtttttattttctcttcctcctttcctccctccacctgccctgccctgctctcttcccgctccctgtgtctaataggaagggcaagcacaatgctgagcacttgggacgtttttactttgcacttaacgttggcccttcaaaacgttaaaaaaataaaagtgcctagggtatgtctgaaaagatcctcatcaaatttttcccctcctggcctctggctatagtgtgcaattctttcagctttggtattttcctttcgctattacctgctgagggtccctttatgctaaccacctctaataaggctagagaaaaattaaatgtaaacctgatttttattaatgtcctaagtgatccagtcaaatgtacagtcagtactgcattttatattaaaggtccctaaagtataccttcctttgataaaactcaatattcatagcttttaaaatatacatatataataatatcttctatcttgagagaacaattaagaccatgaaatatgtatttttgatgaaataaaaatttctcatttaaataaaaagcttttacttcaaaagttttagaattaaacttaaatatattgtcaaagtattgaaataattcatatttttaatttgacattgccctaaaatttttcaaataggtgttcaagatactttttcaatcactaagatgcattttaacagtgacttctgaagaaaattcaacatattaaaatagagataaggaagagtaactataatttgcataaaatgatatctccaaactataaaaagatggaaaaatacaagataatcacatgaatttatagcccccaaattagccacgattacatttcatttacattattcttatatactttttcttgtattccagatgagagaggaattaataagtagatgtattatttgtatgcttctgaagttattttaaaatataattattaaatagattgaatagtattacaaaatccaaacataacacagaatgttttaatgagagttttgattttaaaatgtgtttgcaataaaattaaatcatacttgtttcagtagatattttttaaaagcttacattcaaaataagaaaatgaaaccactggtgaaactttctgataaggacttttaagcctatgttaaagtaattcaaattttgaaagaatttataatgtattttaaagcatttctacttttttcttgtgatattataactgcattcatgaaccacacttctttacaatgaatgacaatttttacttagaatatgaataatctattttatatttgcaacatgtctttattatgttatatataaatatatgtctacattatttatcatactcacaacatgtctttatatgtttttattataattgcatgtgggtgtgaatctgatttgaaacagtgatgttatcgtaaattctctagtagaataaacatcattcggattgatgactgtttctaggcaaacaattacagaagagtaaacagatttttgtcttttggttaaatgcatattaaccaatcacttttaaatttgtaacagtgaagaattgctaaacccgtgaacatcacaaactgaatggtcacaatatgcttgttggtaatgatctcgctatgataatcacatcagccaggcacttggaacattttcttctattttttctttaaatgcactagccactgttattgtaattgttcttgcaaattctatttagttgtaaattttcagtagatggatactattgtgagtgacctaaatgaactagtagcaatgacttgaaaagacattagttgcatgggataacatatgctatcaagtgtcagaaaaatgtaaattccagtgttcacttttgcagtggatttgtatattaattggggctgtcattcatgtgccattatatctcagcaaattcatctttaaatcatgttactagaggtaagtcttaattgttgcaggccacagtttcaataaccataagagagaatagaatagattaaaaacatgaatctaaccatgaggcatgtatgtagtaactactgtttttaatacgttttttgtttatgtgtctacagtttaatttactttgaagtaactataaaattattgcttttaaatgagttggtagattacttgaaatatttttagtgagtactttatcaataggttaagtttttcaaaaaaataaaaattactttaagaagagataagacaatcaaatgtgactacttcattttcagctgctaattgatttttaatctgtgaaagattttaattcattgaaaatggcttttattataataatttacaccaggtaattttctaagaatagaataatcaacacctgtatgcccatcacccatatttaactcatcttagtattgtttcatgttgctgaaatatttttaaggaaaacacacaaaacatatttgatctgtcatatatatatatgagatgtcataaatatgtatgcacacacatatatgtacacacatttcatacacatatatgtacacatatttacacatatatgtacacacatttcatacacatatatatgtatgaaactcctatgcatgcattcaattaattatcctccattcctctctaccaggagaaaattactactcttaagatgctatgtatttttcaaaatatgttttaatacttcactaaatatgagttacatatcacattattctgagacttattttttcagtcaatcatacattttaataaatatttaagtgatatacttttatataatttattcacagtaagtaatgtatagatgcttatgattaagttgcattgcatttgttttgttttctaatgtttaccaatataaagatattggaaaggcatcaccttgttcatatatccttgctgacagtgctggatgttgccatggaattgggtttcgtgatgttaattacaatagatctaagaatgcatagactattggatatgcttgacaattagatgcaaaatgagcaaataaacatataaatcagagaaacagagtggacatcagtggactgattcacagatatctatggcagaggctaactgatgacggggttttagaaatgaaatatataaacagtctacttacggtgctgcctcatgtatatagaatgaaatgtatagttctggaggacagagacataattcagtttggctttgtagggattctctgcctctttcacaattccaaaacctaagttatgtcacagactcagtcactcgaaggtcaggttttgcctccttaagaggaatctttaatagagtcacaggtattttgtgtatctttttgaagacttcctcagaggtatctgaggctatttaccagtatgactgttctatggtgaaagaaagatattcagacattttaggagttgctgaatactggttctgaaagtatacttatctctgcaatgctactgatccaccagtagaaatataagattattgaggtcagttcaggtgaggccacaaatacatcttctctttgattttgtttttttttacccacaattcttgaatatacagtgtagttgatatatttagtaataggacaatttttacattggggtaagagctattatggaggaaaatccaattggaagatcttgtcatgcccctttagaccaatggagattttaaagtgacagcaattctctattcctgtggtacttgtagtgattggtgtccccttgaaaggactgaaagttgcaggggtggtgattccaaacatccctacttacctcaccagattggacaatgcaaaagctagaaagggcacagaaaataagatgaatgatagaatattgttggaaaattaaacaggatctgatgcaaatttcaccaattctaaaggttggatctctatgaagatagataaacagagctcctggtacctgagtccagctatgacatagaaaattaattattttgtgttctaattagtgaagctccacttgaatttgtcagaatgtctttttaaagatattttgaaagacctaaataaatagatatcaatttttcttaaattggcctacccattcaatgaaattccaatcaaaattgcttgtttgaatgtatatttatatagaataaagttgattttaacagaagaaattgccaaaatatctaaagctgcctgaagattaaatagccctactagtattgagatatttcaaagggaagtaattaagatgtatgacactagcacatggatgagtaactgaactaaagcaacagaacagcaatagagaaatagacatatccatatgtggaaacgtgatctgcaaccaagaaggcactacagatcagtgagtgaaagatgaacttaatatgtagcagacatggcttatttatataaaaaaataagaatctgagtttattttttaagtgtgcaaagaatgagataagaatactttacacccatactcatacttatacatacaatatacctgatgcatctacatataaagaacataatcttaattattttaaaaggaaatatagggaaaaaatcctttcatcctagtgtaaagaaaagttaaataagatgaaacttgcaaaccatatactaaataataaattaattcaagtatattaaaattaagttttagtacatataacttataaaggtgaagtgtctatttcaatcagaacttatattcaataaatacaactaacaaagatattttaaaaatcatatataaggattcttacaaagccataagaagaaaaaacattaaagagcagatgctgactcagcaagatggcagaataggaatagctcaggtctgcagctcccagagagacgaacgcagaaggcaggtgatttctgcatttccaactgaggtacccagttcatctccctggtactggttagacagtgggtacagcccacggagggcaagcagatgcagggtggggcactgcctcacctgggaagtgcaaggggtcaggggcctccctcccctaaccaagggaagcccagagggaccttgctgtgagggatggtgctatctggcacagatactatgcttttctcatggtcattgaaacccacagaccaggagtttccctcaggtgcctacaccacaagggcactgggtttcaagcaaaaaactgggtggccgtttgggcagacattgagctagctgcaggagttgttgttttttttttttttttttcgtatcccagtggcacctgaaacaccagcaagagagaacccttcactccgatggaaaggggtctgaagccagggagccaagtggtcttgctcagcagatcccacccccacagagcccagcaacctaagatccactggcttgaaattctcactgccaccacaacagtctgaagtccacctgggatgctggagtttagttgagggaggggcgtctgccattattgaggtttgagtagggagttttcccctcacagtgtgaacaaagccgccaggaagttcagactggtggaggggggggccaccacagtgcctcaaagctgccgtagacagaccgcctctctagatacctcctctctgggcagggcatctctgaaagaaaggcagcagccccactcaggggcttatagataaaactcccatctccctgggacagagcacctgagggaaggggcggctgttggcacagcttgagcagacttaaacattcctgcttgccagctctgaagagagcagtggatcacccagtacagtgctcaagctctgctaagggacagactgcctcaagtgggtccagggctcccatatctcctgactgggagacaactcccagcagcggtcgacagacacctcatacaggagagctctggttggcctctggcaggtgcttctctgggatgaagttccagaggaaggagcaggcaacaatatttgcctttctgcagcctccactggtgatacccaggcaaacagggtccgcagtggacctccagcaaactccagcagacctgcagaagagggcctgactgttagaaggatatctaacagacagaaagcaatagcatcaacatcaacagaaaagacgaacacgtgaaaactccctccgaaggttaccaacagcaaagaccaaaggtagacaaatccacaaagatgaggaaaaatcagtgcaaaaaggctgaaaattttaaaaaccagaatgcctcttcttctccaaaggatgaaaatttctcaccagcaagggaacaaaactggatggagaatgagtttgacgaattgacaaaagtaggctttagaaggtgggtaataacaaactcctctgagcgaaaaaagcatgttctaacccaatgcaaggaagctaagaaccttgataaaatgttagaggaattgctaactagaataaccagtttagagaagaacataaatgacctgatggagctgaaagccacagcacaagaactttgtgaagcacacacaagtatcaatagctgaatagattaagtggaagaaaggatatcagagattgaagatcaacttagtgaaataaagcaagaagacaagattagagaaaaaagaatgaaaaggaacaaacaaagtctccaagaaatatgggactatgtgaaaagactaaacctacatttgattggtgtacctgaaagtgacagggagaatggaaccaaattggaaaacacacttcaggatatcatctaggagaacttccccacctagcaagtcaggccaacattcaaattcaggaaatacagagaacaccacaaagatactcctcgagaaaagcaaccccaaggcacataatcgtcatgttcaccaaggctgaaatgaaggaaaaaatgttaagggcagccagagagaaaggttgggttatctacaaagggagcccatcagactaacagcggatctttctgcagaaaacccacaagccagaagacagtgtggaccaatattcacattcttaaagaaaagaattttcaacccagaatttcatatccagccaaactgagattcacaagtgaaggagaaataaaatccattacagccaagaaaatgctgggggattttgtcaccaccaagcctgccttacaacggctcctgaaggaggcattaaacatgaaaggaaaaatgggtaccagcctctgccaaaacaagccaaaatgtaaagaccattgacactacgaagaaactgcatcaactaatgggcaaaataaccagctagcatcataatgacaggatcaaattaaacacataacaaaattaactttaaatgtaaatgggctaaatgccccagttaaaaggcacagactggcaaattgtataaagagtcaagaaccatcagtgtgctgtattcaggagatgcatctcgtatgcaaagacacatataagctcaaaataaagggatggaagaatatttaccaacaaatggaaatcaaaaataaaagaaatcaggtgttacaatcctagtctctgacaaaacagacattaaccaacaaaaatcaaaaagacaaagaagggcattacataacggtaaagggatcaaggcaacaagaagagctaactatcccaaatatatatgcatacaatacaggagcacccagattaataaagcaagtacttagagatctacaaagagacttagactccaacacaataatagtgagagactttaacaccccactgtcaatattagacagatcgatgagacagaaaattaacaaggacattcaggacttgaacgcaactctggaccaagtggacctaatagacatctacagaactctcgaccccaaatcaacagaataaacattcttcttagcaccacatagcacttattctaaaatcgaccacataattgaaagtaaaacactcctcagcaaatgcaaaagaatggaaatcataacagtctctcagaccacagtgcaacaaactagaactcaggattaagaaactcactcaaaacgacacaactacatggaaactgaatgacctcctcctgaatgactactgggtaaataacaaaatcaggcaagagaaagaaataaagggtattcaaataggaagagagaaagtcaggttatctctgtttgcaaatgacaggattgtatatttagaaaacctcatcgtctcagcccaaaaactccttaagctgatgagcaacttcagcaaaatctcaggatactaaatccatgtgcaaaagtcacaagcattcctattataatagacattaatagacaaacattaatagacagagaaccaaatcatgagtaaactctcattcataattgctaaaaagagaataaaatacctaggaatacaacttacaagtgattgatgaacctcttcaaggggaactacaaatctctgctcaaggaaataagaaaggacacaaaaaaatgaaaaaaattccacgctcatggataggaagaatcaatattgtgaaaatggccacaccgcccaaagtaatttacagattcagtgctattcccatcaagctaccattgactctcttcacattattagaaaaaaaaactactttaaatttcgtatggaaccaaaaaagagcccatatacccaagacaatcctaagcaaaggatcaaagctggaggcacaatgctacctgacttcaaactatactataaggatacagtaaccaaaacagcatggtgctggtaccgaaacagatatatagaccaatggaacagaacagaagcctcagaaataacatcacacatctacaaccatctgatctttgacaaagctgacaaaaacaagcaatggggaaaggattccctatttaataaatagtgttgggaaaactggttagccatatgcagaactctgaaaatggaccccttccttacacattatacaaaaattaactcaagatggattaaagattaaaacgtaagatctaaactcataaaaactctagaagaaaacctaggcaatatcattcaggacataggcaggggcaaagacttcatgactaaaacaccaaaagcaatggcaacaaaagccaaaattggcaaatgggatcgaattaaactaaagagcttctgcacagcaaaagaaactatcatcagagtgagcaggcaacctgcagaatgggagaaaattttgcaatatatccatctgggaaatggctaatatacagaatccacaaggaacttaaacaaatttacaagaaaaaaacaaacaatcccatcaaaaagtgggcaaaggatatgaacacacacttttcaaaagaagacatttatgcaggcaacaaatatatgaaaaaaagctcatcatcactggtcattagagaaatacaaatcaaaaccacaatgagatgccatctcatgccagttagaatggcgatcattaaaaagtcaggaaacaacagatgctagagagatgcggagaaaatgtggagaaataggaatgcttttacactgttggtgggagtgtaaattagttcaaccattgtggaagacagtgtggtgattcctcaaggatctagaactagaaataccatttgagccagtaatataattactgggcatatacccaaaggattataaatcattctactataaagacacatgcacacgcatgtttattgcagcactattaacaatagctaagacttggaaccaaccaaaatgcccatcaatgttatactggaaaaaaaaaatgtgacacatatacaccatgaaatactatgagctataaaaaagaatgagttcctgttctttgcagggacatggatgaagctggaaaccatcattctttgcaaactaacacaagaacagaaaaccaaccactgcatgttctctcttataagtgggagttgcccaatgagaacacatggacacagggaggggaacatcacatactggggcctgtcaggggttggggggcaaggggagggatagcattaggagaaatacctatgtagttgagtatatatatatatatatatataggcagatgccataattaggcatttctaaaaaggcaaaattaatcatctcaaaatgtacataaaattgttaaacttcatattattataagaatgcagggagactacaataagatataactttacacacagcctaaaatggaacattctgaaaatgccaataaaaacatttattccctgctaataatacaaaaattgtatttttcaaaagaaatgagaaaaatataaatgtgatttagcaaatgtgaccatgtttacccaatggttcaacaattctacttctatgtatgtaacctcggacatactagtacttgtgtatttagagaaatatttgaaaactttaatatcattgtaggtaagacaaaagaagcaaatagtccaaatatctataaccagtagaatgataaatgttggtatatatttaatattaaatattgtataaaagttaaaaatgagcaacagatacatgcatcaacaggaattacaaaatattatgttcaacaacaatttcgggagactctacacaatattgttttgcttataataacatggaaactaaggagcattttgctcaggcacacatacaaatagcactataaactaacagtaagattggtaaataaaaatttgagatttttgacataagtgattggatgggacaaatgaggatgtgctggtacaagcacaaatgtatcagtggtgatcagctgccttagttacataatgagcacatgtgtgctcactttcttgttgaattacacacatcaaataattaatttaataaaaagtagcttctcacctgtttgtcagatccacacatgttccattatttttgcaaggttcagaggaacattcattaatttcaatttcacacagagatccagaaaacccaggtctgcaaatacaccttttaaacaaaaaatttagtaactccattagtatatatgtataaaatcaatgcttcaactaattgtagcatggcaagtttttaataattataattgttgcttaattcaccaattaaaattctatacctgtatacatctagacacataaacatgtatctagatactttttaagttttctgtacctgaaattgttgaccatatcttcacagtcaccataatcctggcaggaaaggaagaggcagtctttcacatcaatttcacagtttttaccttcaaattctgcaaagagtatgagatgagtatggatgagcaatccttgttatagagtaaaaaaatcagaatcagtggtagtctaaagaatacactcataatggaggttaaaaaaggaaaaagaaaataattactctcaagcttctcataaaactccatttcacataatgtgtgcataaaaacatgccagtttctagattaatgagtttaaatgaaatattcaagggaggaatactccactaaatcccctgagaaggtagagatgttgctaatgttgctgttgttttaaggtatttaaatgtttgaacaagaagaattgaaatgatctggaaagcaaatgaattaatgtgatgaccaatcttaaagtaaaattgagcttcaatgatcaaatttattcaaggcagttagcagatgaagcaaattatttaattgctttttatatccaagtgattcaaagaaaacaaattattttgattcacagctacataatcagtcatccatttaaacacatgccagttatattaaaaaaaatgaacatgaaagaaaattatacaggctgataaacaagacagttgcaattatttcaacacatttgtgtcagaaaaaacctgcatgatatcactttttaaaatacaatgaaatatattaatatttataataaacagttaaacaattctatggttatatattaactaagtataacaaaatatatgtgtaaaaccatttttcttgttaatattttttctgtactagttcaaacatgtaagaaacaagatttccctttattttgctttttcagtgatattaccaagcactaaataagtgcagccacattacacaatattctaaatgtcagtatgcaatcaggctaatttagtttgaggaacaaagagtcattcaggttactttaagaaaactgtattcattgtttgcatacacatagactggaattggaactaagaagcatttaaagggaagcatagtctagctacccaggaatagctgtcttccttttacagtacatgtcctttatccttctcatatcactttttcttctctttctatcacaaatatctcagcatgttcagtttcaaatcacttgtaatgttggcatgcgagtgatatagcacagctttcttggtctctatgtctatattatgacatttcagcttcagcacctactgttcaatgaaaaattccctcggtattttctcactcagattcccacgatagaacacggaattgactgacctatttcatcttttcatatcataccatgccacagtcaatgccattctctgtggtgtctaccattggatcaaactgcaaacctgcctcccgttgcaatttaacagggagcttggtgttacaccttataaaatctggctgcctcttcggtagtatataatatggaaaactaaaagttacttaatccaaaagaaaacagaaaaagaaacaaagtacagatacaacaaatagaaaacaaatagctagaaggtgtatttacagccacacatatcaaaagttatattaaatatgatttttaaaaacgccaatttaaaggtagaggcagactaaataacagaagaaactacaagatatctaaaagaaatttatttaaaacataacaacaatgataggttaacatttaaaagatggaatgatcacacactatgaaacactaattgtaagtaagctgccatacttatggggctagcagaccaggtagtcttcaggacaagcaatatttttaatttgccttatttttcttactcaattctcagagcctgcaaatgaatctctgaagttacatttttgtaattcgttcatacgctaggtgttgtatcctcagctttaggaacaaaattaaaatgaattacttccaagttattatggctctcctcattttaggtgagcaagttgtaattgttccaacatgcttcatcattcttcaatcgccattgctgttttctatatttaggttgtaaatgccatagtacagatataaacaacttagattctattttcaaaagatgtttaattctttaagtatttgattgaggttagatttttcacaagttaaaaattgagaaagttgagtgtatttcaccatttctactttaagtctggttagttttctctgggaggcagggcattttgacactaaaatgattcttagaaatgttcttttgaggcagtggaactcaggggcactgactggctataaagaagcaccagtgagcctccatgatttcagctgtgctgatgaatcagaacactcagggcccaggaccttgggtagctcacaggataaccttgtttcctgtgattttgtcatatttattaagtttgacatttctgagatggagttttgttaccagctagcaacatatgtcaatgggttgaggaaatgagattgccgaaatgcagcagacattgggagaaaacataacatgtggattgcattcaatataaagcaaagctttgctgagatagcctatgttttgggaattttaagagcgaagtatgcatacagtcacgtgctgcataacaacattttggtcaatgacagaccacatttctaataacaatgatctataaatattataatggacctataaatgcagtaggctatctcatctaggtttgtgttagggcactctatgttgttcacacaacaaaattgcctagtgatatatttcttaggatatatccccatttttaagcaatacatgactgtatacttaatcccaaactacatattctataatccttaatgttagaagttgatattcatttctgtgaaaggtacttgttttgaatatatgaagttacaggtaagaaactgcccaaacagaaagtttgttattactaattttatgctgttcccctgttctttattcctactcagaactattcggttggccgtactttgttaactgcagggaggatctttacatgcataaaagtgaagcttcttaaatggatactgtcttgatccttttcttacactgtctcgtctgtgtatggctataacaaatacacacgaatggtcagtaaatgatatttttatacttctgcactcgttcctccaaaatacacaaaattgatttttaaaacctactgctcaaatgtaagatctgcatcagtctggattgtaggtattattttttaaaatcacttagtattttctcttttctaacaaattcagcctttttgcactttattgctctagaaggtaatgtatggaacagagtacaataatgaaattttcataaaaatcattttacatagcattttatcattcaggactatattttaacaatctccacttcatatttggtattagttggaataatttgaaatgaatgtaaatagggaaaaaaactagtgtataccatagcatgaattcacacaaggtagttaaaaatcatatatttttaaataaaaactcaaacacttaaaaatgtttttctttcaaaagtattaaatgtattatttctatttattcttaattaaataatctaatttctctggatttaaaagcttgataaaaagaaaacaaaaaaacacctcagaagtttttcttagcaagtcagattttttaaaaaaatattattttatttaaaaatatttgtattcaaatattaacattttctaaaataattaaccaatataagaaattctttaaatttaactttaaaaactatgaaatatgaatatacagaattaatatttccaatagtctctaataagatttttaacatctatttttaaagtgaacttaaaaaaaagaagagctaatattttagaaagtaataaatatttaacatgttttatgtttaattatgtatgtattttctttaaggaattttctaaattcaaatttctacagctattaaccttaacaggtatgtgctacaacatgggtacatgtttttaattgtcaacaggagtaatttctaatttatacaaactattttgtcaaatgacacatttatttggtgtttgtacttgtataccttaggtaatgtggaattaacataatgatagtatatatactggagtaatagacacatttaaatgcaactacttgtctcccatgatactgcaattccatcaagcgtaggatcccaattgtaaatcaatagcacatgtaaatgatctgattctgctctcactgcagctccttgtgaggcatctttgccacattttaatcctgtcatttaaagaaacttctgttcctttcaccttgaagacatacaaagtagctattttagaaactaagctctttacattaaattaagaagtatttgatagggtaattttttgcctataaactgagaaagtggagtaattcaaagtagaaagataaagaaccattcataaaaagaacattagaaaagaaattatttaattcttgacatgtatttctaggctagacacacacatggtaacataataattctactctatgctacaaacacacacattctcatgcattttatttgaagtcgtctttaccttcttaatcttcatgtggttttgtggtatttattattattattttttattattagagacaaggtcctgctctgttgcctaagctgaaatgcagtggtgtgatcatagctcactgtaaccttaaactcctttgctctagtgatccctcctgctttagcctcctgaacagttaggactgcaggcatgaaccaccacgcactgctaattttttttaaatttttttgtagagatattatgttgaccaagctggtctggagctattggcctcaagcaatcctcctgccttagtctcccaaagtgctgtgattacaagtgtgagctattgtgcctggccctcaagtgatatattttatatttgatttctaccagcttgaagttgaaaccagtttattcaacctttcccacttaattaactctttgccttcactatatgttttagccattactctaatggccataaacatatgaataaaaacatgaacttagttaagaagtgagatatattggtaacccagctgagagggataccagacagttcacaaaattgaagaaagaactgtaagttctgccaggattccttccccaaacacttctatcctactatatacagatcatctccacatgaagagaacatggtagttgactgtactgattgaaaacatctggcagaaagagaaggcctcttctctcagcatcaactctaaagaaggggtctgaatgccaatattccactcacatgcatgcccagacataggtaaatcatagttaccatggggatggaatttactatgtgtcttagcttgggttgttccaaaaataaaataaaaaaaaaagtctgagataatgattttctcacaagtagtttatttgagaggtgatcccagatcccaggaattattgcaagggagtggaaaataaagcagggaagagagtggtttaatgagcacataattgtgggcaactgaggcttcatatgctggagactctcttataaatcatgcgaaacataactaaaagttgtcaacagaaatgagaaagcagtgctatgtatccacaacttgtcatcccttgtgcatatttctggcataaatgtggaagtgatgcaggatttttctcagcccgtttggcagactcgtgggagaggtgccccatctacttggtctattatgctcaagcttttgggggagagagcacatatgccagcaagtgcaggacctggctggccactccagatgccgaaacaggagcaagctccacacgggcccccagcctgaccaggtgtgttgccttggcgggaacatggtggaacccaggtgagggtgcctgtgacactgaagccccagaggggattttacagtgctcctttagttccaccattcacagacagcagtgtgttagcagctcagttggtgccttgcctcgtcacatggggtggctgccctttgccagggagggcaaagggctggttggacggcctttctgggtacccacactcagtgggtcccaagctcttgtccagtgtccaagaagaatgaggtcatgcagatgattgaagggtggtgaaggtggagaattttattgagtgatgaaaacaagtctcagaggagaggggagctggagagggtacaggaaggacaggtcgtcttcctgtacaacctgaagtcaggctgtctcttcccgaaagtcaggccatctcatcttctactgactgagtctggggtttctatagacacaggatggggagtgcttgctgattggtttgtgagtgtgcaaaagttaaagtgaagacaagactcaaaggtgggtacaacagtgtggaaaaccaattaggaaagggcaggtatatgtaaaataggtgaagggtggggatcaatcagaggaaagcgcaccaaacaggaagacaagttctcaatcctgtctgagaatttaacttatagcttggctttcaagctttaaactggcattggcttggaggtgatgtttcaccgggtacccacccttatctgtctaggcatttggctgcctcctgtcactatcaaaagcttttaccgcattgtactttaatggttaattaactggtatgtctctcccttaaactttcaattccttgagggcatatcttcaccatgtttaatttttccagaacctatctcaagacttgacacatcataggaaatcagtatgtttgttgaatcagttaatatttttaaaatttctagaacactaacaacaagcagttacaagatagatatgtatttgtgtatggagtacagtttatagaggcaaaaaaagttggttacaataaaataaatttctaggtgtgtaaattcattacatactaaataatcaaagctaacactattgaggtgtcaaaaataaaacccatttgtttatagaaatctcataaaatgtgccttcctatgtgttatttttctatttattaaagctaatttcttacagatattgtgcctattttcttacagatattgtgccaaactaataagattttatataaaataaccatattgaattattactgtcacatgctcttttgcctcctcattttcctgtagaaaatgttcattattcatagagacccaattaatcaccgcagttttagtcagaagacagaagctttgccctttatttatctcacaaagcaggatcacaatagttctggtgcttaactataccgataattttttaagtagcttactttgctaaaaggattagattatttttactatatatatattttttactatgtatatatttttactatatatttcaatcacactaaccaaaatagcttacctgctaagcatgcagtctgacgtaaacccaaaagtatcagttattctacttgctggtccttcagagtgaatttgaatgtcatttctaatatagttttctaacatacagtcgcattgttactctggctgaaattttacctatactcatatttatctagtgagagaccctacagactgactaaaaactgtgaaaacaagttcagaaatacatacgctgaatccttagcctaaagccttaaatttctactcttacgacctgtcctattttagtcaattgacaaacaccaacaacttacaaagagatccagtggagcttccaaatcatatctgtagatgttaagtcttggaattctttgtagttctaaatgttgatacttgtgagaattaaatttgataaaatgttttcttttaaaaacaatatactggctttgacatagaacctattttaaataaagctattaaagtaacccagtcaaagcttctaaaatgttgcatagtcaacttttgaattttctgaggtggtttttaaaagcaatgttacagcctttaatttttcatctgctacagaacttaaaactactaaagacacgttattacagtattcagatctgatttacagaaacatactccacaattaggtttagaaaaacatagatgcaaattagttaaaaaatgatgtgcatttcaagtatctctttgtactgaatcacaatcacaaaggaataaacacataattcactgtgtttacctgccactctagccaaagctctgatttggcttacgtacaataataaaatactaaggggaaataagattacatttatttaataatagtgaaatctaaattctccccatgacatctttgtcaatgttcaatgggacagcagatatcattactagttcaatatatgactagagggttttaaaatgtttccaaactttctttccctaaacccgtagcaggaaagaaatatcactatattttataaatttattaaatgcacttataaatagcaaaagaatttttaaaatattaaggtttgaaaacaatgcccactttgcagaaaattatctctggtgaaaacaaaggaagtttgtctaaagtgaataaatatactatggcctcctcaataaatatttatattctgagattttttttctattttacttagcctacttatactctcagaaataataatatgtttcttacattcttagacatgtaagtaggctaagtaaaatattctacgtagtagaatgtttagaattgttctagtaaataaattagcttcactgatattgaataattttcaacaagtttcactctcagtgcttgctaaaaggaaaactatttacttgtttgaattatgttcttcataattactaaatttttctgggcatcaaatgctccccttgtattttttcgtttttttcttctctatcttgtttttcctgtctcattcttgaaaatattctctcatatgctctataaagcccatgctatttttgcaaaatcaattactgatggctttctagcttttagttttaatccttcagaaggcccagaagtttctgtcacgtatacaggttcaagaacttgcttcaatatccttaaaaaacattaacatcttaaggaagttttaatgcaaaacaaatggaaatagctttgaataagatgtctgtttaactaatgtcatctaagctgacttttttgaacagaagagtaaataagtgatatccttattattaagagactcccttaagggccagtgagaggcaggaaaacatgaaaccacagtgagtattagaaaataaattgcagttttgggcctccaaacacaatgtgttttttatattatgcttatgacacatctagttattctgaaaaccggccatgtgttttggagcagaagcatttccactgaagatggtaattgcttatgagtagccattgatacatgaacagtgaacatgtacctaaaccactgtgcattaataagactttcttcgcttgcatatgaagagaccccaatcaagaaagtttaatgatataagcagagttattggctgatatgacccagaaagccagaaatatcctggcttcagatacggctggatccaggagctccaatagtattttttgaactgctcattctttcttgcataggatttctctcttgagacaaagtagccaccaaagttatgtgattgtaactaaacaatctaagtagaaagaagtaatattttgatagctccagaagaaaatgtacaatagggcatttcattacccccaattatacctatgcccatctctaactaactgctattgtcatgaacactacatgaacaggattgttcagaaaagagaaactgttattaaaggagagacaacttctgaaagaaaaaaaaagggccaaaaagctataaagcttcactcttttccctcttcccaatggttaattcttagattaactcctttggtgcatttctctaatacatttttataactggatttgaagttagatagtcccctacccacaatgtacataggatttttccaacccattttaggaggccatcatcccataggcacaataaatacacaaactaattaagtaattatttaaaaacaataaaatccatattagctcttaccttctctacaaatacaatgctgatttgcgtctaccaaagctaagcatgttgagttgtttctgcaagggttatgaagtaggtcacaaaggttatagcgttggtggcaaaattgtccagtataaaggggtgggcacagacatacaaattgtccagggatggtagattcatgacaaagacctccattcatgcatggatcagagtcgcattcatttatttcttcactacagttctgtccagtccatccagatgtacactcacatctgaaataaaatattaaaatttttagaagtgtgaactctttttcaagtttattttttgtatttttaattactcccttgaactaatagtatgtggtgcttttaaatttataacaggactaataaataatacatagttttaaaatattgtttgcctaatttcctgtgacagtataatatatattaccataaaacttaccaccttggctgaaataagattttaaaagcattaacaaatttctaacatagttaggcctctgagacatgtcagagaacaactattgacctaaatcaccaattgagcaaaattttcctatgaattatttaatataagttttacagatgagatcactatttataagccttaaatgctatttaattcagcgtccttagcaatatgtgaaattcttgtcatcaccagagtatataacaaggtgttactttatgttaagcatctgtttttggctttgtgtgtgtgttgaatcacttgaaatgcatttttaaaaatatattttcttttttaaaaattttagattcagggcttacatgtgcaggtttgtaacacagatacattgcataatgctgtagtttgggcttttgttgaacccattgcccaaatagtgaacacagaacccaataaatagattttcaacccctacctttctccttccctgctcacttttggagttctcagcctctattgtttccatctttatgtccatgtatacccattgtttagcttccacttgcaagtgagaaaatatgatattagattttctgtttctgcattaattcactaaggataatagcctctagctgcatccatattgctgcaaaggacatgatttaattcttttcatggttttgtaggattccacagtgtatatgcatcacatattctttatccagtccaccgttgatagacagctacgttggttccatgattttgctcttgtgaatagcactatgataaacatatgagtgaagttgtctttttggtagaatgacttctttttatttgggtggatgctcattagtgggatttttgggtcaaatggtagttctatttttagttctttgagaaatctccataatgctttctgtgggctgaactaaattcgtattaatatttgaataatgtgcgataattgaagggaaagcaaacaaataaaaaataaagcatttggaagttatctgtgtatcacaggcttctagctcagtctagtcctccatccagtatctgtcattatcttcaaataccactttggctagtcatcatccatgaaacgaggctagtctgccgtgaagagaaaaattctagcagacaggagggggaaagtgttttacacacaaaattctagcagacaggagggggaaagggttttacacacaaagtgtccatttgagggaaatggaaaggttatagtgaagcctgcagatagagagtaaatgcaaatagagagatagagaggtagtccatcagctgggtaagtggaaaacaatcacaaactgtaggtgtgttcaaggagagaacttgtgtcaatttgtgggcaaggtagatttccaaatcttgagcaactttactattatgcaagttatgaatcatgaaacaagcacaggaaatattagaacaattattttcaaaaagtgtatttactgatagattagatttttaagataacttgaaaaaagtcatagtgctgaaataatgtaacttactttgtgatacagaatatcttactaaaaggaggggagcaaagaggaaggaaagaaggaagaaacaaagaaaagagtcacctaatttgcagtttcaaagccccagatatatcaaggccctttataattataaatacataggataccaatatattggaggagataattgaacaaatgacttgcaacaacatctataattgaattctaaatcgatatagttaccattaaaataaaaaccaaaatgaataattggcaaaatggtattagacataattgactaataaagtgtttactagttcaataagtttaaatccaatgcattgtaagccagtggatttcacagctgtctaaatttttttttaattggctgtgggtagaaagtaattgctatcatgataattgcacatttctttgtgaagcatgctagcacaagacaaaatttatgactgaaacaattcataccttcacaatataaaaaatatatacctaagggtatgttatttacttaatattttattttcttctcaaaatcaaaatgctctaattattttggtgactttccatcctagtttgcctggagagacttggttcagtttgttgttctgatataattttcagggcatccttttacttataaaagtttctaaggtgctttttttaaaaatctttatctcctatatcccattactgaaattgagtatctaaaaaacaaaacaaaacaaacaactatacacttacctatttactaatcctacaaattatttcactttgctctaaaatttgcttgccatacactttaggaactcatcatatatactatcttgtgttaaaatcatttgcatggtttgcctccaccattaaacttctggttcctgaatgtctaagaatgatctgaatctccacattatcatgtcaacacaataaatgttgacaatactataagaattgatataaggtcctcagtgttgaaacagatcaacttatctgcactctttcatttaggaagttgaggatcagagagtttaatgaaattggtaatctcagagaattgttgtaaagattacatgacatgatgaataaaaagtatatatagtgcctggaatctgcattgcctggccacctacactgtttactagatgctgtcacagaagttttaagaatacattttctgacctatgagcctaaatacaatgtgtatctcagcaatgaatatttctttagcttttagtagtacttctttttaatgtttgatcatcacatcacattttaaaattgtcaaatatattatccaatttgatactttcaataaagctttgaaatatgtagaagagatattctttttctcactttacagatgagataggtggaagttcaaaggataacagtgatgtatcctaagtcatgtggttaagcaaatggaacttagaatccagatctcctcctctcaagttcctgtttttcttttcttttctttttttaaacatgctttaaatctagtatcatttctttaaacattttgtgaaataatgttaaaattgggtattacccagtcttaagagaacttcagtgtatttattttgcttgaaataacatcactgtaaatataactattcagtcatataatgggactcagttaatatactatggcaattttaagaggagaaaagctagagaattaatattttctaaaatcatggttacacaggtcctgagggtattgcacaagtatttatgtttttctctttattgtattctgagtacataatttcaacttggttaatttaaaagagtttcctaagaaaaaccgacaattcttgcctatttggcatatgtgctgaaggtttgttttatcttctcacataacaggtggcctaagacctcatgtggtgtcattccaaggatccaatcctcaggaaagaatgtggctgtatgtcaagaggactgataatgccaaggctgagttctatggagataacatggatgttttatagaaaataaagttccgaggaacaaagtcactactagtgactaacaatcatacctacaggtttacatatttgaatctgcttccgcacatgtcagagaagctagtgtttgatgggtgggaaaaggaaaacatatttgatgtgagggcttcaatcagattctaagtttgctccatgaaataatttcaggatttagtggaaccaggcagatattttcaaactcacagctagaagcagagtctttatggattaaaaaaaaaatgcaaagcacataccgtgtgactttttgagtgtacaatttctggtagtaaacacttgaaaacaagtaagtgcgtgcctaaagataggttaatacattctaatttgctcttttccctagtgtgagaaaatctaaattcattggtgtaaaatacattgaacacttctaaggacaacttttcaaatcttaaatgctgatttaaagtactaaagctgataatagaaaataaagtagttatcatcgttaaaaagtggaagaaatactactcattaaggtgcgttggctcacgcctgtaatcccagcactttgggagtccgaggcgggtggatcacgaggtcaggaaatcaagaccatcctggtcaatatggtgaaaccctgtctctactaaaaatacaaaaattacccaggcgtggcagcacgcgcctgtagccccagctacgcgggaggctgaagcaggagaattgcttgaacctgggtggcggaggctgcagtgagcagagatcgtgccactgcattccagcctgggtgacagagcgagacttagtctcaaaaaaaaaaaaaacaaaattcactagcttcaaaaatcttaataaatgtcaatttctaatgactaagcattctatatgtttaccttaccataaacatttatttgtaatgacaaaggatcgttcagcaatatgtatctgtgtttgaatatattttgtatattaaggcatataggcttttttggctctaaatttattaatacaaacctaagtgtatatgcagtttaaaagaatattttcttataaaaatcagttcacttctcttagaagcaaacagtaaaatgttgtttatcagctactgggaggtggaggagatcagtggagatgttggtcacaggatacagttagatggaaggaaaaagttcaacaaaccaattgtacatgatcatgactatcattaataacaagatattgtgcacttaaaattttttaagagagattttaagtgctttcttcatgaaaaagataactatgtgaagtaatgcatatgttaattagcttgatttacccatttcaaaatgtatgcatatatcaaaacattatgttatacaacataaatatacacaatttttatgtgttaattttaaaaattagttcattatttcctgcaatcattacatatttgaaacacaaaatttcaaccaaaactgctaggtgaaaaagaaataatgaccgttaataataaaatagtattgttatctttttagtgtcctacaaattggggacataggaaagggaagaattttttttaatgagctaccgaattaaataattcattcattattttattgttttgtctattaacctatttacacccttaggtgtacataccatcaacaaaattatattcataccgaattataacatgaacattactaaactcttaacctctgcaatcttcttcttggaaataaatgtggaaaatcacttagctcatttagacggaaaaatctattgtaaaaaatatttgtaaacattaaaaatagaatacaaaattaaggaccactttgaataacagcctgaaaatgttagtatgtaaaaacatatgagaagattgatatgggtaaaatgaaagtgaggaggtagcctaaaaacagtaatagcaaggcaaagttgctgaggattgtgaaaactactgcaacaacaagaaaagtaaaattaaggaattttgactttacccttgaagatatttaagggttttttgtttgtttgttcgtttgtttgtttctaagcctgggagtaacattgattgttatccagtagatggattaacatagggacagcttggaagcatgaagatcatttaggaagctattgtttcattactgataagagattatgagtactacacaaagggagtaataaagtacatcaaatttgagatatatttctgatgtaggacagagaagatttggataatggttagtaagcagatgaggcagagtgaggagtgaggactcagtgggcttcacattcactattggaaagataatgatgccatcaggtaggagacagatgacaacgatggaaatagaagaaaataagatggcactgatgcttaatatgtaacaacttaaatcaaataaattgcatgatttcagatgctgtcctgcatgtattgaaaattcaaatatggagctctagaaaaaccaaggcatgcaataaaaattcaagtaccattctaacaaataatactaggaataaataaatttaaatttggccttctctgctgaaatataaatttatgaaacatatagaatcctcttcattatgatattctgcagtattttatagaatcttaggtacatatgtagattctttgaaaagaaataggcaggaaagagttctactaggcagattagagtaagcatgtggtcggatagacagtaagcaagatagatagtaagcaaacctttctttctttaatttttatttatttattttgagatggagtctcactctgtcgcccaggctggagtgcagtggcgcgttctcggctcactgcaacttctgctgcccgggttcaagcgattctcctgcctcagcctctcaagtagctgggattacagccctgccatcgcacccggctattttttgtatttttagtagaaacagggtttcaccatgttggtcaggctgggcaaaccttccttttttatgtttttctttttttcttttttttttttttgtgaggctgaagtttatggagtatgtattctaaatgaactcaagaatttctgttttaatattaatagaaaaaggatttcttctatttaggccatcaagcatcatttcatatattttttcaaaaaaataaattcagacatataatttatttatacacataatttataagtcaattatttcaattggaagaattataatctatatttttcatacattttgatgtaaatgaactgtatggataattccttgatataattctcttcaaattatctgtttccaatattctatatgatttaatctcctgtgccatgtaaaaagacaactggtcaataatctttttcagagttatttaattcaagctgctttgtaggtcagtatttctaaaaaacaattcaaggctttttcaagattcagaatattcctcgtttcatagaagaaagctaaaatgccagacaagcagaggcagataatgcattgggtcacgcctccagtatattcatatttaaaatctgaggtaaatctgatggaactcatgctgtattttgaagaatacccaaagttaaatacatttgaatctgggactagaacagcaaagccaaacatatgccgtacagtgagatgccatatagtgagattagtttcattttttttttttgtcattgtggtcataatacagaaaccatgagaatggggtattttaccacttggatgatcagaatttagatttttttgtaagcctacaacaagccctaagacatttatgttgaaagatgaatctttcaacaacatcttgaataaagctgaaagacaacacttgctcaaaaaggctgactacataagatagttgaagctactattctgtaagtttacctgttgagtcaagaaaatgactagtgttataaacatgagtaacatgaacaattatgtgatttagctttgaacataaacctagtttaagttactgtctttaatttcttctattttatttttccttaatggtgtgtgtgtgtaagcggaaaattgatgatgaatcagtttctgagcaagtaagtattacttctggctcctgtttttttccaaaaaggatctttgtagcaagtccaagtaagtctgcttttaaatataatgctttatatattcagaagaattcatagttgcatctttttcaatgcttaaaaatgtatgtaagtatatgtctgcatgtgtatatgcaagtataatatccatacctatacccacacattgtattcaaattatacttgaaaatgcatatataatctttcaaatacagtttaaaatgtataaagatcctatatacctacacatatatttttattctttcaggtacaatttgagtaggaggcagaattttaaatacaaaagcaggatacagagtgttacataagcaaagtactaagatatagaacttaaacaaatttataaacattttacaaaataattcataaatcttcagcatgtcaggtgtttcatatggagaaacattttaaactcccagtttaataagcattacacttgaagtctcagaagaaaatcaactgagctagcaaaagccaaaggatttttatgcatatggaaatattacaagcaatgaggaaacaaaatagtctttgtttttttgttaggactggcattataataaatgctatatctgtttcatactccttaggggtaacatgtattaaaactatatactctaattactaatcacacatacttagttcagactatatgcatataacaccattaattctgaaatgtaacataaattcagttagccgatgtaaaaatatgcaaaaataaacctattgaaaatgaacactaacatatctttccacatacagaattattaacccattattttattaaaatttaaaattatagaacatgtccttccttaaaaatttaaataacactcaaattgtcttattttttaataaaacagatggaactatagaaataaataaggatagcagagataagagagaaatggaaagaaggaaagagaagcaaaataattattttttaaaatgtcactaaagggtcacctgtctcacaggggttatgtggaaagtttattatctatgatcctgcttcttgatgagactcttcctggtacttagtcaagccggagtccaagtgatattcaaaaagcctttaaaattcactaagccagaacttcaaactcatggaaagaaaggataaattcaaagtagaagagatttatctttgtaaagtatgaagtaaagtcaccagtgcctgtgtctctctgaatctaactcaatgtgacaaagaaaattagaaacagaaaataaaacttcatcctcaataaaacagttatcaataatcccaagccaaagcacaaaagaattagatgacaaatattgtgaaaggaccaagataagagcagatatgaagagcaggtaggtgcctgctgctggagtaagccagcagaaagggcacaaaaatagttctcagagtaggaaactgatgaaaaattttaaaaaacaagaacaaaaattaaaaaaaaaaacttgcttgaaatataaggctgggccaattttccatcaaagagtgtttggggtagaagaaaagacactggcagaatttggaatttcagagacatgcaacattgagggcccatgaaggaaaatcagcagtcctgttgctactgttattcactggggtgacgaaaaataaatccattctccctctctcccacctctgtcacacacatacacatgcatatgcatatatgtgttcacacacaagcaattgaaaaaccaatattttcctctgagccagggaagattctgcttgtttctcattgacaaggacattgtgttgactcacacacattcccacaaatactaaggttttgaagaactaaatttaaagataagaaaaacttagaaaggaattagtgcaaaatagactgttgtgtttgtgtgcaaatgtaaatgtaaaaataaatgagtatgaaaagagccagacatcttatataagtattattttaccaagcatattaaaattacagctagataattttaagacaagtataaatattactatacaacaaaatatttaaggagatataaaagactcaggatatatattagttaataaaatgagaggaatcccaatggcagaattccagaaaaaatagaggataaattaaatgccagtattcactggcccttttgtttcctctccatgatagcagtgcaaatgcactgcttctagtctgccatcttgacccaacatccctttaaatgtattttctaactcattccctagcttctagggtgtcctggcatcttagctatggatatcccagtacctgcaggtcacaaggtaacagagactatgacagtcatctgggtctcctggaacggaggacacagagcagtggagatggaccccaagctctaggtggagtaagagacctactttgaattctttatccagcatcccaacatttcattttgtttaggattcaagatccagtattactatgctgatttttttctcatctggagaaacacttcttactcttgtttactttttttggggtgggacttttcttgaggatgtgcctatgatgtatgttgagtaaggccatttggctttgcttctgggtatgtttagtggctgtattagtctgttttcacgctgctgataaagacatactagacacgggggaaaaaaaggtttcattggacttacagctccacatggctaaagaggcctcagaatcatgatgggaggcgaaaggtatgtcttacatggtggtggcaagagaaaaataaggaagaagcaaaaggaaaaacccctgacaaacccatcagatcccatgagacttaatgactatcacgagaatagcacaggaaagacctgcctccatgattcaattacctccccctgggtcccttccataacatgtgggaattctgggatatacaattcaagttgagatttggatggggatatagtcaaaccatatcatttcacccatggcccttccaaatctcatgtcctcacatttcaaaaccaatcatgtgttcctaacagtccctcaaagtcttaactcatttcagcattaactcaaaagtccaaattctcatctgagacaaggcaagtcccttccacctatgtgtctgtaaaatcaaaagcaagatagttatttcctagatacagtgggggtacaggtattgggtaagtacagctgttccaaatgggagaaattggccaaaacaaaggggttacagggcccatgcaagttcaaaatccagcgaggcaatcaaattttaaagctccaaaatgatctcctttgactccatgtctcacatccatgtcacactggtgcaagaggtaagttctcatggtgttgggcagctctgcccctgtggctttgcagggtacagcccccctcctggctgctttcacaggctggcattgtctgtggcttttccaggcacatggtgcaagctgtcagaggatctaccattctggggtctggaggatagtggccctcttctcacagctccactaggtggtgccccagtagggactctgtgtggggactctgaccccacatttcccttccacaatgccctagcagaggttctccatgaggaccccgccccttcagcaaattttgcctgggcatccaggcgattccatacatcttctgaaatctaggcagaggttcccaaacctcagttcttgacttctgtgcccccagaggctcaccaccatgtggaagctgccaaggcttagggcttccaccctctgaagccacagcccaagctgtactttggtcactttcagctatggatggagcatctgggacacagggcaccaagtccctaggctgcacacagtatggtgaccctgggcccagcccacaaaaccattttttgctcctgggactccagggctgtgatgggaggggatgctgtgaaggtctctggcatggcctgcagacattttccccatggtcttcggcattaacattaggctccttgctacttatgcaaatttctgcagccagtttgaatttctccccagaaaaagggttttttcttttctattgcatagtcaggctgcaaattttccaaattattatgctctgcttcccttataaaactgaatgcctttaacagtacccaagtcacctcttgaatgccttgctgcttagaaatttctactgtcagataccctaaatcatcattctcaaattcaaagttccacaaatctctagggcaggggcaaaattccaccagtctctttgctaaaacataacaagagtcaccttttctccagttcccaacaagttcttcatctccatctgagaccactgcagcctggaccttattgtccatatcactatcagcatttggggcaaagccattcaacaagactctaggaagttcaaaacgttcccacattttcctgtcttcttctgagccctccaaactgttccaacctctgactattacccagttccaaagtcacttccacgtttttgggtatcttttcagcagcaccccattctactggtaccatttactgtattagttcattttcatgctgctgataaagatatacccgagactgggaagaaaaagaggcttaattggatttatagttctacatggctgggcaggcctaagaaagaatcatggtgggagatgaaagccacttcttacatggtagtggcaagagaataatgaggaagaagcaaaagcgaaaacccctggtaaacccgtcagatctcatgagacttaatcactatcacaagaatagtgcgggaaagaccagacctcatgattcaattacctccccctgggtccctcccacaatacatgggaattctgggtgatacaattcaagttgagatttggatggggcacaaccaaactctatcagtggaatagactctgtatgatttctttggttatacgtagtcttcatgtggtggcttctcaaatgctcattgtggtagcgatgtgcctggtgtgtcagcaggcccaaggcctcctaatgagcaagggtggtgtgaataatagtggtagcagaggtcatatgaggctaccttcccaaatgctgtgtacttgtgtcagcagatactgaaatgggctatgaagtagatcttaaggccagaaagtggtgcttataggtgagagccagatggcatggtcactagctctctcctgtaagatgttctcaccttgtctagatgatctctcatctacacccaaaggtgtaatctaaatgaagttctcaggttcccaggtggtgggttgggttgtagaacattcagtggtccttgtcccccactttgcctctgaggacagaggcagcatagctgggaactgggccaagcgagcctgcatgtgggcccctaatggtgggtgcaagcaccagccccagtagggttcggagtcagttctcgggtccctagaataacttcccaatgaggagcagaataatcattgctgggcctaagacccaggatggggaatgagagatggctcaggctctacagactagcaagtggtagtgggacctgctgtgctctcgtactcccaacctaggagggctccctcctatagtctgactctggcagaaacttagaacagttagccaaagcactcctagtttgccttcaggcagacctatcccaggccacaaaactttctgctggggtcaaaaccacacccactcatgtcctctgaagagggagcacccaagtactgtgcctgtggctggagcacataccacatttgcctctcaattctagccccaggggcttctcccctgctcaagatcataaatctctgacctgagactctccagaccagtaactgccacttgtgctggctggcaggtttccacatagctccctatgagctaggatacagaatggcctcattctattgatgcccagttctaggagagcatgcaggataatttctagggctgttcctgctcatagacttctgatggctccccaggttagatccagagcttggttgggacaaggatctccgttatagcctggattgcccagcttcccagtgggaatgtgcatcatggaggcaatcactctctatctcatgcactggggattcactcacaattttctgctggagcctgccacatgagttgttacctgcattttttttctaagtgcccaaagttttctttaactcttatgttgatctcccgtgttcctttttgcacagaagttcacagtgtgaatctttacacacaattttgctatttctaagtaggtgaggtatactaacaaagcctccaattacccatctggtgaaagaaaggtgtttaaaaactttgaaaaagagatagaccctaaaatgtaggtatttgtaaagaattcctataccaagacatacgttaattgtgatttactgtgaaaagcaagagcaaatataaagactatacaggcgatatacgtcatgatttttttacaaaagaaagcagagttatattttctcattctgaagtcaaagaagaattttatagctgaatcttttagtataggacattgggaaacatgatggaccatgtcttgatgtatggctttgcaataggtatagaaatgttcaaatgcacatcttttaaactgattctgcatgaaaattgaaggcaaaatgtaacatgctaactttgtgtggaaaaaaaaggattattagctcgaataatgtgctctagacacagatctaggagaaacacataaaatggattccttagttttatgtgagctctttttgtttgtcagctggcttatcattttgaaagctgatagttactcggggcatgcattggaaatacccacagattattgagcaaaacaacattgatctgagaagaaagccctctacaagaaaagaaatatccctaaatcaaactagcaatacgaaatcttacttacctagaaatacactaataaaagttattgattacttacgtgatcaattctatagactgaaacaatttagaataacaaatacagaaataaaactttttaccattaaatttatgtcaaaactccccagcataagaaaaaccacaacactgaacaaccctttcatcactgatttggcaaggagttacaggtgacaataaaaaataatgtcaaatcttaagggttctggtgtaagaagtcctaaattctatatctcttctgctaataacatgtcatttgaaaagccaactgatctatataatttttttatatcctcatataagaaacaaacataaataatatcagtatatcatctggccatagttataataaaagtcaaattaaaagtttctatgaaacccctttattaagataaacatagtaaatagataatttaatttacatttaaagatttctcatgctgaaaaaaagtatcgatgttttgaaatagtttatcagaaattattacaaaaggaaaattttcaaaagcccaacaaatagggtataagagggtggaaatgaactgtgaatggggcacaagaaaactttctagggtgatggataagttctatattttgggttcagtggtagttacacaagtaagtgcaattgccaaaactccttaaattgtatatgtaaaatctttgcattttattatgtgtaatcacaataaaaaatgtccaaaagctattgaataccttatgaaaagtctatttctctaaaaacattgcctcccccttccccataaaaagaaagagtaagggaaaaagtctacttcaaaacataagaaaaatgcaggaccttaattatatcatttttttaagaacttaatatcaaattttgattatctttcaaaaaaagaaaatacagattttgcagcaaataatattctcatgtacatttttcctttatttccatatgtgattacctttcttccacagttcaatacaaataattttactcacaaataccataatcctaaatttcacattttgtgtttgttatagtcatggtcattgccctcccatgcaacattgaatctgaaacaaacagtaactaatggctttcaattcatttctaatgagccattgctgaatatgtctgcatcattctggttttgtttcatggtattatgtttttacatttttcttaaattttacagtttctagtactttgcattaaaacaattcatcatctttaaaaacaaatgttaaaaaagaagaaaacaagcaaaatctattcttagatatagtactttttaaaagtccatttttttttaattttagtttatttttaattgacaaataataaggcaacacttttaatctgaacctggtattatggttctatgtgaaataatgagataacctaatacggaatgatttttttctaactacacctctaaacaagcaaaattatctttgaatatgtttctatgcagttctgtgaataaaatttaaagattttatgtatggctatgctaaattataatcttctgggcttcaataaccgtaagatatgttttcataactgcactcaggagacatcagaaggtgttggggttgaattgtatctccccaaaagaccttgaggtcctaatcaccaggatctcaaaatgtggccttttttgaaaatagagtatttacagtgatattcaaatgaaagtgaatccattagggtggaaactaattcaataggaccactgtcttttaaaaaggggggaaattttgacacagagataggccctcacacaggaagaaaactacaaaaattgaaggctgagatgagggtgattcttcagaagccaagggatgccaaagattgtcccggcaaagtaatacagaaggtatacagggagctttttacaattactatgatgcctgataaaactgtctcttcctccattctttcaactcagttttggtgaaataagagagttcatttattcattcaaaataaggtctttaataccttttctgtttatcactgcctgtcttcaaataatatgccacttcctgtaaaacataatagccttacaacaagatactgtgctttccccttttcttcctttgtgctactgttatcaaaaagcaattttacttaatcagttagttctaaggcctatttgtacaataattatttgaccaataattggtggtaggatgtatttatctgtcaaagaaagtatacttaactcctgagttactcctttttgataaaatttgaactacatgaggttccaacttttccagtgagaaaataataattatttagtctttcacaaatttgttaaaccttgggaactgagagatatcatacatatcaacatatgttgccactggcaacgtatgtatgattatatactataagcaggatcagatgatgatgatctcaaaccattgatgtggagtcacacctgtcttgttctggtatttagatttactactttttaacactgtgatttctgcataagttacggaaaatatctaagtttttgttctttcatatataaaataaacataaataaaatctgactaagagatttgctcaagaacaaaatgatacaaactgtaagtgtctgctatagataattgctttaattacttgtgtgaatttactgaatctgtccaaaagataatttgataaaaactactcgaatatttaatgtagacacactttgatccagcaattacacttatagtaatttattctacaaataaacatgcacacatatatacagaggcatatataattcctcaaataatagattataattgtaaaatattaaaaattccctgtgtctgttatatctgtaaactacagtgtagctataccataagaggatgagtgatctacctacccacacatattttgttcaaacctccggtttttgtgaaggaaaaatcttttaactcttaaagatagatattgtgccatagattgctattgcctgaactaaaattttgtcatggctttgcttttatattagcacttaggacttctatgcataaataaggtaaaaaaaaaaaaaaaaaaaaagcaaaacaatatctctggtaacacattaaaactttcatagtttttatttgatgtgttaagatatacataaataatcacaagtttttaacttattaaatgtcagactttttcagttattatatccattaaaaatttttaaacatttttataagagatgaaaattttaatgcatagtgcttcatgatttaaggtatttatttaaatactcataaaagacaaactaaggaaaaaaatgcttacagtcatctgggagcaaaccttcacgttgtctgaaagtcagctttgtagtgtccataagaaaagcaggccaaagcatcaacacaaatgccaactgcacaggcagcaaagagccagatgctgttggcaaaacatgctccagagtgtggcatctgggtccaataatggccatacagagccccatctgtagctaaagctgttgactctgctttgggggaagaaaaatcagaaataaagaaggcagttaaattttaaaccatgccaggaatagcagaaggcaggttgcagtcagcattcaaattacatcgctagcccaatttgctttttaatgtcttgaaactgtgtaaacactaaactatgttaactccagttgtttagagagatgagcacatataggtagttcagtaacttaggacacacaaatcagctaaatagatttgatattccatcagacgttcatttatctaatttttttctcaaggaatataagcatatggtccatgaaatgcaattctaatttgatctattaaaatatgcaattttaagtgttcattatggtatataattttcttcaaatagcataaaatttaagactcttctttacaatgtttataatattttattagaataactcttcacaaagttaaataggatattcatgtatccttcactgagactccttaaagttttgatcagtggaaatttgtgggaaagctacaaagaaccttaagctttaatcaaataaagtttttcaaaattataaagagatgatcaaaataatctctttttagtgttcttcatttgttgtacatataaatatataaaatggaattagttgatatccagatgattaaaaagattcatcatttataagatgccacactaatcttatctatgcatatatttttgaaaacaagatcaatgttttaaataataaaaactaatgatatttacagtgaactatatataaaaaagttaactaaaactttgtggacagaatattatttatcaccataaccctgagacattactattgttgattctactttctagctaaggaaactggaagcttgcaaatgtaatgtaaacttacttatcccaattcacacaaacccttagagacagaatcaaacttaatatgcagacactgcagacactgtgattgtagaacccatatttattctccttctccccaataagatgaaaataaaatataacttgatagaatcatttctgtaatagcagaggaagaactagtcaaacatacactcttccataaaagaaacttgtacattgataaatatagttaaaataagctgtttcagaactgtgtaaatgaactaaaggcttgaaacaatctccgtgtttattcaagaaaaatgattgaatctcataagcctaatcagcttcgtggttgtaaacaaccatccctctctccccagctcttcaatggacttgaaatccaatatcattgcaataatggtagctgagaaaccagcaacctaatagccagtggagggggaggggatagtacaggtatgcatttgactcaaaagacccttcccaaggaatgtcactatttcattggtttgacagcactctgaaaaactccattctcagggactgactttatttgacctgactaaaaattcactcttataaaaaaccatatatctagggaatttgttaaaaataatcagtggcaattgcttaatatcacagtgtttgaggcaataattccagttgagggcaactctaggttgatcaatataatcaaagatttaataactcgggaattagatgtacctagaagtctttgaaagctagaaaaaatcctggaaaactagaaaacatcacagcatgcaagtctataaacaggcctaagaaagatataaacagccctaatctctgatctctgactaaccttgaggctctatacaagcaggaagtaaagaataaagtacagttgtaaactgcctggctgagcattgaagacatgtctcaacacacacacagagtcctttagtaaaggctggaagatgttttagttccaaaaatctaagaaaaatctctgtgaaatgattcattttagctgaccactaagttaatcaagcagagactaaaatggccacacatggtaaagaacaatcccagtgaaacactagacaaatagtagaaacaacaaaaacaaaaacactagctactaggaaagagcaagatttgatttccagatgtaccaagttatgctatttaaaatgtcaagttaccagaaaatattataagacatacaaagaaataaaagtatgggccatgcacagaaataaaaccagtaaatagaaactgcctttgaggacacccgaatattggatttacttgacaaatatattaagtcagctatggtaaacttgttcaaagggaaatataaactattatataatcaattaaggaaagtaggagattgatgtcttaccaaatcagtaataaaaataaaggaagcaattattaaaaaattaaaaaacaaatagaatttccagagttggaaattataaaaactgaaaaacaaatgtaaaagagaaaaacaacgtcatcaaaaagtgggcaaaggataggaacagatacttctcaaaaggagacatttatgtggccaacaaacatatgaaaaaaagcttatcatcaccggtcattagagaaatgcaaatcaaaaccacaatgagataccatttcacgccagttagaatggcaatcattaaaaatcagtaaacaacagatgctggagaggatgtggagaaataggaatgcttttacactgttggtgggagtgtaaattagttgcaccactgtggaagacagtgtggcgattcctcaaggatctagaactaaaaataccatttgagccagcaatcccattactgggtatatacctgaaggattataaatcattctactataaaaacacatccacacgtatgtttattgcaacactgttcacaaagcaaagacttggaaccaatccaaatgcccaccaatgatagattggataaggaaaatgtggcacatatacagcatgaaatactctgcagctataaaaaaggatgagtttatgtcctttgcagagacatggatgaaaatggaaaccatcattatcagcaaaccaacacaggaacagaaaaccaaacactgcatgttctcactcgtaagtgggagttcaacaatgagcacacagggaggggaacatcacacaccagggcctgttggggggtcagggggatagtggagggatagcattagaagaaatacctaatgtaaatgatgggttgatgggtgcagtaaaccaccatggcatgtgtatggcacatgtagacctatgtaaaaaacctgcacattctgtacatgtatcccagaacttaaagtatattaaaaaaaaaaagttattggaaaaaataaaataattactaactgagcaaaacaagagacttaatttggcagaagaaagaagtagtgaacataaagataagtttattaagataattgtgtctgaggatcatcagaaaaaaaataaataaatgagtagatcctcagagatctactcacatatgagttccaaaaggaaaagggatagataaatgctttgaaaaattaatggccaaaactttctgaatattatgaacaaatgttgatctatacatccatgaacctcatcaaactcaaagtagaataaattgaaagagattgaaagttaatcatgatagtcaaactgtaaaacacaaagagataatagtgatagcatcaagaaagaaagtgatttattacatacaaggatcctcataagaataacaattgacttcccatcagaagccaccatgtagataagaaagcagcagaatgatatatttgaagtgctaaaagaaaaaaaaagactatcaaccatgaattctatatcctacaatgctaccttctaaattaaagcagaaactaagacattttcagataaacaagaacaggaagatttcataactagcagactaacatataaagaatagtaatgatagtcctttaggttaaaatgaaaagaaactatagaatcttaattattcacacataaaaatcatgagatccagtaatggtaactatattagtaaatattaaaaccagtataaatatgttttgttcataactcttttctctgtatatgatttaaaagatggagcataaaaccataattataacagtttgttgatgggcttataatgtataagatataatttgtatcacaataataaaacaagggagtaaaaaaaggggagcaatggtggagcaatatttttgcacagtgttaaaaataagttgctattaatgctgtgtaattgctttatcttaagaggttacttataatctataggtcaaccattaaaaattttctaaataatacaataaatgtaacaagggtgttaaagtggtatatcagaaaaaaatatctatttaacacaaagtaaggcaataatggaagaaggcagcagcaaaagagaagaagacatatagaaaacaaatggcataatagcagaagtaaactctaccttatcagtaattacagtaagtgcaaattgagtgaacattccaatcaaaagacaaataatggcagaatgtgcttaatgaaaaaattgttcaactatatgctatttgtaatagttatactttgtattcaatagtgaaaactaaattcatagcaaaaggaaggagaacataatgaaaattaaagcataaattaataaagcagagaataaaaaagcaatagaataacacaatgaaatctaaaactggtactttccaaaactgaaaaaccattaactagaatgatcaagaaaaaacagagaagacccagattacaagaatcagaaatgaaagagaagaaaatactacactcttccaaaaacaaaaaaggattcaaagagaatactaaacaattacacgctaaccaattataaaggctaaatgaaatagataactttacagaaaggtaaaaccacggaaagtaacccaaaaaaagtatagcatatcaataaacttacaataagcaaagagatttagtaataaaaatgtgttccacaaaataagtacatgagtagattgctttaccagtgactttaccaaatgtttacagaataatgaacaccaatccttctgcaactgttccaaaagagaaggggaaaattcttaacatgttctatgtggctaatattacccagtctaaatccagtcaaagatatgacaaaaaaagaaaaatacagatcaatatgccttaggaatacagaccccaaattccttcatgaagtactagcaaatggaattcagcaacatatacaaagaaatatacattatgaccaattgggacatatattagttctgcaaggttggttttaaaatagaaaaccactaaatgcaatatacaatattaatagaatataagacaaattacacatataaacagcttcattgacagcatttgaaaacattcaacacattttataaaaaacaaaacaaaaaaaacactcaacaaaccagaaacaggagggaatgtccaaaatctggtaaagtgtcccatgaaaaatctacagctaacatcatactttatggtgaaagactgcttgattttcttttaagctcaggaacaagacaagcatatttagtctgtcatttctaagttcaacattgtactggaagttgttgggataattaaacataaaacagaaaaaaacgtatcaatattggacaggtaggagcaaaattgtctccattatcagatattaaaaatcctaaggaatcgaccaaaaattattataactaataaataagtttactgatgttgaaaaatacatcatcaatatacaaaaatcagtgctgtctctatacactagcaaagaacaatctgaaaatggcatgaagacaattccatttctaataacataaaaagattcaaattcttaagaatagattctaagaagtacaagtatacataggaaacaataaaatattattgaaagaaattaaagaagattcaataaaatctctattaaagttatggctgccattttcttcagaaagtaacaagctgatactaaaattcatatggaagtacaaggatcccagtttagcaaaacaatgatggaacaaaaaaataagttggattcatatttcctgacttcaaacttaccaaaagctacaataagagggtgtggtattagaataaagataaatagaatagagggtctagaaatccttacaagtttgtctaattcatgttaaagttaccaagataatttaatatggaaagaatagtatttttaagaaattatcctgagacaactggatattcatgtgtagaagaatgaggctagacctttacctcacaccacacacataaaaattaactaactcaaaatggattatatctcaatataagagctaaaaatataaagtttatagaagaaaatacagaaataaaattattgtaatcttcagttagacaacaatttcttagctatgatatgaaaagcaaaagtggcaaaagaaaatgagtcaattggttgtcctcaaaattaaaattgtttgtgcctgaaaggacaccatgaagaaaaagataactcacataatggaagaaaatatttgcaaatcatatttgataattggcttgtatccaaaatatataaaatttcttacaactaagataaaaggtacataacttccattcccaaatgagcaaatgatatgaggagatattctcccaaaaagagatacacgaggtcagaaagcacatgttaagatgagctgtattattagtccttagggagatgaaaatcaaatgtgcattgaaataccatttcacacctactagaagggttaaaaagacaaacatcaacaaatattggcaagatgtggagaagttgacactctcatacactgctggtggtactgcaaaaattatacattcactttggaaaagagtttggaagttcctctaaaagttaagcacagagttactctatgatccagcaattctactctagttttatatgaaaaataattgaaaatatatgtctggacatgtattgcacatgtttatagcagcgttattcataatagtcaaaaagttgtaataatcaacatgtttatcagctgaaaaataaacaaatttgctgtaactttatgatgtaatgttatctggccataaaaaagaaacaaagtccttataactgctatgacataagtcttgaaaatattatgctaagtcaaacaaaccagtcaccaaaaaacatatattgcatgattccatttatatgaaatgtccagaacagacaaatcctagagatagaaagtcgattagggggactttatttatttcaagggggaagaaggaaatggggagaggctatggtaatggtatgagttcctttggaataataaaagtattctaacattagatagtggtgatccttgtacttctctacgaatctactaaatctatagtagttctctccttttccatggttttgctttctggtttcagttaccagcagtcaaccatgctctaaaaatagatgaatatagtataataagatattttgagagagagagagagagagagaccacattgacacacttttattacagtatgttatgatttttctatttaattagtagttattgttgttaatctcttaatgtgcctaacttatatttaaacttcaccatagttatatatagaaaaatacataatttatatatagatggtccccaactggtttgacgtgatgtcttgtctttacaatgggataaaagcaatttacattaagtagaaactacacttcaagtacgcttacaacaattatgtttttttgctttcagtggagtattcaataaattacatgagatattcaataatttattataaaataggaattgtgtttttctccaccggtaagttaatgtaggttctgagcatgtttaagggaggctaggataagctatgatattcagtaagtatattaaatacttacaagtacatttccaacttacaatttttgtcaatatacaatgggtttatcagaaaaataaccctattgtaagttaagggatatgtgtaaccctgtatagagttcggtgctatctttgattttcagacatccactgggggtcttggaacatatctcccttggaatagtaaagggggactattgtactgaattgtacacctaaaaaggtgaattgtatggtgtgttaattatgtctcaataaaattattatttagaaagataactaggtaaggaaattcctaagttgtaagtcatcctatttatatgcaacatatggaatacatacattatgctcatctcattaatatagcatatttagtgactgctcttttctctttacaatctagaaaagccaatatgaatataatgttcatattaatacattatctttataatcacaaaggagaagcacattcagaaaatctgattcagctaaactttaaattttatagccagataaaatgcaacaaatatctgaaatatgaaaataaataaagcaaataatatatcaaaaatcttaggaatgatgaaatgactaagagtttgtcttaatttaggtaacaaaatctcctgaaacatttatacatttaaatcactaggagttcacaataagccatgtcagggttatctagaaagactgattatgtatcatgaatattaaagtattttgaattaagccttgtagatgttgcttattttgttttcaatttttatgacgtctatatcaaatgcgatacttttatttaaataaaattaataccatgttggacaataaattaatatttgagtcctctcattttgttgggatatataagaatattttgaaccaataggtggacaaacataagtgatgtatttcatacacacacacacacacacatacacacgtgtatttaactcatatgtataagacattgttttgggaaggagcaaagtagcttctgatagccaggatattcaggagctagccatatagtataaagcaggtttagagctaggtgtaagtgttcttctgatgaccatttcaacaatttcatagaacatcagtatcagacatggctaatctatgcaaatgagagatcacaaaaactaggctaacttataatcatatcaaatagagacaaaaccaggaacatcacccaaacaaaagactaacaaaacaatcccctgtcatggctaatataagtaattgctacctcttttgaaaacattggctttcacttctttcttgtcttttcctccatcctcctaggtaagacttaccataaacctaataataaaattctgctcccttcttgacaacttatccagagcaaagacccactctttgaaaccatcccccaaaatacaagtagcaagctcaagtcggtaagtcctttctaacatccttttatttagatatccctgtggatctacatgatgtgttttctcccttgttgcaatgagttataaacccaacttttgcaaccctaggtgtgttcccagtggtgtttgtctggtgactgccaacagcatcaacacacacatacagaaacgcatatacaagttatcttaagaaattataggaagagctaaatgccaaaaaaaggatatatcagagtctcaatgaaagaaatactagaaaatttatagtacatattataggttataattaattaatgtaagaaaaataaaacagataacaattaatattatgtttttagttcatcaaaagtttattatttctcctaatatacaggtggaaaggttattaatatcaatttgtgttcatacatcaacttactaattgctaatgtcacaaaaatgtctctgggtctttttatttttatatatctttaactaatcctaactactggcattgtgagttttcctatattaccaaaattatttatttatcttttttttgtcacatagtatctatgccattattgccagctattgtggaattcaatttaataaagcaaactgcctactgttgaacagtctgcaccttataacccactttaatcaccaaaaaattagaaacatttgtgaaaagttttacaggcatgagataatccagaattctcaaccttaatcacaaggcaaaagagaatgtatgatttattttggaggacattctgaaataattttaacattttcctttgtaaaataatcatctgagtgtgtttgtatgcaattcatctgcttctgaacaagaaaaggatttagttatgatatacttgattatgcatctacataagagatgcaatgtatgccaaacaaatctaggattaaaaattatttaccaagggcagggcatggtggctcatgcctataatctgagcactttgggaggctgaggcgggcaggtcacttgagatcaggagttcgagaccagcctggctaacatggtgaaactccatctctactacaaatacaaaaattatccaggcatggtgtcaggcacctgtaatcctagctactcggaggctgaggcaggagaattacttgaacccaggaggtggaggttgcagtgagccaagatcatgccactgcactccagcctggaaaacagagtgagagtctgcctcaaaaaaaaaatttacaaatatatacgtggttattaagcttttggaataatagcaatagctactaagaatttctttttcatgtgtatgcatcattttagatttagggagtacatgtgcaactgttacatggatatactgcatgatgctggagtttggggtacaaatgatcccatcacccaggtagtgagcatagtatccaacagtcagtttttcaacccatacttacctccttcccttcccactctagaattccccagtgtttattactgccctctttatgtccacgagtacccagtgtttagcttccacttataagtgagaacatatgatatttggttttatgtttctgtattaattcacctagaataatggcctcaagctacatccatgttgctgcaaagaacatgactttgttcttcttcatggctgcatagtagtccatggtgtatatgaaccacattttctttatgcaatcccatgttgatgggaacctaggttagttctatgtctttgctatggtgagtagcgctgagatgactacatgagtgcatgtatctttttggtagaatgatttatttacttttggatataagcccagtaatgggattggtgggtgaaatggtagttctatgttaagtttttgagaaatctccaaactgctctccacagtagctgaactaatttatatcccaacaacagtgtttaaacgttctcttttctccaatgccttatcagcatctgttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaatacctggtaacacaccacctctcaagattgaatgagaaaaaaattgaaatcctgaaaacaccaagttttgaaattgaatcagtaattttaaaaaaacaacctaccaactaaataaagccccagaccagatggattcacgccaaattttactagatgtaaaaagaaaagctggtacccattctactgtaactcttccaaaaaaaaaaaaaaaacaaaaatgaagtcgaaggaactcctccctaattcactctatgaaccagtattatcgagataccaaaacctggaaaagatacaacacaaaaagaaaactacaggccaatacaccttatgaccctcaacaaaatactaggaagcctaatatggcagcacatcaaaaagttaattctccaactaagcttcattcctgggatgaaactgtttcaccaaacacaaatcaataaatgtgattcactgcataaacagaattaaaaacaaaaaacacatgatgatcccaatagaagtggaaaattctgctatgaaattcaacatcatgctaaaaatcctaaatagactaggtatctaagaaacatatctcaaaataataagagccatctatggtaaacccacagccaacatcatactaaatgggcaaagtctacaagcattcccctggaggactggaacaagcccagcctcacaacttctattcaacacagtaccggaagtccgagccagagctatcaggcaagagaaataaataaaaggtatccaaaaaggaacaaaataagtcaaactatctctccttactggtgatatgattctacacctagaagatgctgaagactccaccaaaaggctcaaagtttcaggacacaaaatcgatgtatacaaatcagtaacatttctatgcaccaataacattcaagctgagagccaaatccagaatccatttacaatatgaaatctcatttacaatagcacacacaccaaaaacaaaaaacaaacaaacaaacaaaaaagcaaggaatacatctaatcaaggatgtgaaagatctgtacaaggagaactacaaaacactgctaaaagcaatcagtaatgacacaaacaaatgaaaaaataccccgtgttcatggcttggaagaatccatatcattaaaatggacataatgcccaaagcatgcacagattcaacgtatcaacctacgaatgtcatttttcacagaattagagaaaaactatactaaaatgtacgtagagtgaagaaagagattgaataactaaagcaatcttagagaggaaataaaaaaagatggaggcatcatgttacctgacttcaaactatacgtaagtctacagtaaccaaaaacagcatggcagcattgcactggtaaaacaacaacaataacagacacacagatcagtggaacagaatagcaaaaccagaaataaagcaacatactgacagccatttaatatttgataaatcaacaaaaataagcaataagggaaggaccccctattcaataaatggtgctgggaaaattggctgtccatatgcagaggactgaaactggacccttaccttttactatacacagaaaagtaacccaggatggactaaatatataaatataagacctctgactataagaatcctaaaagaaaacctagaaaacaccattctggacatcagccttgataaataatttatgagtgagtccacaaaagcaactacaacaaaaccaaaaattgacaagtaagattaagctaaagagcttctgcatagcaaaggaaactatcaacagagtaaacagacaactgacagaatgggaaaaataaagtggagtattctcccaatgtgatagtctgaaatatagtctgaaaccaggggcacaatgcactgtggaaagccgtagggacctctgcccttgaaagcggggtattgtccaaggtttctccccatatgatagtctgaaatatggcctcctgggatgagaaagacctgaccgtcccccagcccaacacccttaaagggtctgtgctgaggaggattagtaaaagaggaaagcatcttgcagctgagatagaggaaggccactgtctcctgcctgtccctgggaactgaatgtctcggtataaaacccgattgtacatttgttcaattctgagatcagagaaaaaccgccctatggtgggaggcgagacatgtttgcagcaatgctgccttgttattctttactccactgacatgtttgggtggagagaaacataaatctggcttatgtgcatgtccagtcatagtaccttcccttgaacttaattatgacatagattctattgttcacatatttgttgctgaccttctccttattatcaccctgccctcctactacattcctttttgctgaaataatgaagataataatcaataaaagctgagggaactcagaggccggtgcaggtccttggtatgctgagtgccggtcccctgggcccactgttgtttctctattaaaaaaaaaaaaaaaaaaaaagaatgggaaaaatagtcacgatctatgcatccaataaaggtgtgatatgctgaatctataaggaacttattcaacaagcaaaaaacaactccattaaaaggtgggcataatacataaacacctactcagaatttctatttggagtttcttcagaattctcatctaagaactaattaatacaattgaattatggaatatgtggaaaatttatactataaaatatatcaaaaattttactaaaataatccaaaatcacaataatctctaagtaaaaaattggaagttttaatttagcggactcactcctttcttgtcagagtgtggtagttctcatactgcatggaaaggtccaaaacaatgttaagatggcaaaaacatgttttgaagaagtaaatgcatttgtatcattaccatattggaacattgcattttcaagttaaaatttgtttatactttgttgacatctgcccttcagtgttttcaaatttcaaatgattgcgacaccatcttgtcagtaaatggctcttcattgctggatggttattttaattaaatgtatctaaagtgaaaataatgtctggatgtatcccaaggacactgagcactccaagtaatttcatgaagaaagctaaaaatatgttactcaccgatagcttttgtaaaggtcagtacaggtggaattgttcttgcaaggattcattttacactcattggattcttgttcacaaaaatttccttcccaatcagataggcacacacactggtagctctaagagaatatgaaattatatatttttaggctatttcttactattaagcctataatacagatattactcctggccattttgatatctctgtcaatttataatttttttagttttatagaatgccaatactccccccaaatgacttttaccacatttttaaaagcgtgtgaacagtattctttagtatctaattaaataaagttttgtagtaagtcaatagattctacagaaggtattaaagatttatgcattatgctcacaatgtagaattatcatctttgttaaatgttttaaaagaaaaatagcatgttagtcatatgatggtagatgatggagtataactaaataactaattaaacaactcagcaactagctcacaagttaaaaatacaagtataaataaggaaacttttgacagatttattgttacagataaatatttaaaataaattaacagacttttggtcaattaaaatcgtaaaacttttcatggtgtttttctgaaacagagagttgccctatgacaatgtaattcagaatgctagaggtaaaattttgctttcctagtattgggcaaacaaacaaacaaaagaaacactttaaattactctgtgaaaatactttctatatgaaaaatatttttgaagaatagagctcttgtcaaaattagattttgggcttttgtctgtagagaatctagatatagcattataaaaacggtaaaatcaatgttaactgttatttaaatctgcacttttcaatacagtagccacatgtggctataaaacattgaaacatggctagtaccatttaagatgtgctataaatataaaatacatattgaatgttgaaaagttagtattaaaaaaggaatgccaagtatctcactaaaattttttattatttactttcggttgaaatggaaataattttgatataaagagttaaatgaaacgtacgatttcaattaatttcatttatttccatagctttttgtagtggctactagaaaagttaaaacacaaacagagatctcttttaatttctactgaacagaggtgagagttgagttagataatgccagcccagtttctccatttgtggatagagttaagaagtctatatacttataagcacaatgtgatgagtaggagccctgagattacagaacgcatcttagtttaatacatctcaacatcctgtacagatctagcaccctatgtttaattaatgttgattaaataaacagaaaaaacaaacatgatatgaccaataatttaaaggttgaagttagtagccaaaacaaaattcaaaatgatccttcatcactttggtacatttggacagcaaattttttttacaaacataacaatgaaacatgataaccagaagaaaaataaatgcatgctccatgtatgtgcatttagtttacaacagtttaaatgtataagaagttctactcagtactgtgctttggttgaacagggccaattggttttccatgctaggtattaataactagcttaaaagcacaagaatgagagccaccttttcaacattgtgctttattcttgacacatatactagtctccactcagaataatctttaagggtactccagttttgctggattttagcagatttttttttcacataccatgctccctacattgttaacttcctccatgagtgtggtaacatttacagttttcattggttgcgtttggcttattttttctttttttttttttttgtaaacattaaaagaggacttacataaaaattgaatataatgattatattttgttttatgaatgtgctatttaaaatgaaagcaattccacaatagtcaagacaacatcagctgtggtgaatgggagaaaatcatcccactcagtagcataaatggcatatgcataaaatcttcgggacatgcccattcgttatgttctgaaatttctcatattatggggtataaattatttatgtaaagacaaatgcataagcacactgctgatttttattttgatgcctcaataatattttgaaacaaatttagtgagtcaaaaattcagtcaaatttttcctattaaattcatatatttcttaaaagctaataactattggtattttcaataacttgataattagtagaaaattgtcaatttcagggtatcattatcattaaagtatcaggtactatagcagtgaattccagatatgatgaactatatacaaaaagaaaacataaaaggatgaagaaaatataatttaaaaaattaaaatttaaagatgtaaatgatgaagagaacaaaagtgcatagcaactaaaaataacccagagtttgagaatttttattcatcagtatcttacttgattcaaaagcattttcctcaatttagacattcttgctgcaaagcagtttctcattcaacattgaataattgattccagtaatttaaaataactgttccttaaatttgcactggtcaatacagtggccagaatagtattaaataatattaaatattgtatttaatattattaaatattaaatattaataactattaaatattttaatattaattataaaaatagaaattatattccactagaaaactgaaatataattaatattaatatttaatattttaatattaaatattaagtaattattaaatattaaataatattaaataatagtaaatactagtattaaatagtattaaatagtattaaagtaaaatactatttttaaaagcacattttcagccaattttgatggaaaaggaaagtattattaaaatgtgtttaccaaaaggagtaaaggtttacattatttattaaattagaatcttatcattttttaacttctcactacaaagtagacattactcttcctactaaacttggataaaacagtagtttgaaaatatgcatgtgacaggaaagacagatgataaaaacacaggtctacaatattgaactctgcagccagtgagaaaaaaataaagacaaagctgtcaagtttgatagttgtaaatgcataaactatatagtagttcactttttcagatcaacagccagatattttaaatttttcttatcagtaacagatgtactaaagtaagatggatagcataattgtgaacatgaattttcaagttagagagattaaacaatatctctgatgcttattaaatctctagacatctagtatattagttttctcttactgcctaaaagattactacaagtttcgtgtcttaaaacaacataaatgtattgtctcacagtttcaataagtcagtgtacaagagtcagtcacctaaatcctttgctttcggtctcaccatgctgaaatcaaggtattgactgggatgtgatctcacctaggaaatggagttctcttccaagttcaatgattgtagcagaattcatttcattctgcctctaggactcagatctcattttcttgctagctaccaggtaaagactactctcagcgtttagaaggtatttgcaggtccttgacacatggcctcctcctctcacagcatgccagtttgtttttttaaggacaacaggagaatctctgctgttacctcttgttttgttaaaggcccatttaattagggcagcccatgtaggacaaccacatgtttgattaaataaaagtcacttattgggggtgttaataacactgtaaaatctctttctacatataatataatcatggaagaagtatcatatttacaggtttcactcacacccaaggggagattttacagggcatatacaccaggagatgggaatctcgaggatcatcttaaaattttgcctttaatatctactaatctacttaatctttccaagtaacctactcaagttctccaagcctcaggtgccttcatatgtaaagtactaacaatttatacttcataaatatacttaagccttgaaggtagtaataactataatattcttagcctagcgacaaataattatcattaattagtagtagccattacctctaggcaaaacagtctagatctaacaacgtcaaagaataattgacagaagtaccacgattggctcaaacctattcatcaatacattacttatttttataaacatttaagccatgtaataagagataaccagactaggaaaaacaaagaaggaggaagagcaagagaatccagcaatatgtaatttatgaacacagacttacatgaagtggattaatataagaaaatataaatgaggaaaatgtattcaagatgaaatagaaaatcacactaaaccagtagacatttaaaaatataccaaaggagggagatttgctaacatagactcaaacaaaattactcccaagtctttatttattctcttatgccacataggtgaagagaatagaaaaacaggaaaaactactcaaattattttttgagactatcaaaacctagctaccaaattctagcaagcatataacaacaaatagaaatttagccaatgtttttaggatcaaaaagtcaatttttttcaaaaaaacataaatttagatagtcgaaaacagtaatgtatttaaaatacattatatagtttgagctggaaatatgccagaaatggaaatatgcctcaacacaagaaaatcttttagagaaagaaaaatggttttatcatttcagagcagaaaaatattttataaaattcaatacacattctaaaaatttcttttagcaaatgaaaacaaaatgggaatgtacttacattaacaacaactacctacaaaatgatttaaaaaaaccctgccaaacatcagtttatcaaaaacaaatgtagaaactgaataaaaaatatatacacatatacatatacatatatatatatatatatatatatatatatatatattgttgaattgttacaagaacaactgaagttgactagatcttctaaagctaaagagataagaagcaagcaaagttaagactacagagggctctgcttttcaaaccaggacatctgcccatttgcttccagataagtagttgcatctagataagcagaaagtagtagctggagtttgcagcagcttctttgaatgaaaagaaaacactagcattcagcttggtcaaggagattaggtccgtgaagagaagaacagagaagtgagcccacaatttgatcagccctattctatagaggcacttgttccctttcaaccttgtatttatagtatgaaattacacagaagtaaagcattagcagtctagtagtgcaaggaagataaaagttggagtttagggccagcaatatcttacagtcttgttaaacacttctagctttcaatgaacacaacagaggggcatatcttgaagaaaaaccagcaaaaaaacaaaaacaaaaacagctttaacggcatgaaaaccatacttgcctaaaatgtgatcatgcattcctattctgtctgccagaaaaataaaaataaaaaatcctctttggaagatgttaacattagatggagcttttcaaagtttgaaacaaatgtctgccattcaataaaaaagtttcttaaatgctgattaccaaatgtcaagagacaaactgacagtagaaatatactattgagatactgtgattattggatagagatttaaaaatacttatgatgaatacatataaaaatatagaagacaaatagggaattccactagaaaactgaaatctataaaagagacaaagaaaaactctgagtttgaaaattataacctgaaatttaatgacttaatatattattttaataatagacttattagacagaattaataaacttgctagtaaaagatatacagattgaaatatttatataaaggatataacagtcataaaagaaaacgaaatatgggaactaatgaaaatagccattatttgtttaattggaatatcaaaaacgaaggtagagaaattgggcaagaacaatatttgaaaaattgctgcctgagaattttcaaaagatggcaaaaagagagtgaccacagatttagaaagttcttgagacctatgctggatacataaaaataaaactttatctagattaaaacttctgaaaatgaaagacaaggagtaaatcatacaggcagccaatgaacaaagacatattatcttcaaagggacacaaagatcacaacttactccccagtatcagaagcaagaacccagtgagccaacatcataatggagtgaaagaaaataactgccaatttaaacttctatacccagtaaaaatacacttcaattatgaaagcagaacaaactcactttttacaaaaacaaaacctgagaacttactgcaatgtttaagattgtgggaatttgttgacagatgacctggatttaaattcaggctctaagaattatgacttatataattttaagcatgttacttaatttcaaggcacatcagaaataatgctacctgcccaacgagggtataagaagtacagcactgagtataggacgtagtgtaatatctaacatagtaagacaaccataaattttaactaaaatgttctcatatactgtgacttgtccaggtaagctaaactacttctcagtctctgtgatgtttgtttcctttactttcttccacttggaatgactttgtctacttccaccaatccctgaccatactttccaagttttatccacctgcaaatgtcaaaacaagtgccacatagtacctgaagctttgataatttccttcagcataccttctcttacttactgttttagattttatgatacatttaaagcatgttagttacttatgtacatataagctgtattctgcttagtgcttattgtatttaaaaatatcttaattatattattgcgtatttctctagtttctaaagtataaattccaagagggcagaaactttctttactttgttcaacaattatcatcaataataacatctggaatagtgtctaatgtttgactgaataggtgctagagattggaacatctataatgatattcattggtactaatatagtcatggaggatattttatttatcatttctagatatttaataatcttattttcctaacaagaaaaagacttttttaaaagaattcatttaaataattatttcattacaatcaaccaaaagcagttctataaatgaaggattaaaatccccattgaaagaaaacttggattgcttccattttgaaaagtttttatacattagaattattgtattttattcagtcttagccacaattttttactaacatgtgtgctttgtgaaactttctattagattactgaaaatgtagatatatactgaaaaaaatagaaatttcaaattatagtctctttctgatcattatttatgtaactcttgaaagaaggacaaatatttttctttgctttaataaaaaaacttttgaagtaaaatttgtaatgaatttaatccttgtaaaaataaagggctctccctattgacttattatctcttttatttaaatgttattttaagttttcactttaattcataaatacttatagagttggctatagacacaaaggtttccaaatactgaatgctgatactcaggattatacataaaaacactaatctttatttataaaaacaaacagaactatcttaatatgatttctttcagcaagagaaaatgatttatcttggtgctttaaatctaaagtaaaataatatgtattattctgacagaaagtaaatggaatatttagaaacaatttctataaaaagttacaaacactgaatttgattgaacatattttgaaataaggcaaagaaaatacactttacaatgagtgatactttcaaggcaaaacttgtagaaaaacacaatttcttttacttgggaaaatgtaatacaaatacatgaagaatatgaaaagtcacatggtagaggaagataatatagagtataaatcaagctatactggattttgaaaacattttctaaagaaaacataaacctctaagaaacttagtcattgttcccatgtgattatacttttcattagtaacaaaaaaaaaagcaaatggtcattttagtgcctaatattccaaatgagaaaacaaacattaagtataaatttccactggttttatttcctatatctagtaaatctactatcaaaataacttcagctgtttgtctactatgctattttcaatttatagtttttattagtaatctttacttataatttagttctcttacggcatgccctaccttcataaaccatttgtgatcctttttaagggttcctttacctttaatgtcggtttaaaaaaaaaaagaatttaaaactagaataaagaagtttagactaactgtaataaaccatgggaaaaaataactcatctgtcattgatgtgtactgctcaaacatatttattatgttttgaatattatcttccttattgactcaatttgacaattagagatatagtctaatacccaaagctttttccctagtacacaaataataagaatatagaaaatataatcttgtatgagatgatcacataaagatgacagtatataaatgtaattctgcaacatatagttttggggagcattacatgttttggtctgagagccaaatgacaataataatgcaagtacaccatggactaaaaatcacttgtaagttttgaaccacaagtacaaaactcatttccagtattatgacctcaaagaaaattagcaactgaggcagagcaagatggtggaatagaaagcttcgtcaatttttcccccacccctggcaagggcaccaaattaacaactatatacactgaaaacaccttcataagaaccaaaaatcagtacatacaaaaatcagtagtatttctatatgccaaaagtgaacaaactgaaaaacaaatcaaaaacataggctaggcatggtggctcacacctgtaatcccagaactttggaaggctgaggcaggtagatcacctgagatcaggagttcaagactagcctggccaatatggtgaaaccatttctctaccaaaaatacaatacaaaacaaaaaattagccgggcatggtggcaggcacctgtagtcccagctactcaggatgctgaggcaggagaaacacttgaacctgggaggcggaggcagcagtgagcagtaattgtgtcactgcactccagtccagcctaggtgacagagtgagactctgtctcaaaaaacaaacaaccaacaaaaaaaaaatcttaattccatttacaatagccaaaaatgaaattaaatacctaggaattaaccagagaaaggaaagatcacaataatgaaaatatacgacactgatgaaggaaattgaagaggacatcaaaaaaatgaaaaaaaaattccatattcatggattagaagaatcgatattgttaaaacatccatactattgggagaggacatagttagaggctggctacacacacagagagggagagtcttgggagagaggcagtgcgcatggaaacacactggcaccacccttgtggtgtagttagcaggaaaaaatatggttaagaacttcctcttataccaggatgtttgctcagaagggatttattgtgcaagcacaataaatcaactaaatgtcctgaatatgacccagagctaattgtaatatcatcggcattgcagttttggctccctatcccatgggttttgcttaggcattcttgggtaataactacgatggagtcactatggtctactccagatatgcatagatgcaacgtccccgggggagcgggggaactttactcctcctattaaggcagaacctacgaaaggctttcttatttttccccacagaaaaaatatccccagcactcagaaccatttctggcaactcgctttgggtcccctctcactgctaataatttttctattgctttacaaattctgctctgccttactcactctctggtgtccacatgccttattcttctttgtcctctgacaagaactcagacctcactaaattaaggaatagagaaactgcaatactatgcaaagcagtctacacattcagtgtaatctctatcaaaatatcaatgacatccttcacagaaatagaaaaaaaaaattccaaaatgtatatgaaaccacaaaagacccaggatagccaaagctatcctaagcaaaaagaatgaaatggaaataattacattacttgacttcaaattatactacagtgctatagtaaccaaacagcatgttgctggcataaaaacagatacagaccaatggaacagattagagaacccaaaaacaaatccacacacctacagtgaactcatttttggtaaaggtgtcaagaacatgcactggagaaaagacagtttgttcaataaatggtgctgggaaagctggatatccatagacaaaagaatgaaactggatgcctatctctcatcatgtacaaaagtcaaatcaaaatggattagataattaaatctaagacctcagactatgtaactaccacagaaaactggggaaaatctccaggacattggtcaaatatttcttgagcaataaccacaagcacaggcaaccaaagcaaaaatggacaaatgacatcacatcaagttaaaaagctcctgcacagcaagggaaacaatcaacaaagtaaagagacaatccacagaatgagaggaaaatttttgtaaattaccaatctgacaagggactaataaccagaatatataaggatctcaaacaattttataggaaaaaaactctaataatctgatcaataaatgggcaaaaaatttcaacagacatttatcaaaagaagacacacaaatggcaaacaggcatatgaaaaggtgcttaacatcactgattatcagagaaatgcacatcaaacaatgagaaatcatctgaccccagttaatatatccaaaagacgcaacaacaaatgccggtgaagatgtggagaaaagggaatccacttatactgttgatgtgaatgtaaatcagtacagtcactatggaaaacaatttgaggttcctcaaaaaactaaaaatagagctatcaaatgatccagcaatcccactgctgggtatacaccccccaaatgaaaatcagtatatcaaagagatatcttcacttccatgtttgttgcagcattgttcacaatagccaagacttgcaagcaacctaagtgtccatcaaaagataaatggattaaaaaaatgcagtacacatgcacaatggcgtactattgagccattgagaagaatgagatcctgtcatttgcaacaacatggatggaactggagattattatgaagtgaaataagccaggcacagaaagacaaatcaaatattgcatgttctcacttagttgtgagacctataaatcaaagcaattgaattcatggacacagagagtagaaggatggttaccagaggctgggaagggtagtggatggtttgggagatgtgggaatggttaatggataaaaaaaaaaaattagggagaacgaataagatctactatttgatggcacaacagggtgcctatagtcaataacaacttaattgtacattttgaaataactaaaatagtgtaatttgattgtaatttgttgtgtaatttgtaacacaacagatgaatgcttgaagggatgaagacctcattctccatgatttgattatttcacattgcatgcctgtatcaaaacatctcatgcataccataaatatatacacctattatgtacccgcaaatataaaaataaaaataaatgcaacctccttcatcaaaaaaaattagtgcctgtaaaagtggaaaaatcgtctaggctttttcacagcaaaacagagacaaataccaaacaaataatatggtatttgcttattgtttttaaatattttcaatacctacttaaatagttcatttaatcacctggtaaaataaaataaaatgaccaatatgagataatataaagaaacgttcaactgtattttagcctatttgacagttttatgttctgtaaaacttctaatattttacatttattaggatttttttctgtaaaatggttttaagtttgaactgaaagcatttttatgtaattctgtatatatatcacacataaaatatatttgtataattatacatacacaatgtattacatataattataaatatacctagtatatataataacatacgtatataccatatgttgtgtgtatatgtatataacatcaaattttggctgggtgcggtggctcaggcctctaatcctagttgttcgggaggctgagacatgagagtcgcctgagtccgggaggcagcggttgcagtgagcgaaaatcgcgccactgcactccagcctgggtgacagagtgagactccatctcaaaaactaaacaaaacaaaacaaacaaatttaatgtcatctgaatctaaacctcactttcacagagattaagaaacaatcttcaggccgggcgcggtggctcacgcctgtaatcccagcactttgggaggccgaggcgggtggatcacgaggtcaggagatcgagaccacggtgaaaccccgtctctactaaaaatacaaaaaattagccgggcgcagtggcgggcgcctgtagtcccagctactcgggaggctgaggcaggaggatggtgtgaacccggaaggcggagcttgcagtgagcggagatcgcgccacagcactccagcctgggcgacaaaacgagactccgtctcaaaaaaaaaaaaaaaaaaaaaaaaaaaaagaaacaatcttcagcaaatatacatactgtaatcaaactgtggtgtttctttacattttatatttcataaacataataatttcttggcaattggtaagaggaattctggaaacattacagttagacacacaatcattggagtgtaaataatataaactggcttcatatcccaggaccttaacaattattgaatgacttgtatatctgtaggttatagttccttgataagaggactattttgtcttatggttagccattatgattttgttgctggctgatagactacctgctttgcattagaaaccagtaggggtaagatgggggatataaatactcagtcgtagttgtggtaaccatgtaagcggcaggtgagaagggagtagaacaatgtaagaatacttagaaaaaatgtgagctacaatttcgaatatccctgtcatcatcagcatgttggaattccataattcctcaataataattccaagaagcaaatttgctgtaaaactcattaatttatgaaaacaagccctccaatctgtgttttgcattgtagaatgtgttattattgacataatcattactcctctcctcagagtaatcagggatatcagaagcataagtgtttttttcttttccttcattattctttattttttgaattcaggaatgaaggttctgttgtcattctatccacagataccataaatattttctacacacattaaaccactcatgatattgacttaatgtgaatggagacatgggtaaaatgccctaggcagatgtcagggtatttgattctggtcccagatgctatgacatgtaggctattgaacatcttatccaattggtcataactggtcttaattttaaatcaacaaatttgaactcagtgattttttttactctttcaattctaaaatgattatatttttattgccttatttatagtttctaaaagcaccagatattaacaagaactgtctctctattgtgccaagtattctgaccagatgtctaaggtgttcctagtgattggttaatccctgagtaacaaaactatgttgtaaagtttcagctgcaaacacagttaagtagttcacgactcaggattttttttttttttttttttttttaagaagaaccactgttaaagtttgtctttgttgccaatcacttaccacagtgcatgggcaaatgtgtgtttaaaaacttgcagagagaaatttgtattactgagtcacaatgattgatgttttacttaccaagcacataagtgatattagtcttaatgcctttcaattgaataaaatcaatggtaattttcaggtatagaaaaaaagtggagtctctaaggctaagtttgacttgtgatttgaagtttacaaatagttttccagatattttcttaatcctgttaacaaatatttataatgagaggaaattactaataccttctcattataaatattaatatgaacaataaaagtaatctttgattatgtagaatatgtaaatagttactttatagtcatatgtcatataatcattttcttgtaaaataagggataattttaagcaactgtcttcaaatgttaagacaaaaatgattttgaaaggatttttccttttacctttttaaattgctgtcaataattttttaacaatgtagaacctaggtcactgaatacagtgttttgtataactttgttttttccaatatatattccaaattatttataggttttccttttcattttctacttttagaagagccaattgtgattcaacttatatctacaattctgagtctgttcccaaaatctttgatgtcacaaaataaatccgtgccatcttacatttggcatttctatatttttccttctttttaacttttatattaagttcaggggtatatgtgcaggtttgttccatagataaacttgtattatggtggtttcttgtacagaatattccatcatcaggtattaagcctagtacccattagttatttttcctgatcctctccctactccctactgccacccaccaccctctgatggtccccaatgtgtgttgttcccctctatgtgtccatgtggtctcatcatttagctcccattgacacatgagaacatacagtatttggttttctgttcctgggttagtttgctaaagataatggcctccagctccatccatatccctgcaaagacatgatttatttcttcattatgactgcataaaccatagtgtatgtgtaccacattttctttatccagtctatcactgatggtcatttaggttgattccttgtctttgctattgtgaatagtaccagagtgaatatatgtgtgcatgtgcctttataatagaacaattgatatttatttgggtatatacctaggaatgggattgcagggttgaatagtggttctgtcattacatcattgaggaatcatcacactgtcttccacagtggttgaactaattgactttgattatggaatgtagccctttaaagacgtgtttcccaaaggaacattttggtcagtggtgttgtatgtatctgttgttgtaaactattaattattcaaataaattttaatataagtaaatgaaatcctattatgatcatctaactgtagtgaacaggaatgaagtgatcagttatcctttccaatatatcatatatatatatatatacacacacaatttatatacacataaattgtatatttgtatatacatgcatatctgtgtgtgtataattcctcttcctctttaaaatactcaacagctacactgttcacctctcagtcatttataagctaggaataatgtttttcaaaaaatgcatgcttcatcagtacaatggaataagtccagagggaatttataaggcattttcatgtattctattcattttattacatcattaatcctctcccaactcacaatcctaccaatacacctttataatgctcagtgcacttgagttgcaattcagcttctgttttgagcccttatgctattaggcaatttacttagcctatctttttatttataaaactagaaaaataataggaaatttgggggagataatttctgaagcggtttttctatactcatatactaaaaattcataatttatctatcatcataattattttattgatccattagtattttaaaattctcaatccagagttttcattcttcaactctagtgaagtcaccaaaaacataatcataacttcctcacgtttcccctaagaaattttctatctccaaaacctcaaattatgatattctgttctttgtcactacttcttcagctttatcactcctaaccctgcacttctattctagttgctattcttctcagtatttctcggttagcacacttgctttctagccattagttctttctcttcacttttcagcataaacaccatcataagggggtttccaaaaactacaccactagtagtaaatgagatggtctgataaacagaggtttattttattttaaactttatttatctagttgtgttaaataaaaataaactgtttatctaatttatctatgtatctctttatctctctctttatctaattgtattagatagataaattgtgttatttctttactctaaattgtgttacaaaaacagaacaagtaggtggggcatggtggctcatgcctgaaatcatagccctttgggaggccaaggcgggaggatcacttgatccagcagtccgagaccagtctgggcaacataggaagacaccctatctttacaaaaaaaaaagaaaagaaaaaaaaagcttgtcatggtgctgtatgcctgtagtcccagatactcatgaggctgaggggctgaggcttgagggacgcttgagcccaggagtttgaggctgcaatgagctgtgatcacaccattgtactccagcctgggcaacagaataagaccaggtctcctccccaacaaccctcaaaaaaagagagagagaaatatagaacaagtgcaccaaattctgaatagattaccgaagagtaagtatatcttaattaaaaaatgatttaggtggtataaacatttgtatcaagaacacaaatttctataattttgattagctcgatgaggcttaaaaatgtgtgcccttagtcctattatcatatctccttgcttctgtattactgtactcaggactatttgaatgatattttctatgtagtttaaaatgttttgaacttttatggtaaaagatatgcatatgaatgtgtgcgtgcatgtattattctgagtgtcactctacagacaatggtttatctttctttagcagaaaatctctctctaggtgtagtaagctagtgttctgattagaaagcccacattctaaagatagttactgcaaatacttcagttatctttatctctgaccaacactcaatacttttgcaaatagcaaaatattaatttacaaattggatttcattagcgaaattattattaaacatatatagacttagtaaatattttacagccattcttagttacttcttgaccaggatgtagtgagccctatagtcattagccataggaatggcaccctaggtttgataatttaattatcctttacctctcccttcgttcaggaatttcccattcttttgactctgaaagatgttaagataatccaacgacttgaatattgtcaacagtgacctactgtgaaacttttatgcaagcaatttctgagaccaccaaaagatagagaacagagacctcattgatgcaataaatgtgtgcacgatagcataatttggcctatggcttgtttttgataaccaagtggtaaattagtgaggaaggaagcaactcatacaattttagctattcgtagtgatagagacacaccaagtagaaactaataatattatctatgttcaaacagattttagtcaatttccaaatccttaagtacatttctattcattttgtcagatgagtgaaataggagtcttttgtatatcaaaagttcactgaacaattaataacatacagcacatatataaaatgctgaccaacagcaaaatatttctttagaaaataaactcttttaagttgtaatacataatatagaattacaatatattatgttgtacttttttattaggtaaaacacacatgaatacactacctacttttaagcaataggggttaatatttcctgttagagattagaaagcaatggttatcaactggattttataaaaccttacatctataacttctcaacaaattttaccttttatgattatcactattacatatttttaataaacacacacttctcacactatttgaaaataagatctatatcatttgggtttaagataaaagtagctcaaattttagtgagattttaatatagggctctcgatatgtattcatgtaaattatgaaggaatttttatttcctctttaatttggaaataatcactttttaccatctgtctgacttccttcccttcaaaagttttcatacaatattctttatgattaaatggatattcagcattccttattccttaaaggaaaatctttcaacttttataaatgattttatttaattattagactttttagctttatgttattactataatgtgtcaatttaaaatgtcatatgttaaattacatttttctttcctgtccactgagataattcgtatattctaattttagtcaatatttgttgataaaatatcttatgtttgttaaggtgaatatttgggaaatttcctgtcacagtggcggcaccagcaagcaattcatcaaagtatgagctatattctttgctctttagcggatgcaaaataacataaaatatgtctttttgcctaaaaagcaaaagtatggaaagtttctattaataacattaataaaattgagttcattgaaatgaattctatataggctgggtgcagttgctcacacctgtaatcccaggacattgggaggccaaggcaggcagatcacttgaggtcaggagttcaagaccagcccggtcaacatggtgaaatccccatctctactaaaaatacaaaagttagccaggtgtggtggcatacacctgtaatcccagccactcaggaggctaaggcacaagaatcacttgaacctgggaagtggaggttgcagtgtactgagatcacaccattgcactcctgctggatgacagagtgagactccatctcaaaaaaataaaaagaaattaattttatataaaacaatttaccctcatgcccaagggtaataaataaatgctattaaattatatcatcataatattaaaactgcaaaattgaagcacagaaaattcatgtagtcttttttggataccataagtatttgctaaatatgtattaaatgatctgcatcctaggagtttgaaatactttagcgaacagaattgacaaaatattcctgcttgaatgcttgtctgaaaattactataatgtccatataggaagatcatagtattgaccataaatgatcataaaaagataataaaatagctattgtttataggcctttttgtccaatatattatatatgttattacaatgtaaatgtatatatattttattttttacatataggaaagtaaatgcattgatatatttgtaaatgtgctgattaacttgtcactaattgaagaatcatataaatgaagatcattcagacttttcattcttcattataaatgaggaaagcaaaatgacaaaataaaagaaaaacccaaaaagggaaattttctaactcatgagtacccccatgagttttatactttttatatagcatcatccctaacttttttcatttattttatagaggttatcagatttattacaaagtatactgaccattcaattggttttatatgctccttgattgcttgcttttttatagtttatgagcagaaatattttagatacatatattaagatacagctacctacaaactattactgaaaacagaatatattttatatattagagatacatagattgtgaatcagtttatggcttgaaatttgttactgaaagttctgtcttttttaaaaggcagcgactttaagaagtgtttggttgcctaatagctgctgaaaattgtgagtgtgtgtgtgtgtgtgtgtgtgtgcgcctgtgtgtgtatttcgaagtctattcaaaatgcttgtccattttactgggttgcgaaatgggtataaagggtacagggaatttaatttaatctggttaactgaaagttactccatgcctttgagttggagaaaagacaagttgatttcttatgagtgaattatttgttattaaatgtatgtttttctgagttgttgctttattatttatatagataagtatcaaaatatgagaaaaaagattcatttgtcctatatgctaatggatagattatttttagctatgagaaaagagagcctaaattggtttgttagtatgttttgtcaaaatctagaaagaaattggtgttggggggggtattgtttaacttgttaaatgtttaagcttgttaatgatttggcagtcctgatggtttaatttaaggattgaaatatgtcatattctattaaaattaccatggcttagaattaataactgttgacaagagatgtagagtataaagccaaatatctgcttctctttatgtgaggacgaaaacaggttaggtggtcactctggggataaaagatatggccaccttcaaggggctttaggggaaaatctgttccatttccttttctagcttctagaactgctttcttatcatccttggtttatgcccaccttttccttcatctgtaaagacaacagtgtaacatggttgcttcaatcctcacatagcctttttcttctatcttcaaatctctttctgcttccctctgataaggatactcctgattacatttaggacacacacagataatccaggataatgtcctcaatatccttaatttaattgcatctgcaaaatccctattaccatataaagtaactttcacaagttccacaggttccaggaattggaacctcatctctttagtggccatcaagtctaccctttgatcatctggctactctctggcattctatatacaaaggtagccctccagttagcacatcaaaaagccatggttttcaaattaaattccattgcattcttaaattatattctactaattacatgaaattattttttctttgaagtttctttctaatcaactaccactaccttattactgggatattatctttagcttcaattatggcatccattttccatgtaatctgcctgtctctaaccatactcagtcctacttcatagcagccagaattacttttctaaaaattaaacacagctatgttactcagctccttagaaagactctgcttatttttaccattcatgggacaaaatctaaacttacactttggaataagctgttcactgtagtctgagatcaaaactccattttttttttttttaagacagagtctcactctgtcccccaagctggagtgcagtggcatgatcttggctcacttcaacctctgcctcctgggttcaagtgattctcctgtctcagcctcccaagtaactggaattagagcaaccacacctggctaatttttttatttttagtagagatggggtttcgccatgttggtcaggctggtctcgaagtcccgacctcaggtgatccacctgcctcggcctcccaaagtgctgggattacaggcgtgagccacagtgcccggcctccattgtctttcttatcacccacatcattccattcagtacaccatatgctcccactacactgaggattaacactactttacaaatctgtactataaaattaactccagtattttgcttggaaatctcccatttatcattcaggaaggcaggtgctaaatttcataacgatttttctcccttctgcaatgtataaaaatggctgctccatcttttgggttttcacaattcagtcttatttcttgtataatatttgttgtatggtgttaattttttaaaataaccactctatcccctcaacatgaatttgggcatgtgaaaagtactgtgcccagttcatctttgtagtcccaaagcctagaactcagcagaaagaagacattggacaaatgtgattagttaaatgaatgaggccttcagaggcaagtgaaatgaactagtgcccacaatacaacataaaagacaaatttgtaccctctcttcaagattacagccatatataacactagagtcctctcaagaaataatctttgattaaacaggaaattaacttcgatttttaaaataaatatgggtatttattattacttacagaaacagtaaaaaaatgtatataaaacacatctgttaacacttgacccaagatttttttttatgggaagtttaaaattactcagtgatgcagttgttctataaattttccactgccttgaaaactatggcaattttatattttcaaaacttgtttaaaaaataattttgctgatcaaataaatgtgttattctttcaaaatatatttatatgagtttcttcatttacaaattaaattttaaaatgtttgcaatttttctgatctaaaacctttgtatattcactcaaaaatacttttctccaatcaatctctttctccttttgaattgttacctgagagggtctgattgctttatatagatgctcgaagcagtattatttttttcagaaaataaaacaatcacattacctaggaccctcaatttggcttccaaaattctgcttgtcaaaagctggattgcctactccatgtttattttctttactagtcaatagccccattggctgtttttgtggttgccatggtgtgcccccagatctgtcttcatagctgaggctctcttagccccagcttcccagactgttggcagttgaaaactcatagctgagtctttgcctaggacctgtccttacctgaaaggagatgctttgctcttcttccaaccccagaccacatccaatcattgctttatatgaaggtacaaagaccaagctcttttccctcaattcaagatatctctaatgaggtaccccagctcaagcactttctgtgggattgcccaagatctctgttataattgctgttcaaattgtctatttctctttccttcactctctcacagacattgttttctgagtatttcacaatcaactccttgcgtgaaaaaaaaaaaaatctcatttcctaaaacttttcctggggaatctcccttaaaagagttggagaccggcatggcctaggacatggactgtaaaatgatgctttgaagctaaattgtcagctgaaagaaaaaagtctctgtcagtggttgcaggtggagtgtgaatggcccatagcatgctgtagtagggcaactgttaaaacttgctactagctggggactggatcaggataccagagaatgtctttgcaaatgcagtatcacacacatttgtgaggaacagtgggagtggaaatcacaataatgtaatcagatggctcttgctgggtatcattaaggcattgaaaaaggcaaagattaagggtgaataatcaccattttaaagaatgaaacttagggggtcactttggaagcatttagactccattcttggcagccacagatctgtaaaaaatgagggccaggtccaggacttacttctaaggacagtagagcccaaattccctggaacccactaggactgtagaagaagccacttcttttgcttgaagatggtgcagacatctctgcattccaagataataacatgaaactgctctccctaggatttaatcccacatagctagtgatgttaagattatatgataagccttccaagcaaagtcttccttcacacagaggttactagcctatctccacacatacaaaggcagtaaaaggtctaaacaattgtaccaaatgtgaagtctcaaaggcctagtagaatttcaccttggtactcttcagtctgtgaccccagatgttacctaaactttccaatctcatactatgtaaaattgctttagattgtcataccaatgattataaaatctgtggctttaatacagtagctatttctataataagaatgtaatacagttgttccatgaacaacacaggtttgaaatggacacatacatttataagcagatttttttcaataagtattgttggaaaatttggggtagatttgtaacaatgtaaaaacctcaaatatgaattgccaagcctagaaatacaaaaaaaaaaagttgtgaaaaagttagaaatgtaatgaatgcataaagtgtatgtagatactagtttatcgtattattcactaccataaaatatacacaaatccactgtgaaaagttaaaatttatcaaagactaagcaaacaaacacagatcatacatagtgctcatacatcccgagtagctgggattacaggcatgggctcctatgcccggctaatttttatatttttagtagagatggggtttcgtcatgttggccaggctggtctggaatccttgacctcaggtactctgctcaccttggcctcccaaagtgctagaattacaggcgtgaaccactgtgcctggccactgcaataattttataaccacctcctgtagctattgcagtgatcccaagtgttatgagtagccacttaaaacatcatgtgatgctaatcatctccaagtgagcagttatctctccagcaaattgtgcatcacagtaaaaagtgatttttcaaagttcttatagatttttcttcctgtttagtacaatacgtaaaccttgaataacaccactgaacccatatgaagtgccactagtgatgctgcaagtgctcccaaagagcagagaaaagtcatgacattacaagaaaaagttaaattgcttgatatgtaccatagaatgaggtctgcagttgctgccattttgagataaatgaattcagactaagaaccattgtgataaagaaaagaaaatttgtgacaccatcactgcagctacatcagcagatgtgaaaactgcacttctttttgtgaaatatatttatttttaatctcatatttaaaatgcagcttttatggagattcaggattgctctaaggaaggcataactatagactctgatataatgcaagaaaaagcaaaatcattatatgataacttagagcaaaatgaaggtgaaggatttcaagctggaaaatttaatgccaacaaaggatggcttgataattttaggaagagtttggcttaatacatttcaagataacaggagaagcagcttctgctgcccaagaggcagcagcagagttcccagatgccaataagaaaatcactgaggaaaaatgatatttgcctgaacaaatgcagatgaaagtgtcctattctagaaaaaaaaaaagccacaaaggacattcattagcatggatgaaaagtgagcatcgggacttaaggcggtagagataggctaactctactgttttatacaaacacacttgggtttattatgatcagggctgctcttatctataaagctgctacacactaagtttgaagggaaaaaaaataaacagcttccagttttttggttgtaaaacatgaaggcctggacaatgagaaacctttttctgacttggttccattgatgctttgtttctgaaatcaggaagtacttagcaagtaagggactacttttaaaaattcttttgatagtggacatgcccctagccactgacaaccccttgagttcaacagtgaaggtgtcaaagtgctctatttgttcttaagcacaatgtgtctaattcagcttctacataggggatcataagaatatttaaggttaattacacacagtactctctagaaaggattgtcagtgctggaagagaatcccgatagagagaacatcatgaaattgtggaagaattataacattggagatgcctttgttgttacagaaaagtaatgaaagccatcaagcataattaagtaagttcttgctgaagaaaactgtatccaaatgttatacaaaacttcccagatttatgatgatgccaatccaggaaatcatgaaagagattgtggatatggcaaaaaaaaagaataaagaaaaaacatggtcagggggtaaagcgtttctagcaatgtatcttggagaaattcaagagctaacacacaccacaccaaacaaattagcagaagaccacctgatgatgatttcttatgaaccagtgccagaagatgagaaagaagacgtggaagaagacatagaaaaagcattgccagaaaacattttgacattaggcaatctggcagaagagttctgattgctcaacgttggttttgatttcttttaggacatagactcttctataatacagctactgaaactaaagcaaatggcaggagaaggattggtactgtacagaaacattcctatagaaatgaaaaagaaaacagttatgacaaaagttactatgtattttcatgaagttacagaatgtgtctctctcctgcctctccttccacctcttccacctctgcgactcctgagacagcaaagccaatccctcctgttcctcctcttcctcactctagccaatccctcctcttcctcactctactcaatgtgaagacaataaggaccttaaagatgactcaattctccttaatgaatagtagatatattttctcttccttatgattttcttataacattattttctctagcttactttattgtaagaatagagtaatgcatataatatagaaaacgtgttagtagactacattactggtaagtcttccagtcaacagttggctattagtaattgtttgaggagtcaaaagttttacatagattttgactatttcaggggttggtgcccccaacacccacattgttcaaatgcaatttaacatgttacctaccaataaatattaatactaggcattataggtcttatctctaggtatgttctttagagtaaaaagcctactttcccaattcacctctaatgtatatgaatccaaattaaattaataagtgattgagaagaatcacaggtagaaaaatctgtaggcattttaatttttcaatatctccactatatcaggtatcattttaaaatataatttataataaatatggatctgacttcactattattttgtactatatgatttatagccctatataccgaaaggactagaaatactgttatttttataggagcataattaagtaaaattgcccaatattctttgacaaaataatacacctaggagaatctcagcctttcagaaaacaaatctataggaaagacatcttgttgattcacttaacagatacttactgactacccttctatgtactaggcactagccactgggcaaataatcaataagctatatcacatcattactcttacgtcataagtaagacatagatgtcttccttatgtatgtgtatataaaatcatcatagtctgtgctgtgaagaaaagggagtgttaaaacatacatctaacaataacacataatttagcttggcgggttatgtgatttttttatcacactttgtggtgaaaatagtttacttttctctctctctaagagtcccaaaggaagagattgtgtattgtttaccattctatattcattttaaagcacagcattgggaaactttattatttttgaatgagtgcataaactaatctagaaaaacaaactgagagcacataaagtcagtgattcatggagcatttattaactgaagatagtgctaagtctttcctaagtcttaaagactcaaagtgtaaactgcagtataattgtggaaaccaaataatggaaaattattctttggaaatattacctgcatttttcgtaaagcaggcattatttctcatttttaaaatgggctttattataatttccaagtcaaaagggtgaaattcctttctgttttagataaacatagataagtcaaattaaaatatgagacaaaatatacagaaagataattcattttttccctcaaaagcaaaggaagttttaaataacttaaataaatttagaaaacattcattgagaaagagaatatacacagcagcatgaaaaagcatttcacattggattccatcattacatttatgagcttctaagaattcacagattataagcacattatcaaagtaatttcttaaaatcatttgtttatatatttataaattgccttaaggaacaaccagagacatctattcaaaaatcgtatgtacagcataaagcactaagcaaaagaaatagattctggccaagttaaccaaaataaagaaaagtatgaaaggggatataatgtatttgaagactattgggttaacttacaataaaataagggaaaataaaagccttctcatgtaaaatccaaggtacttcttgtgattcaaacggtcatttttggcagcttgatctgaatcacctgaggtgcttgttaaaaatgatggattcttgagttccagctcataattactgaatcagactatctagtaatggcctccaggaatctgcatttttaaccccatcaggaaggataattaagcattttaatatttgttcttagagtgactctgctccaaagtttccaaatacaatgtttttctacaaatgtcaaaaatttgggggagattaaactacattttccactccaagttgcagaaccgtctctatcttcatgtccttataggatacatattatattacactgtcaatggcattatttgtgtggatacttctctcttaagttttccataatttatgagcttatttagactagcatcttgatagtctgtgtataccgcacagcacaaagaacaaggacttttcacgtttatgtgcttaaatgttacttgaattgaatgacattgataacatacaagagtaatgacagttttatgggtaagaatattacattgaatggacttcttggtgtgtgcataaatttaaaattgtaaaacttattctgagtcttattagttcattttatacaagagtaaaaaatgacagcaggctcatggttaaatttaatggaaaccagaggtccccagagaatcaaagtcataatcaatcatttcttttctcatatatttagtaaaatataccaagtttcaaaatctttttatttctctgaaaattgcatttgagattgattaggtcaggagctgcacacatttttaaaatcatttagctgctcatcctgatatctctctgagaatttctgatattgattagaaactgcaccacttattgaataagatataaaaacgataattttgtttttgacaacacccgcctgtattaatttatgtgcaaaaagacagctttccttgttaaaaaaaatacattactataaatataaataatgtaaaattcaagactcagagcaaaaactccttctctctgtgctgtaacttaaaaataattccccaggaggaaagggctctggttatttggacagtatatgtgagatgcagacatctgttaggatattttttcccttatttttttaaaaaagtttttgcattgtagttccaatctctccaatacgtgtcatattcacatgaatagctgtctttgcaaaattaaacaaatgaataaataaagccctgaagactcattattaacaagtgaccatttgtttcaaatattgtttagctaaaatagatatcccatataaactaagagttaatagaatcacaggggcctttaataaaattctgtaagaacttttgctggaaaagctgaatctcctaaaaatcccttcttttgatttttataattcataaattttcttttgatttggtaagcaaacattatcatttggtaataattattttgaaaataaacatttttattacatgttattgaaaatatatgttaaatgaaatgcctatttaaataaaactaaatactgtactaaaaactggaggcctattttatgtgatttttttaaaaaaagctaatttgataaaacattttatactatattttcagtaatatctatagagaaatagctgcagtaagttcaaataacattttaaaataaactagtttgactgaaaatatttgcctaactttattaaatgaatctattataatgatacataagcatttttaaatataaatgaaatgaactaagaatacaattattactgaaaagcaagtgacagtaaaagaagctatcaaactttacattgtttgaatatattgaaccgcctcttttttgacttacattgttcaaatatattcaacagcctcttttttgctgaaatttcttggcaagagttcattaataagtatgtgatgaatgtaaaataagaaatattcaaagtgccatgccttactattttacatattggcctattttataattcagagtggtgtttggtttattcaggctgctattaaaaaaaaaaacatgaactaagtggtttataaacaacagaaatttacttcttataattctggtgactgggaagttcaaaatcaagtttgctgacaaattcagtatctgctgaggcctacttcctaaatcataggtggccatccttctaccataactttacatggcagtaggaaagagaggactcccccttttataaaagcagtaatctcatttattgggggctccatgatctaaccaccttgaaatgctccacctactaataccattgctttgggggtaggattttcatatatgaattttaaggggatataaacatttagaacatagcagccatttttatcaagtagtgtttattatacatcatgaaattcatctccattcaagacaaaagagaactatgtttctgtcactaatttattggcataacttattttattgcaattcacaaatattgagattttttttttgcaaagggaaggtttgtgggaatcctgtatcaaatatacttatcagtactattattttttattattttttttgagacggagtctcattctgtcacccaggctggagtgcagtggaatgatatcggctcactgcaacctctgcctcctgggttcatgtgattttcctgtctcagcctccctagtagctgggattagaggcatatgccaccacgcttgcctaattttcgtatttttagtaaagatgggattttgccatgttggctaggctggtcttgaactcctgatctcaaatgatctgcccacctcagccactcaaattattgggattacaggaatgaaccactgcacgttgccttatcagtgccattttttctaacatgtgcatacttcatttctctgtgatacattttgttaattctcacaatatttcaaatgttttcattattatatgtgttatgttgataagtgatcagtaattttttatgttactattgaagttactttggggcactattaatcacacccatacaagatggcaaacttaaataataaatgttgtgtgcgtctgactacttcaacaactggctgttctctagctctctccctctgctaaagcttccccatatcctgagacataacaatattaaaatgaggccaattaataaccctacaatgacctctaagtgatcaagtgaaaggaagagttgcacatgtctcactttaaatcaaaatctagaaataactaagcctagtgtggaaggcatgttgaaagccaagagaggctgaaagctaggccttttgcaccaaatagtaagccaagctgtgaatgaaaaaaaaaaaaaaaaacttgaagaaaatttaaattgcccctccagtgaacatgcaaattgtaggaaagagaaagagaaacagccttattgctgatagagtgaaagttttagtaatctggatagaagatcaaataagtcatgatagtccagttaggcgaaacccaatctagagcaagaacttgactctcttcaattctgtgaaggctgagagaggtgtcaaagctgcagaagaaagtctgaagctaggagaggtgggttcatgagttttaaggaaaaaggctatctctaaaacataaaagtacaaggtgaagcagcaagtgacaatagaagcagcaagtgactgtagaagctgcagcattattcagaagatctagctaagatgattgatgaaggtgactacactaaacaacacatttccagtgtaggtaaaacagctttctgtcagaagaagatgctatgtaggactttcacagttagagaggagatgtcaatgcctgaattcaaagcttcagaggacaagctgacactctggttaggggatgatgcaatttgtgacttgaagttgaagccagtgttcatttaccattccccaaatactaaggcccttaataattatgctagatccagtcttcctatgctctataaatggaaaaacaaagcctggataacagcacatctgtttacagcatggcttactgaatactttaagcccactctttagacctactgaccaaaaagaaaagattcgtttcaaaatattactgtgctttgacaatatagatgatcatgcaagaattctgatgggagatgtacaaggagattaatattttcatgcctgctaatacaacatccattctgtagcccatgaatgaaagagtaattttgactttcaagtcttactatttaagaaatacaattcataatgctatagctgctgtagatagtaatttctctgatggatctgggataaataaataaaaatccttctggaaaagattcacaattctagatgccattaagaatattcaggatttatggacagaggtcaaaatatccacattaataagagtttggaagaagtttattccaatgttcacagaagactttgagggattcaatacttcagtggaggatggaactgccaatgtggtggaaataatgagaactagaattagaagtggagcttgaacatgtgactggattgctgccatattgtgatcaaacttgaatgaatgaggaattgtttattatggatgagcaaagaaagcggtttcttgaaatggaatctacttctggtgaagatgctatgaccattgttgaaatgacaaaatgggatttagaatattacataaacagttgataaaacagtggcaggatttcagaagatttacttcaacttaaaacaagttttactgtggatgaaatgctattaaacagcagcgctataagataaatcttttgtgaaagcaagagtcaactgatgcattaggaaaccaaaaactgtatgactcgctttattgctatattcgctttattgcagtagactagaatcaaagccacaatatctctgagttatgcccgtattttaacaattttatgaagtaaccaatgcgaacttaaaacaagatgaaaataaatttttcctacacagaaatgaaactatgttagtgtactagctaattaattatattattagttagtggcataaatctcaagattatgagaaacttgatagaactgacctaagtagagctaactgcccacctcccgtgggaaaaaaagaggaatcataatggctttcctgattacatttaatagcataattctgactgggaattacactttgcactacttttctttgtcttttttgagcagagcaggacctgtactctggaagcatctgactggaatgaagaatgaggagagaaagcaaagatcagttgttgacaggtagattaatttatagctgtaatggaataagaaatgataaggggaataagtaaaataaataacccaagagaatcaagatttaaaaagtcaagcaaaacacttattgctaacatataataaagataaaggactgttagttatgcaagagaagtgtttaagcaatatagtctcctgaaaaataaaggatattttaaaagatatactattgtatagattaattagccaacatgattaatattttttaaaattcccactaagttattgtgagttggacaaattatttttagtagatgataaagtaaataatattttcaacattattctgggatgtcaccacaataagtgatgcacaatccttggagacactaccaaactctttgttccaggtgatggtgtataatagaatctccttccagtaaaataagtgacatccttttagtcctctattgctaaatttttttaaaagaaaaggaaagaaatacagtaagactttctactctgaactgggcaataataaaaaatgtgctgcaagttttttctttccttctctataaaaaaaatggcaatgcaaattttattgttatttcaacatgccacaataatgtacaatcattatgaagaaatgatctcagtttaaatgctacttccccctttaaggcattaaaatagcacagaaaaatttcagaggaatcaagttaaatctaggtcatcaacagaatatatggctggtttcatgaaatggccccaatttgtgataagattgatcatattttaaattagtctgtagcctcaagataattctccagaatgccacaataaatatatatgtctttatatgctgtatatttattgtacattagtaaaacatgaattattaaatacatatttctataaatagcagctgcatttatattacagcatgtctgatattagctaatatcattgctttaatatagctgtattaatacatatactttgtgttcctatctccttcatattgaagaatgatgtaggtttatatgttgtatatgctttgttatgttttatggtgagacaatataagaatatcaagggaaaaatatgtttaaaatcattagcaatgtcaaactgaatgagaggacacattctagttttataaaactaatgatttctcaccaggcctaagactttaatagttgagatgtggtttgtcatcttccatttcatttaaaaatactttggaaattgtccatttgagtgagttaagataaaaaaaaacctttgaggcttaaaaatacccttaatttaaaactggatatcttaaaagagaataagacttttcaggaaggtactgctctcattttaaaacaaaacaaaataacaaaactgaggcccagatttaagtcgctgtaattcaatcataaaattcacttagaaaaggtttgatcaataaatcaataattatagaatttgcctaaggttataaagcctcggtggatgagcaattcattcctatatcacataattattaagcattgattttaatccaggcaatatactgggttttatagattcaaagataaataataaacattcctggctttcaagaactgacatgagaaaaagaatacgtaaagctactgaattagaatgcaaggtaatagagaaacccaagaaaacctaaaacttaagtcatattttgtcatattgctctttaaagtccttaactgacttccctctttttagagtaaaaatcaaagtttgtatgatagcctaccaggtctttcatcagctgcctctatgccttctttctgaacaaattcacttttgttcatgtttttttcactggagccacccttcacctccatttccatttcttgacagatcaaacatgcccttcttaccttcttctaaccacctggcaaaaatcatcatttcttctcttactatacccatatattttatcatattggtcaggtaaccgaagcatagaaagatgacataatttcctcaaaattatagatcctgtacatggttgagccataatttgcatacgggagtctggtttcagatccaacatcttaactgctttattttaaaccattttgttttactgcctcactagtaggggaatccaaaaagaaaagaaaatgcagaccatttttaaatggtttctctcaagaggtttcctccttggctttgggttagaagggaataattggatacaaaatggagggagagggggttgtaagtgacaatatggaaaacagagtttggccaagcttagaactactgccagatgttaccagtggctgtgtctccaaagaattaaaaaccagtaatatgaaagtacctcactgtaggaagggtcccctttttaaacgaggcaactctagatttcaataagaccaggccacaatagtacttgtagcaagagaaatcaagagaagagaaccatgccagcattaatatctttcctttccctctacaggattggcttaattagtgggtgtggcaaatgtaaatataatgattcagtaagcacaatcaatgttacactattcccatttttaattatgtatctctgcatggtacctttttcatgttggtcagcccattaaatcaaatatttaaacaaattgaagatagcaacaaagttttgaattactgtagtagaattaattcaaagaaaaaaagggaagacaaagcaagtttaattatagtgtattcgtgaatcaattataataacttaaatatgccaacactttagattactaataatgcaacattaagaatcatttatttactgtgttgctttttattctacattttatgtgtatgtttataatttaataacttctattagtaggatctgtcatgcacataatttataaattacatgtattttggaaatatatgaacaaaaccttgtattgaaaggagatcaaaatcaaagaagtttgaaaagtgttggcagaaggctgactaaatagggacatagaatcaattgtaattgagtcctaatagagacacattcaatctatatagatatatatgactttgaaaatgattttgagtgcttttaaaacacttaattgtattataatttaataatttaaagtagttatctcctatttgagttgatagatatcagaaaatattaaagattttgtttataatttaaacaaaaactgattttgttgattgtatttatgcttaaccttaataaagtggcaacttctgagtgaaacccaaaatacagttctaaaataatatttttgtatatgatttgtacagaatcgttacccttcagctgtccagtaacaacatttaaatctatacaagaaatctttgaaaataaaatccttatgatgcttgtcagtgcctgagaaatggatgtcaagcataaatctattaaataaatagatatcatggattaaacggttcttattttataacattatgaatttcatgtcggttttatttttcctccacactgatattctcgattttaaaaagataaagcgttcatattacgcatcatcttttgatttactcatagagtaccactgaataggaattagctttgaaagaggtcatctatgggcaaaatgtcaacaggattgctacactgcctagacagaataatgtacaatatgaagtaagtgatttaattaactgaaactgtctcagtagagtgcacttcttatctagtgaagacataaaaaagatagataactgcattatgtcaattaatctactcatatttcagggtgaatataagaaatgcgggagcatatgagctatttgtgtcaggataaatagataataaatatatatagcttcactcaattgagtcaatacaaccagttttccccccacacaaaacttatacttttgatgtttccactcataaacaatgatgcttccaacataatatttttaaaaactcttattacaatttttaaaatcattatttaaagatatttggatactattataaagcccatttaaggatttctcctactttttacttctgttgtactagtatgtgttaatggggttactatgaagtggatatgctgatttaacaacaggtgctgaacattttcttgatgaacattttctaggtaattttttttttctgctaagttttaagactcaattttgtggttatttctccctgttttaaacatggtgagataatctcctgtacgctagtccttaaacagaaaagtcataaaaccatgagtctaaagaagaccagtctttggcacaagtttacatgactttgtagcatttaaccaccaagctcttaaacacctggcatagagcatctttatttagcaaagtgaggaagcagaaaagtagagcgctgtctaaagtaggcagagactactcaactccaggaatcctgtttgtattagaatcccgtctggaattacgagatctgattattcaaaagaaaatgaaaatcctgattcttatatgatgaaatgtgtccattattaaattttgaaaaatgattcaaacttaaaacattgtagaccaactaatgaaaggcaaactggacttctgaggtcagatatagtctctgggccctccagataaactacccttgacatctcccttccaatcatgtagaagcagagatgaccccattacagactgattctcccattggatggcttttcttctaaaggagcagagaggttaccaaactatcaactgaaaactaaaagacatatgataatattttccacaccatttttgtgaagaaggatatactgatgatgactgtcttggtagtaagatttgaaattactttttaaaaaattttaattgtatttgtccatatctttttaaactgcctacaaaagaacatgtattagtttttcactcagatttttaaatgttattaaataattatgtaaaaattaaaaaaggaagttcaatgctctgtaatcaattttcgtgtacaagaaaaacaaggcagtggcatcatttgaaaataagaaagaattagctagctatacattattgatagacgagactattttaaattgtaaatttatttatgatgggtttgtaatatgtcctacccaataaagacaactgaactccctctgccttacagtgcagccagggacatatcttcttagtgaacttatttctgtgatacgatccaggttttattcttatccatccctccagcagccttactgtagcaaaatcagtttcttgtaacagaaataaaagtttctttcttagcttccggaaattattgactttcaagaatttttgagattctgcctccctttaacaaagtacaaataaacctctttttaacattcagacaatctaaaaacttgctgaaaatcagacaatgaatacctattggagcctcccttgacatatattaattttctggtacaatcttttgtaaatatttaataattagctcctgttttatgaatatgcagatgtaggacaagccttatatgaataggtcctggttgtagcaattgaactgatgcaatcacatgtcatccctgaaaacaaaagcagatgccactgaagaccatccttgtcaaaatatttccacaagcctgcgaaaggtcttaacctatacaaatgttatgactttgcttagggctgtaatttcttctttttgaactcaagtaacaaaaagaggatttgtcagttgaatgaataagaagaagtagcaaattatttggggatctgactaattaagcctatcaggaagtacctcaggcagtgtcattatttgtttagctaaattgtcagtctagacaatgagggagtaatgccttattttatttttcctcctctatgatattttgctcaactgcatattctaagctgctctagaagaattcacttagaacaattctatcttcttttattgaaattaagtcaaactctaagtgaggtctaaaaataaatttaaaaaaccttttttacaaaaagataagaataacagtcatatagtgactgaaaaaataaatttctttaaaataaagtctgatttaattagggttgttagacaaactattggacacaatatgagtttcagagaaaaactgattcttttactataaatatgtcccatgcaatatttggacatctgtatttttgtttgctgaatctggcaatcttagactgaatttatgttccggagaaagtgtagagtaagtatgtttaaaagagggttcagaagatttgtataaaaactaactgtggaagtcggcctcagctctttagatatatgcctgttctgccacaactgtccagcagtctgctctactcagctgcttctacttatcacgttttccagaatccagctacgttctgtcacagctctccatactcatatctcaatgtttactgagaccaagttttgatttatcattatcatatggaagaatctatatcagataacttttttaaacttgtttattctatttctcaatattcaagcaaataaagggttttgcaagcctatattcccatccacaaaggaattgaggtataccttaatttccattataagaaaagaataacgattaaaaaagaatatagaaaaaaagaaaaacttttatcagaaggtgccaggcttattattcaaagaaatcttgtttcatttcctttgctacatctatcttttttctataattttcatctaatgtagcaaataaaatatacacatatgtaaataacacatacaaattcctatgtcaatttattgtataaatatcactcacagaaaggtgaatgaaaaggcagtacaaaataaattcactttatttcacaattttaacttgactgccttgaattattggaagatcctttaagatgtatactgtaaaggcagtcctatgcaatttttttttttctaatacttcatggtgtttcctgcaatgtttcccagatatctacacaaaaattataataatacttactatggtttgtttttactttttgtttctatgtattaggttcttcattcatccaattgtctcctcttagaaacaattataagggccaaattacagttagactaatacacagtaaagttaaaatgttttgcacattatatttcttcaccatttcatactattaattttaaattttagttaaaattgatgtattttagaaatgtttttagtttgtctcagaatatatatatatatataactcagaccaaaaattctagtgtagttgttctgtctattccatttattatatttaagcctaaagaaaaaccttggtggcaaatgacagaaatctgttgattaagctcattgaattggcaaaccttaagaagagagtactctctttttccattagaacatcacctttctgatggtaaaagtgcagtaattgatactgtttgggagaagtgactagaggtctatatccttaggaaaagatttcaaaagctttggattctgttatgttttattatcaatatatttagaattctagttctaaattcccttcaactccagttattctggcgacaagcagcttttacttgtatttcaatctctgtggctaagtcctatcacctgttagcagatgatttccggaatcatcaggttcttgctacacctctcagtgcaagcttccatgcagataagcattggctgggtgcagaatgctgcgtataaaatgcttagaaacataaatcactgtggctatgcacagtccaatacttatgcactatggctctgcaactgaattctctgtgggggatattaaaaacacagagtctcaacctcaccttctattcactaaatcagaatccccaaagcgggaataccaaatatgcatgcagtttataactggcacaggtgattctggtgtattgtagagactctgaaatactgatttgctcttggaatccttgtccttccttgttttgtgagtcctgtgggcagctgaactcaaggtctgatactttcagaggtacagcatatgtaggacagaaagggaatcttgggggaggcatgacttgtgctgtatattccccgtgtctccttgtgaaacttgcttcacttctatgaacattacatttttctctgtgaaatataccttctatgatataccagtgaactataaaagacatcctggaaagacacacctcagaacaaagtgggatttatattttctgaaaagcaaactagtccttgattgtatatagtaataagaatttaaaaaagcatagaattggtaataacactctaaacccacatgtatgtgtaaattcattttcatatttaatacacttgtgtttaatatagtgttatatttaatatacttattgtattaaatatattatgtttaacatgatatttaatatactcatccacatttatatccacaccaatcccattggtctcttttgagtttttgtttcaggcttttttaagaatgtagggcaaagttttggtcttggtcttttaagcacagcagctacaggaagggagattttcttgctctgagagggcaaaaaaaaaagaccagcaacttaaaccaggggaactgacctaaaaggctgtgccactgataagattcacttggacttagccagattagaggcttgatacctggagagagagagatcaggctgaggtgttttgctttgtgtctatcagatgcagagcatttcagcagaaatgcagcaatctcacagcaagccttaaaaggtggcccaagagcctcagcatccgatgatatcatgtcaaacaaatgctatcatgtcaaacaaatgctatcagcatctgggaaatctctggaatctgggcatgagtatagactctgtgagtttcttactctatgaaaaaatctaaaaaaagttaaaagacgtacaggtaaacacctgaccattcatttcttctttccttcctttctttctctcttcctccttccctccttctctccctctttctctctctgtctctcactcagcaatctgcaatgtttcaggcattgtcataactcagccttgaggatataataattttaaaaaatattatagagcataacctcatcctcaaagaattgacattagtggttaaagtaaataattaaaccctgacaaaatattgttaagagttagcagtcttcataataggtattttattttgtactttcttcaaagttttcatgtaaaaatataagcttatatattatttgatatgaaaatatattaatatcaaaacacatgatcagtgaagaaattatttttaacacaaaagtgactgaattacagctcacttccatacacttgaataaaataccctggcttggcaaatcagtgtaagagctttagttcaactcagagaaacactaggtgcaccatagttaaatcattataatcataataaaacatggtatatatctattaatgccttgtatgggacaggcattatgttatagattcaacataaagtaaaatacatgaagcattttacatttaatttgtgtaacaattccacagagtacctgctatgaatatgtttattattaaaattaactgactgaggcttagaaacgttaaatgacttgttcaaggtaacacagctggtgaggccaaagctatttatcccaaaggccctcttctcttctataagcagacttttggttttaaagagcacactacaaaatttaaccctactgtagtcaagatgatgccatagatcattctctatcagttcaaatcaaggttcttcatcaatttacaggaagaggctatttactggctagctgtaatatatatatatatatatatatgaatatatatgagaaacaggaagaggctatttactggctagctgtaatatatatatatatatatatatataagaatatatatgagaaacatgtaatacataaaattataatatatattatgttataatatatcatatattttatatttaagaactatgtaatgtataaaaattatattatttaatttaaattaaataaatataaattaaatataaattaaatacataattataaaaattatattatttatttttatacattaaattttatatcttacatatttcttatgtataaattataatataattttatattatatataattgtatacattatatatttcttataaatataaaaatatataacatagaatatatattcatacacacacacacacacacacacacacacacacactcacacacactataaccaagacaggtttattgtaggaagtagctggtttcagctcaagagcttgattttagaaaggtgttaagctctatttatcgtaggatggttggcagaagactaaagaacagagatacacatattctctatttgtgtaggtacacacaaatgtacaggcatacttgcacatgtgcttgtttacacatgtatctatcaactcccaaatcctaaatttcctatttattttttacttttaataaactacctacagacaaatgaggtggttagaaataaacagggacttagaacacaatggagttatttactgaggctattaagttaataaattgctaaaatcaatctgttctgaaagaaagtgtgattttatttctctatgaaccccttaaatgcatgatatgaacacagtgtacacaacacagcggtttttagaaccaatttttatatggtcaactaattaaaaatggtatctaaatggcatataaaatgttttctaggaaaaaaagtggaattcctgtagaatgtaactattgattgatttctcagaaataaattgtgaagctcagagatgagtcccatttatagttatgtaaatatcacaaataataacggtaaagtgcagtgtttgttttgaaatcagcttaatttgtctcataattctttcaaaataaattcatttctttatgcactttggctaatattggaaatggaaatagtattcaatcagttctaaatcattttttaagctagataatttctggaaagtgctgacttttgttagaaaatctgaaaatggaaaattcctctcagtgatctgctatgtcttcacatattatttatgaagttaatactgcttcatggatttcttaaatctcaaaattcagccatctgtaaacctctcttctctgtaatgaatcttggaataagaaagaagagaaaatatgttttagcttccagaggagatttctgaagtccaaagcattaaagctcacatacttgtttactcaggtgaatcaacaagtctttttctcaggttctgtttgcttttattttgcatgtaatcctgataaatttaatcagtttcagagccatcataggttcaaaacaatagtttaaaagggaagaaataaggttgcttcagataggcatagtaactatgattaaaactgacaattgagggggaacatattaagataattatacaggtcatcagatgagggaatttaagttctattttagtcttacatcatacagggaaaagaattccataatctagtttattgtagaaatgacagaaagctgacctctatcatagttaaccatagttataaatgtaacattaaattatgttcaataaattcttaaagggaagattggtataataaaaagtagagatctgagtaatacattgtaggcagattttattctatataaacatagcaggctgtttaaaatgggcatgaccaaaaaactttattttgtgttacctagtcactgcagtgcctcttttaacaataggttttgaagttagctaatacatcaaggtttagttcaagttttggctacataataactactgatgatgttgcagcaagagatttaataacagatttaagtgaaccttttggatatcataataatcaatcagtcattgattatttttaatatgctcataatgatttcaaacattatatccagcctctaagagaagctataatttcatgtatggattttctgattagtaaatgccaatacatagggagactaacacttcactaatttattacaatagtgtggagaaaaccatatattattatctctcccacaaaagaattggaatagaataaatagactttattctgcttgtcttaaagacaaaaacattaaaaccgaaggaggaatccacaagaaaatagtacttaatgaaggaaagatgctatgaaatatgctgttaaaaacagagaggatgaatcagttttatcattttccaaatttttcagatcatccattatttcctctttaaggtactaaataaattgtgaattatcaatacacatgaaatagaaatctctgtgctttactcagaatatcacaggaatttagagctagagagtgctatctagataactagttcaatgattttcaaatagaagtacacatcaaaatcacaaggcgttataaattatctaaatgcctggacccatcatctgaatcagaattttaagcacgtgtcttttcaaaagcaactccctattttagaacaattgagtccagctcctacattttatggaagaaactgataaacaaattaaaatgtctaataataggtatttgcttatgcatattttgacactaaaataaaaaggtatatagtctttaatgtaataaaataaattggtatatagtaaacttgtatgaatactataagaagttttcatttcgttttatgattctaataaattggctagttgtgaatcatagaacaaattcatgtcaaagctagacaatcttcaaatgctgtctctgctcttttaagttctctaagcttacaagttgtttaatctaataaaaataaaaaaagttaagaaaatatttattcttagaagtttaacattttagactaaattccatagaaaccattacttaaaagcaatattaatataaaatatatccatttaaaggctatatataagagctaagatatttcaggatggattaattttgtcacactccaaagtatctgagaaattaatgagaactaaatgtgcttttgtctctctttttgctacaaaaattgaatttttcctttctttaggcatattcagatggctgtttgtgttttgagaattctggaactccggagctctgatatgagtcagattctctgtgttaatttccaacaaatgtgattaagcaaatctttatagagaaggaggatatgaaagaaatgaaggctttagtatttggacagagagcagttggattgattccgcactgatggggagtttgtattcctggagaaagaagagaacctagaggtttttgtggttccaacttggtatactgaagggacaactgggacctgaccactgattagctaagcatcatgcccttgaaggcaagggtacagagaaggtcctgggagccacatttggtatgcaaggattgaaaccatttcacagattaacatatttttgaaaggagcatggagataccatataggcattttattaggagccaagatgaactgtatagcaaaggctgttccccattaattctggattgatccacctccagtgtttactcaaatcccaagggaaggaaataagcgactctcaaataattgacatgtaccacattttcttaatccagtctatcattgttggacatttgggttggttccaagtctttgctattgtgaatagtgccacaataaacatacgtgtgcatgtgtctttatagcagcatgatttataatcctctgggtatatacccagtaatgggatggctgggtcaaatggtatatatacaccatggactactacgcagccataaaaaatgatgagttcacgtcctttgtaggaacatggatgaagctcgaaaccatcattctcagcaaactaccgcaaggacaaaaaatcaaacctgcatgttctcactcataggtgggaattgaacaatgagaacacatggacacaggaaggggaacatcacacactggggtctcttgtggggtggggggaggggggagggatagcattaggagatatacctaatgttaaatgacgagttaatgggtgcagcacaccaacatggcacatgtatacatatgtaactaacctgcacgttgtgcacatgtaccctaaaacttaaagtataattaaaaaaaaaccaaaataatgaaaaaaaaattgacatggattttcaaccatatggtggatgaaagtaaaggtagtttttttttttttagaagacatataaattcagtttgtttttgcatctgaatgtttgggggaaaagttaaacctgtagtatacgtgtgtgtgtgtgtgatgtgtgtgatatttatatatatatatttatatattgcagagttgttccttccacattagttctactgcactatttttgtttcccctgctgttatcaaaaataagcattcattattcatgtaagataaagaggaaaacgaaactaaaatgagaggggaaatactagattaatttgatcatacatatttaaataaccacaagaaatagttattctcaaatatacataacaaagttacactagggaatagatcttactatacacattcttaacatttgtattttattatatgctagactttcaaaagattattttttcctcctattgttttcttagatttactgaaccataaagaaaggaaaagaagaaaactggctcattgttacaaatcacttcctactgtggatttgaagtcttcttattttctgcttttcatctaaattcagcatcatgatgctgcaatacaatcaaaagaaaatgctgtaaatataaaaatgttaatttaaagctatacacataccaggttcaaagaagatgcaagccacatgtcagtgggattgcctgggttcatctggacagtccagctcatacaacaagcaggccggtgactctttaggcaaatgcgaatgttttatagattaaataaatcatctttctgtttttttaaggttattaaatattctgcagaaaaatccaactctgtgcctttctaattttctcttccacttcaaatccttcacattttatgttttttcttttaccaatgagttagtaaaagcaagtaaatataaaactcaaaaaattatgtattatgtctaatccaggctttattttaaaaatatgaattttggctctttttatatgacttagtatctttgtactatttttgttttattattatagaatgcattgttttccaatagtatactatttattcatacacaaaaaggcaatatttaacaagacatttgagcaagaaagcattaactcaaaattcagggctcaagcctacatatattccatcggaaggaccggccctttactggctcctgggagataacctctgaatttggaatatcctgacagataataatgtctttgatacctgagacctcgagctgtgccaaatagtttatgctaattagatgtgatttatgcttgcaaccctttttttgtatgcctagggctttggggcatgctgcatcagcttggcccctgcaggagctggagactgattagctaaggtcagttatgcaggtgcttcatgtcatcatgactgacctacagtgaaaaccatagacaacaaggcttatgtgagcttccttggttggttacactttatatatgttgccctacattgtttctgagaaagtattttaagtacttttcatgcaactccaatgggagaatacacctggaagactgtacctgctttatcttagactttatcttatgtgtctttccctttgctaattttaatctgtaacttttatagtaataaatcctagcaaaaagtaaaacagtttttctgagttcttcttatacattatcaaacctgagggtagtctttaggccccagacacaatatctgaaagctatgaaatgctttgagctttaatattttaagcaatttgtggtctccataacaccatttcttggaaggatatcaccagtatgatgacatttctgttcttgaagttgatatatgacttacagttaggagttagataatttcaatagtctccttatgttaaaatatatttaaaccagttaataagatgagaactttatctcttcttcaactttgcttctttctgcttcccccccgccccatattcttattatcacaatttctggaaacaggagtcaagattttaaactatactacagttagttggaatagcttcttagtggcaattcataaaatagataaatgagacaagaatatccttggaagttctgttatttggtataaggcaagatgtaaagttgtactccttgacttgtcaaatgactggcttaatgtcccacagaatatctgtggcagtgtcaggtctgaaagtggaatcttatattacaggtatggggttctttcttctgtaataaactcagattattcctgaagttactgccaaaatcacaacctaaaataaagcgtaattacattatggatgtgtacattagatgatttacctgcaagtaaaaggaactctgacttcagtaatattaaacaagaggccataaggatcaaatatattaggtccagaggttgggcaggcaacctgagaggttcagtcaagagttcaacagttgaccacaggccagatttcttttatctctaatctctgctgttttcaggacactcactaataatagactaatagtttattatattattatttaagtagttaatagtgatagtctaatcaactatacccccccatcttgctttagggcctcaaaatggtaacagcaactacataaatccagatgttagaaggtataggagaggtcacgcatacttttcctcacattctaagagcaggcgacgaaatctttcctcagaaagaatgcctcccttgcctcagagaccagcatagtgtcacatgtccacttctaaaggaatccccaagagtgggatgtgattaacatgactgccttagataaagcatgagacatggaccaagacaaagcaaccagacaaccacaaatacttgaaaagtggctagacaacctctggagtaactctgtttctggtcatggatatgtaaatgcgagttacagttattccattaggtatctgcagtccttgtgggaaaaaacagtttgccacaaatgttccttctattgtaaaaacaatgtcagtgcactgacagtcaaaatatgtggtggctgaaaccatattttggcttttcaaaggtttgcttttaaagctttgttttctaacttcaacaagtatagtcttcttgcaaatatcagttctgttgttaagtaacaaactataagcctggattagtattgtagccctgacttgtgttgtatgttgcttattttctgaagccagtcagtgagtgagtccaccttgagtaggtgtttttatgtcaggctttgtgagaaatgaggagccggaggggatcccaaatcaattgccaaccatgtcacagatcatttaaggcagaatggaacatgcttgtgacaaaggtgatgacaaatgaatatgtactgaagggacaacaccaacagatgagtgaaggaaactggaaatatgtaatatgagatggaggtcagagtgaaatgtaagataatgataatgaaatacatgtgtgaatgtaataccatgagttagataaaaataggtggccgttaagactcacacagtgcctttcagaataaattctgaaattttacacaaattcaatattgccacaagttgtgaatccaataagtgaacagtttgttatataatatttaaaccaacctgtatagagtggagaatagaacatgttttactacctttaagttaaaaaaaaaaagttgcttgagtttctgttttctaaccttgagaagtaagcatatgtaatatatatactaacctaacacacaggcaaaaactcactctatttgtacataggtgttaaattatattagtccacatttaggtatataaaaagccagtggatactaacgagatgcaggtctttgcaggtagaattgtgctcacaggcattcaggatgcagtcatcaatgtcctgttcacatcttatcccaacatagcctggattgcataagcaggaaaagccatcaaccactggaaacaacagaaaagagaaaactcttaacattcctttaaccttagtacaggtaattataattagtctaaaattctataatcatttatgtagttcacttttaaccaaataaagtaagaattattatatttaatcgattacatagtcatctacaatattttctaaataaccatcttattcagttctatttaacttaaaaaaaaaacttcagttagttgaaataagaacaattactatggacatttggtaatagtttgcaaagcaacaatgaaaatatccaattttacttgctctctcttgtttttggcagtacacaatatatatgataaataggttactcttgtatcatttaattttcccaagttgttttaggtttaataaacaagaccttaactgttcagttgttaaagttctatgtatgacagaatatattaaagtgcattgtgatctcaaagttgataatgagctacttaagccttagttaaaaagagctttcacgtttcatcaaaatctttgtaaaataatgatcacaatttgttcttcattttaccattaatgatgaaaaagaatggtgtctgaagcatctcaaggaagtagtgacagtatgaattgcagttggagcaggcaccaatttataactacttgcagtcagtccctgagtccttcattatccctgagatttaccatgaaatctatactcccattatgcctctctgcatgtacttgctattactctcattaaatgcttaggtcttcagtggcaacagcatttttaatgcactgtaataaatgtatctagcttctggatttttgcagccatgttttgtacaacatgtgtaactagggcctctaaggagaacagggcagtcatagacatcaacaagagacaagtgaaatacacaagaataggcagctccttagacaggattttacttctgttttactttccttttgtatctagcacctagtttttaacctctcattgactacaaattgttaataaataaacagatgtaattgtaaatgaattaatgtgataaaatgtcagtctgtgcttctatgttacacatggtattttttattttaacatattaaaaccacatattatacaatatataattaagacattgtggagtgtcatcaatcataacaatatttaaaattatccttatggttattatttaagttgggatactgatgcatactgacaagtaacaactggagtcaaattaactttcagcattgatgttacgtgttctatgaagacaaattataaattacattaaacgcaaaggacaacaaaaggtcactttgaacaaacgaagtgtctggaaacagattgttaaaaaaataaagcatgcttttattgtcaataaatgtgtttctaacatagattaatacagacaaggaatgtgtttctaacactttattctggaataaaaattaataaatggactaagtgccagaagagaacctagagaactaaattggataccaaagggaaatcggatactgcaaagaagatagaaaaaaattaaatatttaaaacaaagtaacaaaaagtagagggtttttctcatatgtaatttgttaaccacggggctatgtgataaccaataaccatttcacaggaaagacatgttatacacatagtcttgctcttgattgttgttgttgtttttaacagaaaatctagtcactgtgatatggaagtgctggaatgggaagagtgtggtccctttaaatgatacagaagggggaagggaagtgctgggtagaggagggcgtggtccctggctagggctccacccccatggatctacgtgaggacggcactcctgcctttatgccagaatgttgcatttcccaagaccaccctgtcccaccctgcccacatcgtgtgcctataaaaaccccggagaccctagcaggcagacacacatgtggctggatgtagtgagaaacacatcaggggaagaagacacagtggcacctggacattgagaggcacacatcagcagaggaacacacaggtggctgcacatcaggaggaacgcactgacaagcgccggcacgctggagctccagaacaacatggagttttgccagggcagtcagaggggagcccaggacgccgagcaccccaactccaagggaaaaccacctcccttctggcttgcattgtctgagagctacttccacccagtaaaaccttgcactcattctccaagtccaggtgtgatctgattcttctggtacaccaaggcaagaacccaggatacagaaagccctctgtccttgtgacaaagtagagggtctaattgagctggttaacacaagccgcctatagatggcaaaactaaaagagcaaaactaaatgagcaccctgtaacacacgcccactggggcttcaggagctgtagacattcacccctatgcactgcggtggagtcagagctccacatcctgcctgtctatacgttccgctagaggaatggggcactgaagaagcgagccactccccctgtcacacaccctgcaagggggaaaaaggacctttcccatttcaactgcattggtattagtctgtgtttataaatatttcatactactattttgaggccaaattttcttaaaataggccttctatgaatctggatgtattattcattttatgcttaaatgtgtaccagacatcatatatactggttgtactgaatgaaagtttgtaatgtgacaaaactttttggtggaatatacagaggtattttaaaactgtaacagcaggccaggcaggtggctcacacttgtaatcccagcacttcgggaggccgaggcaggtggatcattggaggtcaggagttcaagaccagcctgatcaacatggtgaaaccccatcgctactaaaaatataaaaaaaaaaattagccgggcttggtggcacatgcctgtagtcccagctacttgggaagctgaggcaggacaattgcttgaacctgggagacagaggtcacagtgagcctagatcgtgccactgcactccacactggaagacagagcaagactccattaaaaaacaaacaaacctgtaacaacaaaatggtgaacaaccgtataatggtgttcaagatttacagactcacacacaaacacacacatatatgcagtgatttctcatatattgtcctgtaataaatactattgacatgctagagttccctgatccctctcgcaggacatgcgacaggggtgtggctggcctgctcagttgccgcagctgctgaaaccccttgagggagggggaccacgcagataggcaggtgcagaggccagggcgagtgctttgggctctggacctgtggtagtgtctaggggtggatgcctgcaaccccagtgttacaatgctctcagccttgctgtccgcagatggctttaagggttaaccagctgaatggaccctctgccttttcacaagggcagaaggccagtatgatagctatctgtatcctgagctcttgcctagcgtcccggaagattcgggtcacacatgggcttgaaggttgaatgagagatcttgagtggtggaggtggctctcagcaggatggatggggaagtgaaagcaggggatggagtgggaagataatcttcccctggagttgggccgcacagtggccaaactcctctctgaccactcccaaactcctcttggtattcagatgttcctcctcttctctctttctctgcggaagagtccgttggtctgcctgtcttacctcttcaacttccggttcactctggagtctgaggttcagcatttatctgggtacgggctagggagcatggcaagccaaaaggcaactttttgggtggaaaaacaggaatgcctgttctcatttatggctacgggtatccaggcttgaggatgcggcctttgccagggcatcttgtaccttcttctacccagtatttccgtgtcttctgtctgtattactattaactagaattcaggaagtttagcttcccaaaccattttatttcagagaaagtatgaagaatctagtgtcttagtttcattctgataacattctacatgtgtgatataaattttaataaatattttggttgcctggtagctaaatatccttagatggggtccaaaatatattatgaatgattatattatgaaatacattaatatattaagtattcaaattttacatttcccataatatattatggtttcaaaattttaataggtagtattgcattataagtaacattataaattgcattttcatatcttagaaaaaatcatatattaaaatatttatgaagaacttttaaaagtcaaatataatacattgttaatcaatgtgaacaatttaaatttaaattgtctattataatcattatagtagggctgcctacatatttcaaaaacaaaaaatctctaacttctctctcagccatgcgatattttaaaatgacatgaatcttttttaagtatcattcctcaccagacacctgtgggtttgagctcagaaatgatacaatactgacttacttcaaggtaatttgagaatttcagaaattttaaaatacaatcttggaagtgccaaaatctggaacaaaaataataacttggtgatttatatcaagagcagcaaaaatatggcatatagtccacagaactgttttgctcagctggcacaatgttagaaaattaacgtgatattagtatctatacagatatttcagtttgctagggccccaccactaccttttatatctgggttcttttatatctgggtggcttcacccaatttacaaaattcaattgccttgatattggcttttatttgcacagcacttgttttgagaaacaaatttaaaatttgagttaaatcctactgtttctaaataaaaagacaataacataactttctattgaaatgaggttttatatgtaattttaactatttattcatatattgaggtgttgtgggaagtcagggaccccaaacagagggaccggctgaagccatggcagaagaacgtagattgtgaagatttcatggacatttattagttccccaaattaatacttttataatttcttatgcctgtctttactgcaatctctaaacataaattgtaaagatttcatggacaattatcacttccccaatcaatatcctagtgatttcctatgcctgtctttacttcaatctcttaatcctgtcagctgaggaggatgtatatcgcctcaggaccctgtaataattgcattaactgcacaaattgtacagcatgtgtgtttgagcaatatgaaatctgggcaccttgaaaaaagaacaggataacagcaatgtttaggaaacaagagagataaccttgaactctgaccgccggtgagctgggcagaacagagccatatttctcttctttcaaaagcaaatgggagaaatatagctgaattctttttctcagcaaggaacatccctgagaaagagaatgtgcacctgggggtgggtctctgaactggcccccctgggcgtggccatctcttatggttgagactgcaggcgtgaaatagaccccagtctcccacagcactcccaggcttattagaaagaggaaattcctgcctaataaattttggtcagaccggttgctctcaaaaccctgtctcctgataagatgttatcaacgaaatggtgcccgaaacttcattagcaattttaatttcacctcagtcctgtggtcctgtgatcttgccctgcctccacttgccttgtgatattctattaccttgtaaagtacttgatgtctgtgacccacacctattcgcacactccctccccttttgaaactccctaataaaaacttgctgggttttgtgtcttgtggggcatcacagaacctaccaacatgggatgtctcccccggatgcccagctttaaaatttctctcttttgtactctgtccctttatttctcaagccggccggcacttaaggaaaatagaaaagaacctacgtgaatatcagggcaggttacctgatactgagggatcatgtagaaatatattttaaaggaggtgagataaaaccaaataagatagttttttgcaacacccttctagacctttgtttatttctgtttctcctttttatgcctcagccacattctgtatataatgtcatttcgttttctgtgtctcaacaaaattacccattttaggcatgttcttccacagaaaaatccatgtttccatcttacttttccctctttccttcttttcttcctgtctttttcctctataaatttatatttttttaggaatataaatttcagtaggaagaagtgtgagtgtgtggggtgatatatgtataaaataggctaaactaatgttattttgaatactgtaaacaatgctttctcatgcctaagggtgaatatttttaaaaattctaccatttcaaataaaattgcaaaggttaattctgacactagaaaggaaaagtcacatttcattagatttcctcattcgctgcacttgtgactcacaaaaatataaatgaatttgtcagaaattgggggtacttagtgaagataactgacattgactttgatgttcaagccaggctaaagtcagtaaataatcatggttatatcctaaactctcccattactatgttacattctacaatggtctgctctacaataattgcagccgctgaaggaactcactgtcatagcaatatccatgcaggcaagggctggaactgcactcattgacattgatctcacagcgtggacctgaaaagctggcacactggcaccggaactcaaggggaaacatttccaaatccattttctctccacgcacagctccattctcacaagaatcactagctttgcaaggtccaaattcacagtgataacttggaaaagaaagaatcaaagtgccaatgcttattgaatgaaccaattcttacaactgctgtcattcacctggcatatttcagcataaaggcatccaatttattctctattctcttccatattatcattgtgactctctctctctctccctttccctctacattacaatttaagaaagaaatgttatttatgatttctatgcttcatctaacaaagtaccagcaggtagcaatgataagtgacagcatttttaaaaattatattttgtttcttcatacttcccacttcttgttcaacaatgttctctgaagacattgcaattaagaaagtagattattgggcaaccccctttgggtcccctccctttgcatgggagctctgttttcactctgttaaatcttgcaactgcactcttctggtctatgtttgttatggcttgagctgagctttcgcttgccgtccaccactgctgtttgccactgttgcagaccagctgctgacttccatcccttgagatctggcaggatgtccgctgtgctcctgatccagcgaggcgcccattgccactcccgatcgggctaaaggcttgccattgttcctgcacggctaagtgcctgcgttcatcctaatcgagctgaacgctagtcactgggttccacggttctcttccatgacccacggcttctaatagagctataacacttaccgcatggcccaagattccattcctcggaatccgtgaggccaagagccccaggtcagagaacacaaggcttgccaccatcttggaagcgggtcaccgccatcttgggacctctgtgagcaaggaccacccggtaacattttggcgaccacgaagggacctccaaagtggtaatgttggaccactttcgcttgctattctgtcctatccttccttagaactggaggaaaataccgggcacctgtccgccagttaaaaacgattagcatggccgctggacttaagacttaggtgtgaggctatctggggaagggctttctaacaacccccgacccttctattggggatgttgatctgcctggagccagcttccactttcaattttcttggagaagctgaggaccgactagaggtagaaagcagctgtcccgaactcccggcagtagccggttaagatcatggcacagccagaagtctctacccagcagtcgcccatgcgtgcacccctacctttccttctgacccacacctcctgggtcccgaccacgacttttttgaaagtgtagccccaaaattctccttacctctgaatctacttcctctgatccctgcctcctaggtactaatggttcagactttcatttcttctagcaagttgtatctccaaagggatctaaggaggctctacactgtgtccttaggcacctaggctataacccagggagtcttatccctgttatccctcctgatttaggtatacagctgtctacatgggcagttacgtgggacccgttccccaccacctgtgccagggccccaagtttgtaatggctaagagagagagacggagagagagacaaaaagggagtcaaagagaaaaagaaagaaaaagatattaatagttaaaaaaaaaaagtgttccctattcatttaaaagccagggtaaatttaaaacctgtaattgataattgccactttgttgtcagtgtaaataagggcttagcaaatccttaacccagtaacccacagatgggccaaatgcattcagtcagtcggtagggacaactgcttcactaaaagtagaaaagtaacttttagaggaaacctcgttgtgagcacacctcaccagttcagagttattctaagtcaaaaaaaaaaaaaaaaaaaagcaaaaaggtagctttctaactcaaaaatattaaagtatggggctattatgttagaaaaagctaatgtaactccaaccactgataattcccttaacccagcagatttcctaatgggggatttaaatcttaattaccatacaaaggtccgaccagagctaggaggaactcccttcaggacaggatgatagatggttcctcccaggtgattgaggaaaaaaccacaatgggtattcagtaattgataaggagacttttgtggaagcagagttagaaaaattgcctaataattggtctcctcaaaggtgcaaactgtttgcactcagccaagccttaaagtacttacagaatcaaaagactatctcaatccagactcaaaagttttgctacaccctctctgaaatgaatttgcataagaactgttgtttacaagaatgcatcttgatggggcagctgggttgttgtgaaatactcagaaacccagcccagctctaggactcaccctgagtgcaaaggcaatgttaggcatgctggtaaaggaccactagaatccagcatcctggatccctttttttgtggtcaagagaggcgggtaaaacagatgcaggactgctacataggtgagtgtaactaatcagataagcagaggtccatgggtggttacgcacctagaaaggaataagcattaggaccatagaggatgctctaggactaatgctcatcggaaaatgactaggggtgctggcatccctatgtccttttatcagatgggaaacatttcccccaaggcaaaaatgcccctaagatgtattctggagaattaagaccaatttgaccctcagacgctaagaaagaaatgacttatattcttctgcagtaccgcctggccactataccctcttcaaggggggagaaacctggcctcctgagggaagtataaattataacaccatcttacagctagacctgttttgtaggaaaaaggcaaatggagtgaagtgccatatgtacaaactttcttttcattaagagacaactggcaattatgtaaaaagtgtgatttatgccctacaggaagccctcagtctacctccctaccccagtgtccccctaactctttccccaatgaataaggaccccccttcaacccaaacggtccaaaaggagataaataaacaattaaccaaagagtgccaatgttccccaattatgccccctccaagcggtgggaggaggagaattcggcccagccagcgtgcatgtacttttttctttctcagacttaaagcaaattaaaatagacctaggtaaattctcagataaccctgatggctatattgatgttttacaagagttagggcaatcctttgatctgacatggagagatataatgttactgctaaatcagacactaaccccaaatgagagaagtgccaccataactgcagcccgagagtttggtgatctctggtatatcagtcaggtcaatgataggatgacaacagaggaaaaagaatgattccccacaggccagcaggcagttcccagtataggccctcactgggacacagactcagaacatggagattggtgccacaaacatttgctaacttgcgtgctagaaggactaaggaaaactaggaagactatgaattattcaatgatgtccactataacacggggaaaggaagaaaatcctaccgcctttctggagagactaagggaggcgttgaggaagcatacctctctcacctgattctattgaaggccaactaatcttaaaggataaatttatcactcaatcagctgcagacattagaaaaaaaaacttcaaaagtctgccataggcccggagcaaaacttagaaaccctattgaacgtggcaaccttggttttttataaaagagatcaggaggagcaggtggaacaggacaaatgggataaaaaaaaaggctaccgctttagtcatggccctcaggcaagcggacttcggaggctctggaaaagggaaaagctgggaaaattgaatgcctaataggccttgcttccagtgcagtctacaaagacactttaaaaaagattgtccaagtagaagtaagctgcccccttgtccataccccttatgtcaagggaatcactggaaggcccactgccccaagggacgaaggtcctctgagtcagaagccactaaccagatgatccaccagcaggactgagggtgcctggggcaagcgccagcccatgccatcaccctcacagagccccaggtatgcttgaccattgagggccaggaggttaactgtctcctggacaccggtgcggccttctcagtcttactctcctgtcttggacaactgtcctccagatctgtcactatccgagggggtcctaggacagccagtcactagatacttctcccagccactaagctgtgatggggcgctttactcttttcacatgcttttctaattatgcctgaaagccccaatcccttgttagggagagacattctagcaaaagcaggggccattatacacgtgaacataggagaaggaacacccgttggttgtcccctgcttgaggaaggaattaatcctaaagtctaggcaacagaaggacaatatagacgagcaaagaatgcccatcctgttcaagtaaaactaagggatcccacctcctttccctaccaaaggcagtacccccttagacctgaggcccaacaagaactccaaaaaattaaggacctaaaagcccaaggcctagtaaaaccatgcaatagcccctgcagtattccaattttaggagtaaagaaaccccatggataatagagattagtgtaacatctcagggctatcaatgatgccattgtccctctatacccagctgtacctagcccttatactctgctttcccaaataccggaggaagcagagtggtttacagtcctggaccttaaggatgtctttttctgcatccctgtacatcctgactatcaattcttggttgcctttgaagagccttcaaacccaacgtctcaactcacctggactgttttaccccaagggttcagagatagcccccatctattaggcattagcccaagacttgagtcaattctcatacctggacactcttgtcctttggtacatggatgatttacttttagctgccctttcagaaaccttgtgccatcaagccacccaagagctcttacatttcctcgctacctgtggctacaaggtttccaaacaaaaggctcagctctgctcacagcagtttaaatacttagggctaaaatcatccaaaggcaccagggccctcagtcaggaatgtatcctgcctatactggcttatcctcatcccaaaaccctaaagcaactaagaggttccttggcataacaggtttctgccgaatatggattcctaggtatggcaaaatagccagaccattatatacactaattaaggaaactcagaaatccaatacccatttagtaagatggacacctgaatcagaagtggctttccaggccctaaagaaggccctaacccaagccccagtgttaagcttgtcaatggggcaagacttgactttatatgtcacagaaaagaacaggaatagctctaggagtccttacacaggtccgagggacaagcttgcaacctgtggcatacctgagtaaggaaactgatgtagtggcaagggttggcctcatggtttacaggtagtggcagcagtagcaggcttagtatctgaagcagttaaaataatacagggatcttactgtgtggacatccatgatgtgaatggcatactaactgctaaaggagacttgtggctgtcagacaaccatttacttaaatatcaggctctattacttgaagggccagtgctgcgactgcgcacttgtgcaactcttaacccagccacatttcttccagacaatgaagaaaagatagaacataactgtcaacaagtaattgctcaaacatacgccacttgaggggacattttagaggttcccttgactgatcccgaccttaacttgtgtactgatggaagttcctttgtagaaaaaggactttgaaaagcgaggtatgcagtggtcagtgataatggaatacttgaaagtaatcccttcactgcaggaactagtgctcagctggcagaactaatagccctcactcaggcactaaaattaggagaaggaaaaagggtaaatatatacacagaatctaagtatgcttacctagtcctccatgcccatgcagcaatatggagagaaagggaattcctaacttccgagggaacacctatcaaacatcaggaagccattaggagattattattggctgtatagaaacctaaagaggtggctgtcttacactgctggggtcatcagaaaggaaaggaaaggaaaatagaagagaaccgccaagcggatattgaagccaaaagagccacaaggcaggaccctccattagaaatgcttatagaaggatccctagtatggggtaatcccctccgggaaaccaagccccaatactcagcaggagaagtagaatggggaacctcacaaggacatagttttctcccctcaggatggctagccactgaagaaggagaaatactgttgcctgcagctaaccaatggaaattacttaaaacccttcaccaaacctttcacttaggcatagatagcaccgatcagatggccaaattattatttactggaccgggccttttcaaaactatcaagcagatagtcagggcctgtgaggtgtgccaaagaaataatcccctgcattgcaggccatacatttcaatccctgtatctttaacctccttgttaagtttgtctcttccagaatagaagctctaaaactacaaatcgttcttcaaatggagccccaaatgcagtccatgactaaggtctaccgcagacccctggactgaccagctagcccatgctctgaagttaatgacattgaagacacccctcccgaggaaatctcaactgcacaacccctactatgccccagttcagcaggaagcagttagggcagtcatcggacaatctccccaacagctcttgggatttcctgttgagagggggaactgagagacagaactagctggatttcctaggccgactaagaatccctaagcctagctgggaaggtgaccgcttccacctttaaacaagaggcttgcaacttaattcacacacgaccaatcagatagtaaggagagctcactaaaatgctaattaggcaacaacaggaggtaaagaaatagccaatcatctgttgcccgagagcacagcgggagggacaatgatcgggatataaacccaggcattcgagctggcaatggcaaccccctttgggtcgcctccctttgtatgggagctctgttttcactctattaaatcttgcaacagcaaaaaaaagaaagtagattattaacaatttgatgctccctatattttctttctggtaccctggaggttgctatcactgtaagctctgtttgaaggatttgttgctattctcaaaacaagtaaatgatggaaaaagaacattgtaataaacatctaatcttaatagaaatacttcaatcctgaaaaattttttatattttactcagaaaatgtaattatataaagtggttgccattgtgtgaaatgtacacaagtatttaagaaataggattatttgattcaagagaaaccatatcagacaaaaagcacagtataagcagcacaaactttttcaacaaagcaacattattatttgagtgtcagttttcaaggcatagtaaaaatatttacatgttacctatttggaaagtacttaaaaataaggctacttattcactaaaatgtacagtacataggtacaaacataggttctaaaaacgcctggctgaatactttaaagcagaaaatatacagtcatcattaagtccttgaactgcttgggttttctcagtaatttcacaactacagggataaaggtataacacaaagacttaggataagggataaaggtttcaaagttgagaagtactatagttgtttgagaaattacaaaagccaagtgtccctgtgattctcccagttctgaccacaagaaaaatagtaagggggactgcctagaagctgctgaggatatcagcaatctgtagagtaaaggcagcaaattgatatcattagtgtccataaaataagagcaataaaactgtaccaaaatggagatgctcaggacttcactttccaagtacagcaaaaaaaaaaaaaaaatgaaaaaaaactacttcacaagaacataaaaataaaaatttccttcaataaaaaaaaatctatcaagtggctactttttgcaatagcaatgcttagtagtatagagaattcaaatagaaacaagatctttttctgaaactattatgagattgaaatgtattataagtaatacatttctggatactattttatcataatcaaagtttttgtgaaataatggaaattgcattgaacaaacatctactcatgcagaaaaaatgaattgtctttaatgaaaagttcccatgcataccctttctttctaattacctactgctaaatatttaattgtgacactaggtgttttgttttgctagtgggaagttaatttagctgttgctttgtaaataattttgtatattataatctattacatagctgaacaacaatgtatatgagaaaatactcatgatattttcttttgcagaacacacatgaattcactgtacccccatatcatgttgatttgtacatgaattcattatactaatatgtaatgagcccttgtcctgtggcaagcactgtgctagacgcgggaggtggggggcaggtgtttaaaagaacaatgatgggttcaaataggcaagtaaatcggtgcaataagtggtaaacatgatcaatttccttgctaaagagtcattatgtaagtagaattccaatatggtttccaagatccccaccactagtgtacataccccatgtaattccctcactttaaatgtgggtgaggctgggtgcagtggctcacaactgtattcccaggactttgggaggccaaggtgggaggattgtttgaggccagaagtttgagactagtttcagcaacatagtgagacccctagaggtggtgaagagatggtgataggcacacctatagtcccagctactacttgggaggctaagatggaaggatcacttgagcttgggaggtcaagtctgcagcaagctgtgattgagccactgcatttcagcctgggaaacagtgagactctctctcttaagtaaataaatcaatgtgggtaagatatgtgaatatgattgaatgtcactccgtaattgtttactttatatggaagaaaagattgtggatataattaagtcccagaatcataagggagtccatcaaaagacacattatcttgagtgggtctgactaaatcaggtaagactttaaaagaagtcagaggcattatcctacttgcctcaaagaagcaaatgaaagctgtgttttataaagctctatgagatagggaatggcatctggtttgcagcagccaagaacactctagacagccagtaagaaagaaagaccagagttctaaaatcacaaggaagtaaattttaccaacagccagtgagcttggaagagaaacgtgagccttagattagctcacagtcctggccaaccttttgatttcagtcttgtgagaccatgagtagagaactcagttaaaccattcacagatttttgacttgcagaaattgtaaaataaaaaatgtgacttgtattaaatctataagcttgtgataagttgttattcagcacagaaaagtaatacagtcaaatataagggccactaagacatcttcagtgctattggaaagcctactgaacaggtgatatttggagtgagccctaaggaatcatcacacattatcgaggttaggcatgtgggatacagaaggggatggggagagttttctagaaggatgagggccagaagatgagaaagttcaggagattgaaaacaaatcaatatgaatggaacacaaaatacagggaagaaggagatgcattaccacatttaaggaattataatatgccatcgattttaagggagtttattttatgtgccattaagggtagcatggtagaaaaaatgatgccctcccactcccttcactacctccctgttgaagatatccagctcctaattctggaaacctgcgagtgctatcttatgtggccaataagaatttgcagatttgattaagttgaggattttgttgtggtaagcttatcctattttatctgggtaggccctaactataatcataagggtcttccaagggcctttataagagagaggcaagaagtttaaaggaggaaggtgacatgaagatgaaagctggagtttggattgatgcaaggaaggggtcatgagcccaggaacaaaggcagcctctagaatctagtaaaggcaagaaaatagaagtcttcagaagcaacacaaccctgcaatacctacctcattttagactttggcctccaaatatataaaataataaacttgtgcagttttaagtttgtgaaaattagttacagccattataggaaactaataaagagagcaaaaactgccagttaaattctgataaagtatttaagacatcactattgtgaaaaactcatcccaatttcaaagatgcttgtgttaatatgtaatgtgttagttatcacgctaatttgtgatgaaaattgggatgtgttaaatgaagttcactaatttgaaataacatctccataggctgggacaagatcctacaagtctttgtgatctatagaacataaacctggtgtgcattgaggaactgttgaaagctttcctaaaaatggaataaagtatggttggtctccttacagagaatcacattgtattgtatttcttagttgtatctaaaaatatatataatgctgctttatttctttgaagttttattttgctgaaaactatattctcttaaattaatgttaagaagctaaggcacattttatctgcatacatatttggtaggaaaaattaaaaacctgttttttattagttttttacaatgatgtcatcaattcagaaaataaaaaatgctgaggttcccactgaaattgtaccaccgggtgcagtggctcacatctgtaatcccagcactttgggaggcggaggtcgatggatcatgaggtcaagagactgagaccatcctggccaacatggtgaaacctcgtctctactaaaaaaaaaaaaaaaaaaaaaaaaattagctgggcatggtagcgcacccatgtagtcccagctactcaggaggctgaggcaggagaatttcttgaacccaggaggcagatgttgcagggagctgagattgtgccactgcaatccaggctggcagcagagcgagactccacatcaaaaaaagaaagaaaagaaaagaaaaagaaaaaaaaaaaaacaggcgccatggctcacacctgtaatcccagcactttgggaggccgaggtggacaaatcacccgaggttaggagctcaagacccgcttggataacatggtgaaacctcgtttctactaaaaaaaaaaagtatatatatatttttcctctaattgaaatttgcatcaaactagtacgttactttcaaatgtatggatgacttttgatatcaagttcattatgataaacttcatatgttcatatgttaaacttcttaaagaacattgcagttttaagagctgtaagtggatatagatgtttacaaaaatgtgaaaatgctaagcatgtcttcatatgagtctagtagcttgaattttagtttctcatgatttagataaacttaaaatctgctgtttaaaatgtttaaagtgataacaaaaattcagatatttagagaaacatagttaaaaagtgagtaaataatagggtggagataatctttctgtgcaagaggcatcatgtaggatatgtaaattacagaagtctttagtgaaatccactataaagttaaataaagtagaatcaagtcatccaacttcaataatcagcaataaaaacatgaaaagattagactggacagtataaattctgtttctgcagtaatatcaaaggacatatagcaggaaaacagttctttatggagcatacctcaacatattaaagataagtcctaattctctttatattttcataaaactcattattcatatactaaagttctatgaaaagacagtcctttttactaaacagaagatctagctaacactgtatatccttaagggacattaagtggtaatggacattgtatatctttaagggacattaagtggtagatattttgtgcattgtaaaagaccagagatggttgctgctatctatcatctagaaattttatgtaaaccaaggaagtctgagtgatgaattttatggggagacatcattttttccctctccctatcccattccctcccagcttcctagactctatttacattggacaaatttcttctcaaatctaacaatgattagtgagacagaaagcaatggaaataactccactttccacataacctttagaaataatatgctaatggcaaatcttatagatgcattttacaaatattgtcataaattggaatatattattaatgtacttattttactctgagaaagcaaattcgctttccaggttgaatgcaaacatatgaagtcagttattttcattttaaatttatgacttacacttttaaataattttttattgttttaaaaagcataccttcaagtattaataaataaaacattaatatccatgttcatgtatgttctttcttgacctcattaaatagcaaatgaattgatttttatcacttcttcatgttagtaaaatattttgtgagtaattaaagtgagagtcaataaagcagccccgccagtatcagctaagctggactggctgcataatcggaccctggtgcttttcttttgagcgtaaacaattttatggatcaccaaaatcagacaaggtctgtgctcatgaaggaacaaaataaaaataatatcactccacactcatatctgagcacagacaaaaacaataaagctgtctaaaccacaaaatggctaacattcatctttcctatctcttctatagttctttacaaattaaagctttagctttatttgtaataggtaatgttattaccttttagataacaattttcgtaatactcccctttgtaacctcatagagtagaggccaaacttcctggaaccacctccagagtcactaaacccaagcttgaatctcaagcctctgttgaaaccctcttaacaaagtgctcccaaattcttcatggtatggagccaataaactcaagtttgtctaatgacaggtgaatttatggtggtctttaagtggagaatgccaataaagatacttctacttttgactagaaatgagagtacttgtgtctatttttctgtgatcgataaaaaaacacactgcattctcacagatgtgtaatatatgtatgtattggtatgctagggcaaccatatcaaagcaccacaaactgggtggcttaaacaacagacagttagtgtttgaccattctggagtctagaagtccatgatcaaggtcttggcagggttggttccttctgagggctgtaagagagaatgtgttccatgtctctcctctagcttcctgtgtttttctgacaatctttggcatcccgtagttgtagatgcatcaccctgatctctacctttatcttcacatgaaggtctctctcaatatttgtctgtgtctaagttttcccttttgttaaggacaccagttatattggattaagggcccacctactccagtatatcctcattttaatttaacaaattacatctgaactgatcctatttccaaataaggtaatattattacaataaagtgctaagtaattaggacaacaatataattttgggaggacacaactcaatcaaatacaatgtgttttgatgtgaaggaagcataagaggtttttctgtatgttggtttttgttttttggtttgtttgtttgtttagaagtttttttttaaaagaccatgttcttctaattgttctctactaaaactttctcatatttcctctaaggttacctttagtgaagcctatatgcataccctgtgtgcatatgtttgcttgttgtttagtagttctgaattgtattgttgttgttgtttaaatatagctagattgtgctttttgcaatcttagcttaaataatattttaaaaatcataggtacaaaaaaattgaccttactgtatgacatcattttggattctagaaataaaaataaagcttataagattatctcaatgaacacaaaatggggaccagaataagtggcataaatgtagaacgagaaagactgggtgccatattttgtatcaatccgatgatttcaccacttggattttatttttgggtaccatatggtttagattaagataaacccattgataataatttcagtctaataggaaaattatttctttatattaaaatttttgtgaatctaggtaccaccatagaagcacagactaaacattcttattctttttacattttttctcacgtttctaaaaatatttaattgaacattatatctcttaaaccactctcactgccacttccaaaatccttgtcctgttatttttctgtcatatctattttataaaaattcagccattcacacaagacaatgtgtggctaacaatgtggacacaacattccaaagagcttggatccaaacccttgcttgatccttaagtagacacgtgatcttaggcatatgacatttccatgcctctgatttctgatacctaacatagagataataacatcacacaactcataggtttgtagtacaaaataaatgacataaggtatgttaagcatttcaaaaagtacctgccaagcaccatattaatttaagacattaatatcattatctctgtccatttgcctagcttgctgattatttctggtaagacaacaggaattatctcaaaatcaaaatttctaactccaggtaggcacccaactcttagtaattgtattagtccattctcatgaggccaataaagacatccctgagactgggtaatttgtaaaggaaagaggattaattgattcacagttcaacgtggctggggaggcctcaggaaacaattgtggcagaaggggaaacaaacatgtccctcttcacatggcggcagcaagaagtgccgagcaaaatggggaaaagccctttataaaatcatcagatcttatgagaactcagtcactatcatgagaacggcaagagagtaacccacccccatgattcaattacctcacaccaggaccctctcacaacacatggggattatgggaactacaattcaagatgagatttgggtggggagacagccaaaccatgtcattctaccctggcccctcccaaatctcatgtcctcacaatttaaaacacaatcatgcccttacgatagtaccccaacatcttaactcattccagcattaactcaaaagtccaatccaaagtctcatctgagacaaggcaagtcccttctacctatgagcctgtaaaatcaaaagcaagttagttacttcctagatacaatgtgagtataggcattgggtaaatggacccatttcaaaagggagaaattaaccaaaacatagaggccacaggccccatggaagtctgaaatccaatagggcagtcattaaatcttaaagttccaaaatggtctcctttgctccatgtctcacatccagatcacatcccatggctttgggcagctctgtccctgtggttttgcagggtacggctctcgatcctagctgctttcacaggctggcattgggtgtctgctacttttccaggggcacggtgcaagctgtcagtggatttaccattcttgggtctggaggactgtggctctcttctcacagctctactaggcagtgctccagtggggattctgtgtgggggctccaaccccacatttccctactgcactgccctagcagatgttctctgtgagggctccacccatgaagcccacctctgcctggacatccagatgtttccatacatcctctgaaatctaggtggcggtttccaaacctcaattcttgtcttctgagtgcctgcaggaccaacaccacatggaagctgccaaggcttgggacttgcaccctctgaagccacagcctgaactgtacatttcccttttttagctatggctggagcagctgggatgcagggcaccaagtcccaaggctgcacacagcagtggggcccgggacccagtccagcaaaccatttttcccttttagatctccaagcctgtgatgggaggggctgccatgaaggcctctgacatgtcctagagacactttccccattgtcttggtgattaacattctgctcctcattacttttgcaaatttctgctgctggtttgaatttctccccagaaaattggcttttattttccagtgcatcatcaggctgctgcaaattttccaaacttttatgctccgcttccttttggatgctttgctgcttagaaattgcttctgctaaatatcctaaatcatctctctcaagttcaaagttccacagatctcaaggacaggggcaaaataccatcagtctctttgctaaagcataacaagtgtcacctttgctctagttcccaacaagttcctcatctccatatgagaccacctcagcctcaactttattgtccatatcactatcagcattttggtcaaagccaatcaacaaggctctcagaagttccaaactttcccacatcttcctgtctcctgattccttcatgtctctaagaagttccaaatgttcccacatttttctgtctttttctgagccatcaaaactcttccagcctctgcctgttacctagtttcaagctcaattccacattttcgggtatctttagagcagcacctcattacccagtagcagtttactgtactagtacattctcatcatgctaataaagacataattgagactggggtaatttcaaagggaaagaggtttaagtgactcactgttcagcatggctgtgggagcctcaggaaagttacagtcatggcaaaaggagaagcaaacacatccttctttacatagtggcagtaaggagaactgctgagcaaaagaggggaaagccctttataaaatcatcacaccttgtgagaactcactcactcactattacaagaacagcagcatggggtaataatccccatgattcaattacctcccactgggtccctcccacaacatgtgggaattatgaggactacaattcaagatgagatatgggtgggaacacagccaaatcatatcagtaataatttaacatatatttcttcaatttctataatggtgtgttttagctgcctagcgtctatccattagcatccagattttctggtggaggatttcttttttctcctaagtctgtgcttagctgaaagatcatttttaaccttatttatcccactgcctacatagtgctacagaaccccaggtgactagatgcttcctccatttgctctctggcttaccaaaagaggcatattatgccagtttatctaattggataaaaagaaagcttcagaaggcatgcttattgcgatagtaacaataatagctggtgtagcattggtggtgttaggtggattttaagcaggaagaggagtactgatgatgacatcttggctaggctgttatggctatttctattctttctgtagctcttcccaaataagcaaaaactgatcaaatttattgacagtggatcaaccctacaaggaatactaaagggaatcttctggctgaaataaactctcataagacagttacttgaatccataaaaggaaataaagagcattgataaaggtaatacacaggtaaattttaaaagaagtacatatataaaactaaatatattatatattaatatatattattttttaaacataaatacaatatatgtaatacaattttatttttctatttaatttaaaaggcatctacataagtcagtatttataaaacttcattgttaaacttataatgcataaagacatcatttgtatgacatagtacaatggagggagggagagaatatagagatatgttgtatcaaggtttttatatactattgaaattgttaacattaatttgaaagaagtcagtcacaaaagaccacatattgtacaattccatttatattacatgtccagaataggaaaatttataaagaaagaaagttgatcagtaggaagagaggactgttaatgggtatggcttttattttggtggtggtgagatgttcttattagattatgatgatgagggttgcacaagtttgtgaatatcctaaaatccattgaactatttactttcagtaaattttatgaattatatctcaactgaatattgaattttatctcagtaaagctattaacttatagtaagttaatattatctttttaattatattaactgcggtcactgttaaatcttggttagtctcagttaccttatttattgcttgtgtcagaaaaagttcagataccacatgcaataaaaaaaaatccaattgaatttccaaatgattatttttctccaccactggaacagatataatactctaaatataaagagatttttaatttcaaaagctaggcttcaagggagaaaaattgttgaaattgttttcattgtagtgtttgttttgtgtttttgttgttgttgaagtggcgataattgtggatttcctgccgttgacatatgttaatccaaaataagaaaaatgggagaagaaagaggaaaaaattcatagttcccacaatttgcagtaagaaaaaggactagaattttttaatagtctctcttttatagtgagaccttccagttttgaaaccagttgaagcagcacaagtggacacagaaatttcttccatagacagaggagactcgggtttgcttgcagcatgaaatcgcaagagcagtcttacaggaaagtatgcacgtgtagtgcagggcaataataaggtaggaatggcagtagggtagtcaaacagacgttgatgtaacttgccccttcatataccaccacctagtaagctgagagaagatgctgaattcaaattctaggttaaacatcatacatagcagtccaataaattaaatgatttcaagtaaaaaatggtttgtgaggttaaaagtttggaaaacagaacgtactagtcaagatggaaggagtctcctactacatgccatagccctcttctttaaagcaagagcaaacctcagtcttctgggtggtctggttttgtcatcactttttacaaaactaactttaacttgagaaaatagtaattcatgtaaatctgtagcctctgtaaacttctatcattgtgaatacatatagcaatgcaatgaaaatatagctggtgctcatatgtctagggagcttttattcacgaaggaggcccacaagatttaagtagcattcatagcaatgacatgatttaatattcataaaaatggcaaaaccttacaacttaaaacaccccaggtactattttaagtgatttctataaccaagtcattgtatcctcacagaaaaaccttagtaggtattgtagtcattcccattcttccctgaggaagtggagatgcagggcgatgtctgtggggagccaggcttctgtccaggccctgaatctatgaattcaacctcattacagggctgagtgttcttcagaatgcccatgtgcttcagtttttcagaattcatgcgtcacgaatgtggtttacttcttcaaaattgtatttttgtttaacttgaagatattgtaggcattttcatatataaataaattccatttttgctttttattcaatcactaagttgccaaaaagttggaaataataggttttgataaatatgattccattgtttaattcttcagattctttgcaagcaatatattcatgtagctttaaaaaaatcccaaatattatgttctaggaactaacatttgatattgtttgagagtgcttcaaaatgatttttttaaataaccgtgaaaaaggtcagctatacctctaagctttcactgaggactatcatcagtcaaatgattagtttcagcaatttcatggcataaatccacaactagggtgattaagggtagtgaatttaggtacaagcctaaaattgaatcaaatagaagcagataaatacctctaccttattctcatataatgaaactcttcttatgtatgaaaaacatcactatattttgagaaatgctaattcacatttaaatttccaagaaaagtgctcttctgaatattttaaagattattcaatagactttacagagtatatttgtacctatcataaaattaaaaatcaatatgcattacccacaaaagtgtacagttgataaaccatacttagctatagcagattttaagagttctgacttccctcaaatccattacattaaacacttcaaccagctaatgtcaaaactggagcaattgcatatcaccccacttaaaacaatacagcaaaatgcacatatcatgtctactaaaatctctgcaataatgaaaatgaattgattttaaacaaatggattttagtgaatgtataaatctgaatcctttgagatatgctaaatgtttaactctgtttttgtattaaatttaatttgcatttatgcatttagagaatatatgttattcaagcagtaaaaagattgaaaataattattttgttcagtaaataaacagtaaagaaacatggtataagactggtactctggtagagctatgcattcatcccagctgcgcaagaggctgaggcacgagaactgtttgaacccaggagggagaggttgcagtgagctgagattgccccactgccctccagcctgggcaacagagtgagacatcatctcaaaaaaataaataagaggaagaaaaacaaaacaatttcttgcttcctgaatcttgaattttaggtaacagaacagatgtctgtcagtgagagaaatatgtgttttaatgatgttctataaagggtacactgggatacaaaggaggaccattagaaaaaactccccagggcagagaaacttccacacaactttctcaagattaatacagtgagtcactcatacaagagcttattttaaaactcagtccataaatacaaaattcctaataaactgtctgaaagtactctaaattgccatatgtatttttttattcaattctgtgtcagtgtctctcattcttcatcagtcattacttttctatgatcttctagtaattcttcagtccctctcttacagattgaaaaagacttcttcagtcgcttattttatttatgaaatctttacatagcctttctaatatgacatggtttatattaactctatccactgttagtttcataaatgaaacagggttattattaggcaaacataattaattcaggtgctctaaatactgtaggctggaactgcactgtagacattctccagaaaataactaaatgaagattgtttagaatttaacaattagagttgttaattgttgaattctaaactttcttaacagaagcataaaagtaataggaaggaaatgcattccaggccaaagggactcatgaaaaaaagaccaggggtatgaccagaaataaaacaaacatgtaggaaggcatttatgcacagatgaatgggctacaaataagggaggggatgttatatgggcctgcgttgccttcctgtgtcagaaggtgcattaggagagcacagtccaaagtccacctagcattttggaaaatactgtcaagaaacaagtaaagattcagatattggccgggcatggtggctctctcctgtaatcccagcactttgggaggccgagacaggcagatcacaaggtcaggagatcgagactgtcctggctaacacagtgaaaccctgtctctactaaaaatacaaaaaattagctgggcgtggtggcgggcgcctgtaatcccagttacctgggaggctgaggcaggaggattgcttgaatccgggaggcagaggttgcagtgagccaagatcgtgccattgcactccagcctgggcgacagagtgagactccgtctcaaaaaaaaaaaaaagattcagatatctctgactctaaacagtcaaaaagtcaccacatgatttgttctacccttttcctcttcctcttgcctatttgtaatgtgtgttttttttttttgacagtgagaagcttggctaccatttataatttatttacttacttgctgaactctacttttacatgtaaagtagtttcagagttgtgcatctatacctcagtaagaaacaaatttaccccaaagagtatgatgtttttgtacagttattttagcttttaccttaatgtcgtcaatcaaaactcttgtttctaaagttatttagatcagttccttttctttccacatcatttagtgatgtcttaacttttctaatgtcatacttttctaatgaactagttctaataaacttttctaataaatctgacttcattagaagtttttgtgacagtcttcattagcagatttgtgacagtctgctttctgttattggaccctcctacatcctggttgatgtttttaatttgtgtacaataagttattacttagggtagagctctattgattttgacaaacatgtgtaccatcacaggactggattaaacaattacagcattctaaacattctcttcaatgcctcattaaaaacaatcccaatctcaactttctgtcaaccactgatctgctgtctgtcctgatatttagctctacattttcctgaatgctgtataagtggaatcatgcaataggtaccttttgtgtatggcttctttcacgtaagaaaatgcacttaagacttatcagtattgtattaatcactttgttcctttttagtgccagatagtatatcattgtatttatgtaccagaagttatctgttcatctgttgtaaggcatgttgtttgtttgcatttattggtgaatacgtataaaggtgaatatgaatatgtataaatgtaccctataaacatttgcatatataacaaaatctttatttcacttgagtaaatacttgattgctggattgtatggtaaagtgaatacttaattaacactaaattattatgccggatttcttttcaaagtctgctttactatcctgcattcccatcatcaatgactacactttgagttcttctgcatcacaagcatttactattgtcatttgttttgtgtttatttcatttttatcttactaagaggtgtgcagtgctcatcatggagtattaagatcaatttctgttaactttttatttttatatagcttaaagcttacaaacaaattaaaatagtgcaagaaactccaatgctttactcagagtcccaaaatgttttgggatattttgctataattgccttaatattttatctctatgttcacttatctatattatatgcatttctacaataatatatattatctatatcatatataattctttttgtgaaacattttagaggaagtttgaaatattatgaacctttatccttaattactgcagtatgtgttttctaagaacaatgttatttcttacatcatcatagtacaattacaaaaaccaatactattgactatagttaataataatgtatacataaaatttgctgagagtagatttttagtatagttttcacataatagtctagtaattttgaaaagtgcccttcaattttggtttatctgatgttaccttttgattcaaattcaggttttatataactttgaaagaagtacaacagaagtgatatgttatcctcagtgcatatcagtggacatttttagttaggttgttctaatatttgttaacttattccagtaaaaaatttatgtaatttatccccttggacttaatgaataattttgttatttaagaactataaacatgtatttttgttaaagaatctttcacccactagtttagcaatcattgataattttccaactccaccttactttcatgtatatgttgattttctgctataaggaagagctttgcctttatacctccctaagtatttgtctatttttcaatttattatacatttatataagaattgaatcatcagttattatattattcagtgaattataatacattaactttattatttattttactgctgaaatttcctcctacttagccagtggaaaacctgtagagctgtcccctgtgtccttttgatttattctcctttttctttgagtacttctttataatgcaaaaaagatatttaaggtttctcttttaacttccttgctctaggcttgaaatttatcttttctgtaaaaagtatggttcctttaagtagagaatgatattaagaaatcaagatctaggtgatcagagtgttctcttataaagggaaagagttaggaaatatgtgcatgtgtgggtatgtatgcatacatacatacacatatgtatatatttatgtctatatattgatatacatacatttatatgcagatacgtactttgtaggaattatataaatacacatgcacacatatacactcatatcagatttatactgataaaccattgacccttgaacagcataggtttaaatgacatgggtctatttatatgcaaagtttttcaataaaatttacatggagtgtgcctgcctctcctgcctccccttctaattccttgacctcttctgcctctgccacccccaagacagcaagaccaacctctcctcttcctcctcctccgaggtctattcaatttgaagatgatgaggatgaagaactttacaagaggagaaggagccaagatggcctactaaatgcagataggaagagcatctcccagcaagagaccagactattaagaagactggcacactgtgtgaggatctttggaagaaaggaattcagagcggatggaaagaagatggatacccggggctgaatggggagcaatctggaatctcttcattggcctgctgagtatgagggacgcattcctggtgccagtgggtcctggggaaggggtgagacaaataagcgaggatggcccactctcactatggaacaccagaatgctagcttcaggacacctcatggccaccatggacatttgagctgacaagaagagctgtttagagaggtcagacctccagcctgtgtggattccagagggtttggctcaagaacagctggagaacagctagggatgtacatcccccaagtctggccacattccccgaagtgtctgtagcctttgatgactgtcagacctggacaaagcagggtgatcttgccaataagatggatgtgacctgagctttcccttctctgccagccactcctagggtccctgcttggctgatgctgcttgcagcacagtgtcagatgcccaaccaggtgcttcctggtggccattgccataggtcctttgttgacagaccctccctaaccatcagagagcttctgcagacagactactgccagcatgcacccaactacgcacagcatccccacactgcagcctccccacaccactatgctggcacacattcacctgtagcacccccactgatttgctggcacctgtgtaggcagaactcactgcatcccctgagcaccctgtccacatgcatgtactccactgtaccactattgctgctggcatgcatgcacaagctgagatcccactgccactgctccagtgaagcatgttggctgacagattccatcggggtattgttgccagtggacagggcataccttgattcctccaacacagcaggtgcttaacgttgagagggtcagagaaaaaggccatggacctgttagtagcccttcaggggctgctttatagtgtcaatcaagtctgcgtaacaacaaacaacaaaatgacaggatcaaatccacatatcaatgttaaccttgaatgtaaataggtaaatgtcttagttaaaaggcaaagaatggcaaggtggataaagaaataagacccaactgtatgctgtctttaagagacccatattccatgcaatgacacccatagcctcaaactaaagagatggagaaaattctacaaggcaaatggaaaacaaaaaagagcagaggttgctattctaatttcagacaaaacagattttaaaccagcaaagataaaagaagggcattacacatgataaataggtcaattcaacaagaagacataaccattctaaacacacacacatttatacatattatatataatattttatattttatatatatatatatacacacacacgcacatacacacacacacacacatatacacacacccaacactggagcacccaggttcataaaacaagttcttagagatctatgaagagactttataaccacacaaaaatagtggcagactttaacacctcacttaaagtattagagaggtcatgaaagaagaaaactaataaggatgtttgggacctgaactctacacttggacaaattgacctagcacacatgtacagaacactccactcaacagcaacagaatatatattcttctcattggcatatgacaccaactctaaaattgaccatgtgataagacataaaataattgttagtaaattcaaaaaaacaaaatcataccaaccatgctcttggaccacagtgcaataaaaataaaaattaataccagaaagatctctcaaaaccatacaattacatggaaattaaacaacctactcctgagtgattttttgagtaaacaatgaaagtaaggcaaaaatcaagaaattttttgaaactaatgaaaacaaagatataatttaccagaatctctgggacattgtgaaagttgtgttaaaagcaaagtttatagcactaaaggctcacatcaaagagttaggaagatatcagattatcaaattaccatcacactcagagggaccagaaaaaaagaacaaacaaacctgaaagttagcagaaaaaaaaataagcaaaatcagagctgaactgaaattaatacatgaaaaatcatacaaaagataaacaaaacccaaaattggtttcttgaaaaaatatataagattcataatacactaattagacaaattaaaatgttgaagatccaaataaacacaatcagaaatgacaaaagggacataaccactgaccccacagataaaaacaaaaacaaacaaacaaacaaaaacaaccctaagaaactattatggacaactctatgcacacaaactagaaaatctaaaataagtgaataaattcctggatacatacaacctcccaagattaaaccaggaagaaactgattccttgaacagagtaataataatgagatctgaaattgaatcagaaaagcctaccaaccagaaaaagcccatgaccagatgtattcagaggtgaatactaccagacatatataaaagagttgtgatatagtttagatatttgttctgtcccaaatctcatattgaatgaaatcctccatgctggagggggcctggtaggaggtgttttgatcatgggggcaggtccctcattgcttatgctatctctgtgatgatgaatgagtttgtatgtgatctggtcatttaaaagtgtgtgacacctgacctaccactgtctctttctcttgctcctgcttttaccatgtgacatgcctattcctctttcaaattctaccataattgttagcttcttgaggcctcccaagaatctgggcagatgccagcaccatacttcctgtaaagcctgcagaacggtgagctaatgaaatatctctctctttttttttttaaataaattacccagtcttgggttctttttatagcagtgaaaaatggtctaacagaacattggtactgaagagtagaatattgctataaaaatacttgcagatgtggaagcagctttggaactgtgcaatgggcagaagctgaaagagtttggagggctcagaagaagatgggaagataagggaaagtttagaatttcttagagattggttaaataattgtgaccaaaatgctgctaatgacatggacagtgaagcccaggttgctgaggtctcagatggaaatgacgaacttattgagaactgaagcaaaggtcacatgtgttatgccctagcaaagagcttgactgcattctgttcatgccctagggatctgtggaggtatgaaatcaagagtgataatttagaatacctggcagaggaaatttctaagcagccaagtgttcaagatgtggccttgctgcttctaacaacctagctcagatgtgggagaaagaaatgacccaaagttggaagttatatatgaaagagaagcaaacataagagtttggaaaatttgcagcctggtcatatggaagagaaagaaaaagctttatcagaagaggaattcaagtagcctgtggagtaatcactttctagagatgtttgcataacaaaaaggagccaagtgccaatagccagagcaatggaaaacatgcctcgaaggtatttcagagaccttcatggcagtcactcccatcacaggccaggaggcctaggaggacagaatcgtttcataggccggtcacaaggcccttttgaagttgctccccatgttctggcctctctagcttcatctgtggctcaaagggacccaggtacagctccaggctgccattctggagaatgcaagtcaaaaaccttggtggaatccatatggtgttaagcctgtaggggcacagaatacaagagtgaagaatgcttggcagcctcctcctggatttcagaggatatatgagaaagcctgggtgctcaggtagaagcctgttgcaggggcagaaccctcacagagaatcactactagggcagtgctgagggaaaaagtggggttggagccttcacacagagtcccaaattgggcattgcctagtggagctgtgagaaaaaggtcactcttcttttgaccccagaaaggtagatccactgacagcttgcaccctgtgcctggaaaagctgcaagaattcaattccaatctgtgagagcagccctggtgctgaatactgccaagacaaagctgtggagctactcaaggccttgaaaacacaccgtttgggttccctgccctagatgcaggatatggaggcaaaggagattattttgaagctttaagacttaatgtaattacttccctgctgggttttgaacttgcacggggcctgtagcccctttcttttggctaatttctcccctttggaacagcaatgtttacccaatgcctatacccccattgtatcttggaagtaaataactaggttttttcaaaaaattcattttacaggatcacatgtagaagggacttcccttgtctcaggcaaaactttgtactttgagttaatgaaatgaattaaatctttgtgggattactgggaaggatgattgtattttttgatgtgagaagtacatgagatttgcgaggggccagtggtagaatgatatagcatggatatttgtctccacttgaatttcatgttgaatggcaatccctattgctggaaatggggcctggtgggaggtgtttggatcatgggagcagatccctcatggcttgttttgtctttactatagtaagtgagttcttgtgaaatctggtcatttaaaagtgtgtggcacctccccctgactctccatattgtttgctcctgcttttgccatgtgatatccctgctccaccttcaagttcttccataattgtaagatttctgaggcctccttagaagctgagcaggtgccagccccatgctttctactaatcatgcataattgtgagctagttaaacttttcttctttataaattacccagtctcagatatttatttatagcaatataaaaatagcctaacactagctactacaattcctactgaaactattccaaaaaatttgaggagaaaggacccctttctaactcattctatgaggccagcattattcctttaccgatacctcacaaagaaacaacaaaaaaagaaaaatttagaccgatatctctgaataacatagattcaaaaatactcaaaaaagtattaccaaacccaatttagtaccacatcaaagagctaatccaccacagtcaagtaggccatattcctgggatgcatggtttgttcaacatatgccaatcaatacatggaattcatcacataaacaacactataaacaaaacccacatgatcatctcaatagatacagaaaaggctttcaataacactcatcgtcacttcatgttaaaaaccctcaacacactaggcaatgaaggaatatacttcaaaatactaagatccatctatgacaaacacacatcatactgaacaggctggaagcattctccttgggaaccagaacaagacaaggatacctacactaactactcatattgaacatagcaccggaagtcctagtcagagcaatcagtcaagagaaggacataaaaggcatccaaataggaagagaggaagtcaccatgatatgattgtatatacagaaaattccatagtctctacccaaaagctcctagatctgataaacaacttcagtaaagtttcaggatacaaaatcaatgtacaaaaatcactagtatttttatacaccaatgatgtccaaactgagaaccacattaagaatgcaattgggttcacaatagccatacacaaaaaaaactagaaatacagctaaacagggttgttaaaaatttctacaatgagaatttcaaaacactgctcaaagatatcagaaatgacacacacaaatggaaaaatgttccatgctcatgaattggaagaatcgttgttaaaatggccatactgaccaaagcaatttacagattccaatgctctgtcaaactagcgatgacatttttcacagaattgctttggctatccaggctcttttctggttccatataaactactaataatttgtattattaataatttgtttgtaatatatattatatatttttatattatagtgttatatattatatattacatagtaatatataataatttattaataagtactttattaataaactattaataatttatatggaaccaaaaagagcctggatagccaaagcaatccttagcacaaagaataaagccagaggcatcacagtatcagaatttgaaccatacaacaaggctacattaaccaaaacagcaggcactggtacaataacaaacacatagaccaatggcatagaatacagcatccagaaatagagcggcacacctaaaaccatctgattttcaacaaagtcaagaaaaagaagaaatgaagaaaggactccctattcaataaacggtgctgagataactagctagctatacgcagaagactgaaacttgaccccttacctttcaccatatacaaaaatcaactaaagatgtattaaacccataaatgtatcacctaaaactataacaatcctagaaaaaaaactaggaaataccattctgaaaataggccatgggaaagaaaatattttcattatgatgccaaaagcaattgtacaaaaccaaaaactgacaaatggcacttaattaaagaggaaactttcaaccagataaacagataccctaaaaaacgggagtaaatacttgcaaactatgcatctaacaaatatctaatatccagaatctgtaaggaacttaaacaaattagtaagccaaaaaaaaaacaaaaaaacaccattgaaaaatgggcaaaggacatgaacatttgtcagaaggtgacatacacatgactaaatctataaaaaaaagttcatcactattcattagataaatgcaaatcaaaaccacattgagataccatctcatacccactcagaatggctatccttaaaagtaaaaaaataacagatgtcggtgaggttgtggggaaaagggaatatttatacactgctggtgggaatataagttagtcctgccgtggttaaaagcagtttggagacttctcaaagaacttaaaacagaattatcatttgacccagcaatgccagtactgggtatatacccaaaggaatataaattgttctaccataaatatgcatgcacatgtatgttcattgcagcactattcctaatagcaaagtcatggaatctatctaaatgcctatcaatggtggagtgaataaagaaaatgtggtacaaatacaccatggaatattaagctgacataaaattgaatgagatcatattctttgtagcaatatggaaggagctggaggccattatcttaattgaattaatgcaagaacaggaaaccaactactgcacattcttacttctaagtgggagctaagcgttgagtacacacagatgcaaataagagaacattgataagaggacctacttgaaggtcaagggtgggaggagggcaaggatcaaaaaactacctatcaggtactaagcttattgcctcagtgatgaaataatctatctgtacaccaaacctccatgacacacaattttcgcacgttatatacctgcacatgtaccttctgaacttaaaataaaaactggaaagaaaaaagacctatatgataactttcacttaataaaaagtaaatgtattttctcttccgtatgattttcttagtgttttttcttttctctaggttactttattcattgtaacaatacgatatttatacctataacatacaaaatacacatatgtgttaatcaactgttaatgttatgggtaaggctcccagtcaagagtttgttattagttgttaagatttaaggagtcgaatttatacataaattttcaactgtgtagttttagcacccttagttcccacattgttcaagagtcaactctatacaatcttatccaatcatccaaagtgttaggaatattctagtatcatatgtaaatacatgcatgtacatatatttatatttatgtttctatgcctgtgtattaaaaaacatgagtttatactcatatctccaatttataaacaatacctcagggtgccttttacttctcctttccgtattagcagttcctcctccaacagtgagaaacctagcttcattaatttcaacaatatctacaaatttgctcaagtcaagaatgcatggcaaaaaggtttagaatcactaaccaaaaccactaataattaataattaaacaaatctaataagaaaacaatttatcatcctgttcttagctaaaatgtacacataagtgcataatcctaaacgtatgtagattagatgggttttaaaaatgcatacagttttaaaactcacattttttaaagatataatacattttcataaacagaaaattccttctgtccccttcccaatcaacactgttacttggggtaacaatttttttaatgtttttccttatttttgaaataaaaagtgaaatcttataataggtcccttttcttttatcttttgtttagcataatatttgagagagtcttatgtcagtagtttgatccttccttcactgagtaatagtccattgtacatacatatcactaggtccttatttattttcatgttgacagatatttttttgtttccaaatctgggttacaatcaataaaactgctataaacatgcttgtaaatgactttttatagaacaatattttcatttcacttgtttatataaattgttattcttagcataggtgtatgtttaattttaaatataatctgcaaaatgtttttcaaattttttaaactttcatttgattccctatcaacaattttatctttttaccaacagtgtgtgagactttgagttacttcacattttcaataatttttttattaactttagtctctggaggagtattcacttttggttagttttacatttttctgatgattaatcataagaattttttacttatctttcaatgaaaatattttctccagttatttgcacaccgttttagtgttttgttttatattagtgaattataagcgctgtctggatatattctgctttatgtcctgggtatgtgtttgtaagtattttctctcatgcttattcattttctaaatagtatcattggtgagcaaaaattttaaatttggttagtctaaattatcattttttctttaatgattattgcttattttacatgttctaatacaaaaattcctactccttgataacaaagaacttctacattttctccttcatagttttaggttttacatagagaatgatgatcatctaaaattagtgtctttgtgtatgatgtgaggtagaagtcaatgtcattttttccgtatgaatatctaccatttccaccatcattttttaaaaggcttttattttcttattgaattgctttggatattttgttgaaaataaattaattgtataagtgtggttctatttctgaaatttttcactttcattgatcaaaccgtctttttatttttcaaattaaacactttcttaagctgtaaaatcagatggtacaatttgtcaactttttcttgtatttaatagacttattggccattatatgtttatacatttctatatcttaaaacacatgtcaatttttaaaaaaaactacttgcattagaagagggattacattgaatctatgaattatcttaaccacatttattcttccagtatgtgatgtgattacatttttccattcttatatatttaatttctcttcgcaatgttttgtatttttctgcatattttcctttttaaaaatattaaccataaatattttatggttttgcagattttataaaaagatattttagaaagtttaatttataatctcaacctaagtcttatgctatgatggaggaagacttttggtatcttagtaaaaaagggtgtattttgcatgtaagtggaatataaataatcattgctagatagcaaaatgtagtaaaaagtaaatggataaatagacaaacaagaaaataaataaataaaataaatattacctcatttttgaatctggatggactctgaaatgtttgcacgatagaatcttgcagaagtgttactttgccaattttggcccacggatcttaagagacttgcactttctgattctttcctcttaaaatagttgctccttaccaggttctcaacttcaccattaatgacacttttatcagataatttttagttgtatgagacttcgttactcattgtaagatgtatacagaatccctgacctctaccttgtatttgtgaggctacgccaaaaaatgggttgtgaaaacaacaaaaatttattgtttcacagttctaaaagctagacatccaagactaaggtcttggtaaagttgattccttctgacaactatgagagagaatctcttccatgttcctcccatgttttccagtgctttgttgataatgtctgtcattcgatggcttgtagaagcatcaccccaatcactgctttcatcttcatatggaggtctccctgtgtgtctgtgcctaaattttcctttttgataaggacatcagtcatattagattagaaacctatcctactcaagtatgacttctccttaactaattacatatatttgagatgactttatttacaaataacattacattgtgatatgacctcactgagggttagaactttaaaatgtgaatttttggaggaaaaatttagcacatagtatactcacttgatgcctcttttattcctccagtcctgacaaccataaatgtctctaggctttgccaaatgtctcctggaaaggcaaagtcatttctagcttagaaccaatgttctaaaaaaatttgattacccccaggttgccatgttgtaaggaagcccaagctagtcatacagaaaactacatggacagaagagtgtttgaccaatcccagctgatcaagtgggatgataagtggtcatttttagatattatgtaacacagctcaatctctggccacaataactaagatgctcaataaggaaattaaactcttttctacctataaatatcttatcacactggaattcacttaaaatctagaatagcattatttagattaagtctggatgtagattgcagaattgtagatgaggctactttactacagtttctctgttttcacttttgggtacagtttttcttgattcagagacttacaaatttaagacgagttatctgctcatccatattctcaatatgaaaagttaagcagagacagaaatactacaacagataaacattcttaaaaaaggagagaagaagaaaggtatatagcacagatcagtccatagtacttctgtgacccttcctctgcaagccataagtcgtggctcacgttgcaggtgaataattttcttagccagcttcctgccagacacacaaatctctcagaattatgttctctctaccatgaggtaagagttaagatatgtcctcatgatttaaaaatatatttatctacctgaggggtctacattcctctgccttagatgattcttaacaaagggtttaaaaaccatgcacccttgatcttgacctgaaccctacttttactggtaatgtcctggattcaataatggctctgagtctattttgaaaactttttaccagctggaagtctgaaaataagaatcttatttattttccaacacagtactcctgtgttaaaaatattttttctaaattttggttaaaaacagtcccatcgtcaactcatctcttatttcctgttttatcataggccagtaaatgaagctatttggtaacttccacattttgtcctgaaatcttagcctagttaataaggtcatgctgtatattttctatctttcacattggcacaagcaacagtgatcccagtatttggtcaatatataatacagtttccatttctccagctccagtacaaatttcctcactgatcttacagacatcattaaaattttctgtttttgcaacctctttccaaaatagtctcaatggcacaaaactgttttatttatggtagcatctcacttctaggtactaatttctgtttcaattgtctctatctgtaacaaacaactgacttagagacttaacaaataaaaacctattattatttctcatgaatctgcatattgtatgcatggttctgctgctccacattttgttgactggagttactgatcaactgaccccttcagtattatgataatcatttttacttctggtctgggatctatttgttctaatatgaatatagatcatcacatttttatgcctttttttgaacagtatatctgtctttcttgcaacttatctatgtctttatatttacctgcatttcttgtagattgaataaagctgggccttgatttttttatccagatgaataatctatacctcggttggatttttgtctagttcattgacattttatggaattattttgatcattgaatttatgtttaccatttgctttttgtaatttggcctattgttttttgttgtaattttcttgctttcatttctgttttattttggttaaatatttttattatttcattgatatagccatccctttttaaatttttttttacttgttgctctttggaatgccttttgcataatccatttaaatttgcactactacacatataagaattttacaccagtatggttcaatttatcacatttgctatattattgtcatatttgttatgtttattatttataaatccaccattcagcattataacatttgtcttaaacagttgcatgtgttttaaaaaataaaaattttgtatattctagtgtatgtgcctacatatttttcattttcaaagacttcatgtctttctgtaagtttccacttggtgctatttccctttatgctgaagaaattctttaagattttattagcttaatatttattttattaaaattattatatatatgtttacgagatactttaaaactacacatttggctaacattttaatttatttctgttgggaagcactggcctcggttatgtctatgtaaacgtgaatgtgtattaaatttcctgagggtcatgtgaaaattcaatttctgattctataggaccgggatggcctgaaaatctagatatcttttgattttattctacattttaaaattactgtgattttttgttaaatcataactgtatacatcatggggtacaatgtgatgttttgatatacgtatacaaagttcaatgattaaattgagctaattaatatatctattacttcatttatcattttttatggggagaaatttgaaagttactcttattttgaaatatacacatgtagtaagtgtttaaagcaaattttataagggtgaattgtgatgcttataaataacataactaagtgtaataaatatgacaatagtacagcaaatgaagtaaatgggactatactggtatattatttttatatcagtgtgtcatagtacaaatgaactctaaatggagtatgttaatggtaatctaaagtactttattattcactgtagttacactgctatgtaatagatttcaaatcttatgcctctttttgaagctttgtacccttttatcaacaattcctaattccctcctgcgcccctcctccagtctctggtaagcattattttgctctctgctactatgagtttaacgtttttagatttcatatgtaagtgagattatttggtacttttctttcagtgtctggattattttatttaacataatgttctccctataggttaatcaatgttgtcacaaaagttctttttcaataatatttcatttatgcatatatatatatgacattttatttatccattcttccattgacagacacttaggttgattccatctcctgactattgtgaataatgctgcaatgatgtgggcatgcaaatatcccttcaacatacagatttcacatcctttgcatacatacccagaaatggaattatttgatcatatgctagttatattttttagttttttgaggaatctccgtaccatttttcatgatggttttactaatttacattctcagaatgtgtaagttccctttttcctgcatcctcaacaaaacttattatttttcaccttttgataataataagagccatgctaagaggagtaaagtgatatttcgttgtggtttttataatatttgtatttccctcatgcttagtgatactgagcatttttaaatgtatctgtttgccatttttatgtctgcttttgagaaacgtctgttcagatcctttgcctatttttcaaccaggttgtgtgttttttgttatagagttgtttttgttccttatatattttggatattaattccttatcatatgtacggtttgaaaataatgttttcctttctgtgggttgtcctcattttgtttgctttgccatgcagaagctttttaccttgatttcatcccatttgtctaattttgcctttgttgcctgtgcttttggagtcatatacaaaatatccttgcccaatccaattttgtggagattttcccctatattttcttctagtaattttactatagtgaaaatattctgaggatgaagtctctctagtaataattatattcttgacatcgtgctgatatgttgcattgtctctggattctgttttcttcctttaagcaatgatgttatttattacagaatgatgttatcacatctgaactcaaatgccataccccacctcaatgtatttggaagcagccacaaccactcagctcctcatactttcagtggttgcttccactggggaaaattgagattccctatgtgtgtgtcattcaggcattaacaaaggatttgtgcaatttgtattttggtacccttccttatgtggtgtcctttcttgaattccccagccccttcacttttctgccattctgggagcctcaaattgtcctgtgactcttctacacttaaaattgcagctttctcctattgttttcactgcccatacatatcagactgaaggtagccctcaggtgaaaagcaatagaaatacacattttactcagcagagcttctttctttcaaagcttgactcctctttaatttctgtctgcttctggtaactctttagtgccttaaaacagttgttttcatgatctgtttagagttcacaattgtcatctgaagaatggtttgtctatatgctattccaccattgccagaagcctccaggattactgtttgcctttttgtgtgtgtgctctcctaagtccacaatatcttagatttctgaacactctgatctttgacaaaatacaattttcatagtgcaatgttttctaaatcatttatttccatttaactctgtgcttctcacttgaatcaacctcccactgtgatagttttccaaaaccttgccattgtatcctgctatagtctgaatgcttgtaacactccacagccccgaatttttatgttgaaatctgatttccaatgtgaaagttttggagatggagtctttgggggcatgatgacattctgagagggaaaacctctcgaataatttctgaggtgtataagaaattcgagtccttataaaagagactacagtccttatagaagagatccttcatcccttctgccatgtcaggttacagtgagaagataaccacatatgaggaagtgagctggtaccagacaccaaaactgtttgtgccttgatgcttgactttgcagcctccagaaccatgacaaatatgtttgttgtttataagccacttagtctatggaatttaagatatggactctgaaatatttgctaagaggtttaattgtcctagagggtttggctcaagaacagctgtagaatggctagggatgtagctggtagatgtagatgtgtttagaatttaacaattagggttaaacagctagggatgtagttggtagatttgttatagcactgcaaacaaactcacccttttgttattaacaacctttcttatattatttattgaatatacttttaccttattgcttcattaaaacctgtttcattattattgcatcatattccttttgtccctcttaagcaacagtttttttctatatcaataaaacttcagactcaagaggtgggattacattcccctggttattcattgacacaaagaacctattaatttctctttatttcctcaattctggactactccaactttttaattctatgcaactcctcttaggctacagagcaccaatagagaaaaatcacacaagtttgaagactgatgtcaagaaatgtgtgaactggacttcaatagtgcctaaatttttataatggaagactcttccagggaaaagagacagaacctcagtagaatcaacattggtacagtgataaatttattagctcaagtagcaaatcatgagagtagaagtgcattcggctcaggtacattagggactataactttgccatatctgtttgtctttttatagctttccttattattattatgattctatccttctatgaacttttttcttccaacttgaggacttccttttgccagtaattgtaaattcatgtttcatatggtcaatgtcaaataaagtctgagcaacattttcccaaattcttcattcaagattccaagaataatttttgatgtggttgagggtagatattaactctagtcaaactagcaactcctaaagaaaaatgtggttaggaaaatcattttcaagtgaaatagacactatcaccagcatacaggaaaatgtatattcatttaaatgtgaaaagttttatactctctgatatggtttggctatgtgttcccacccaaaactcttgttgaattctcaaagttggggaggaacctggtggaaggtgtttgtattatgggggcagatgccccataaatggctttcgtcacccctttgtgataagtgagctctcattttgagttcatgggagatctggtcatttaaaagtgtatggcaccttcgcccctgccccactctctctatcctcttgccatgcaatgtgaagttgtgcttgcttccccttcaccttctgctgtgattctaagttttctgaggcctctgcagccatccctcctgtacagcctgcggaactatgagtcaattaaacctctttttttttttttataaactacccagtctcaggtaattctttatagcattttgagaatagattaatatactttccttgaattataaattgttatttttctagtcagtcacagaatataaccatacctccaaattccagagaacatggatttcatcaaataactccctcaaatttctaccagtaaaacctctagtcttacctatatctccatccatactttgtatttggttactttattaccaaagaacgacagattcatcactgttgatcttgacaaagtccaatttattaatttttccatttctggatcctgttttttgtttcaaatctaagaattctttgaatagctctaagtcccaaatattttctcttatgttttattctaaaagatttatgattatatgtttcacatttaaatctatgaccatttatatttaagatgacatttaatgttatcaccagatttgtagattaccatcataccacattccactgccctctctgttaattatcttctctacctcctgaagttgtagtttctacttctggtctaacatcttcctatgcacacattaggattactaagtgtgattggatcctagcaggcaagagatgatgcaattgaactcagaaatgtgtggggaatttaataagggactacttacaaagtgcggcagagcatgtgaaaaccaccagaaatagaatgaggtcttttctgccacccaggagctgagtggaggtagctgagtggatggtgctagaacctaaggcagaggagctgtgtggagaccactgccttagggaagataacctgatcagtggaggggcatagccagcttgaggcaaaacacagagggaaatgaggtgataaatgtatttgcatctgtctcttcctttcctcttatttcatattggggctcccatttgccaaactcaaaagaaagcatggaaaatacaggtcatgtagtgtagcttcttggacactgagtagatctgaaagggttaatggaagatagccatagtctcttaagccccataacattttgataaacaaatcttgcttttgtctcacgttccccctatttagcctcgtttctccttaccacttttctaccaaatattttcaagaaggaatctagttttactattgccactttttcatttcatctgtacagtcccaaatatatcatcatcaatgactaaactccactgaaaactcttcttgtgaaggttaccaaggccactttagtaatagttctctggaccattttcacaccaaatcacattggactgtccaatcctatttaggactttcttactacttcttcctaattggaactctcccatcttttgtgttcatctttggcttctcattgtgtgttcctttcccgatccagcctttatattttagtatttcttagtaaccaatcctatgaaaaaacttgaccattccatatatacttctttttgactggtgatttataaaacgatagtccttctagaactttctcctatgcttcagatgcacatactaggattatttaaaggaaaccttgattttaataatttacaatctgacagattcagtatgcttgaagctctcctgatctccctcttcattaaatgtgcttcttccactcctgtttccctaaagcaacaatccatttatccgacctaggaaactgaacatcattttctttttttcttactttacacatctgaacaccacaacattctaacctattttgtctgtaacctaaatatctcctgaaattatccaattacctaactcaagccctgtttccatacctctacaatagaccacagcttgatttctgcaagcagttaattttttctttccagtgtgccataagtagattttaggtgccttgtcacaaaaagaaaagtaaccacatgagatgatagatgtgttaatctgcttcgctatagtaaccattttactatctatatgtatcccataaatcatgttgtaaatctcaaatacacaaaagaaaattaattcaaaagaagaaaaaaatcaaattctactttataatttagaataatctccccaaatttatgtttaattttccccagattaatgacttcgcattgcccctaatattccttgggtgacagttctggtttgaattctgttgaaaactccagcttcatgttctcagagtaattttagctaaactgaatgtctttgaggtctttgaattcccacaggttcttttgcctctgctccctattttatttaaatttattccaggaacatgtataatacgaggatatgcatggcagtttagcacttatcaatatatacttctttcaatttaaagggaaaagaccatttttcacatgctgggaaataggtagttgacacatttgaatagatttgaacaacctgaaaagcatatatagtgaaaaagtttaaaagttgaggacagaatgctgaataatatcacagtttaagggtgagtattgtgctggaaatgaagaaaggtacccatttagaaaacaatagcgttgttattactttccaatttttcaaagctttcagaccattatgaattcaatgcaaacaacccttctctgtgatttttaacttaattataattttgtctcattgttagagtgtcaggagtacattttctccttttgacaatgcaaataaaaatgattagtataaaacgtacggtatagttaaacatttctctaagtttaccagacctgtcatcctattgttgcacataataggtaactcagctgggatgggccgtacattaacttgttgataaaaccatataatatgtttatacttatggtcaattacagtactttttcacttgatatgctaactttacagaaaatatagtcaaatataattacccacccaaatggagcagtcaataggttataaaggaagaaggaataataggtctggtccattaacatgaaataaaattaaaatagtagaattaaatacatgtttggccaagatattaaagagctttgaatctaaaataaaaataagagaaaggaataaaagaagcaaaaaaatattttgttttaaatggtagatagaaatattcacatctttcactcaggttccctatatgcttgctgccaaaataaccttagcatgttagcacttacaacgaactaaaggtaaggatttaatcaccaggaagaagaacacaatactgctaataaaaaccaatatttgctccatatttactgtttaattgctagacagaacaaatgaaagacaaaattaacttcaactatttaacgaatcgtttattttttttctattggattaataacttattatggactcagtattttacagttcattcaatttatttgaccactcctccaaaataatactcatattgtcattttcattaaagaaatttaactgacttttggttaatattctaaattgatctggacttgactttaatacatttccagaacattagagatggttgtttgggtagcccagccaaaatattttatactccaagaatctttagtatagctgtagattgagtagactggagcatttaattacagcatctgtagatccccattgtagcttgacacaagaatgactgaatatggcctgtgaaggctgaaaaactaattgctccattatctgcactccagtctttttcacttcacaagcacttaaaaatatatacttaaatctgctttctaattacaagttcccataacagagtgtccctatccagaaaacagcattattactctggctttcaacacacttaagcatttttattttgctgagttttgttcttctttgtttactttcttttgtaaacatgtttaatggctaattaccatttcagctttttatattaattactacacatttagagacatgtgtctttaaatctctagcagataagacatttgctttgctcaaacattattttcattttacttgtctatacgtagctttagcagaatgacattcttattaagtacttactttcttgagaatcaagcaataatttatgacaaagccttatcttttttgcattagctactgaaaacttttatattttagaacaaaagagtaacaacttatttctcagcatcaatatatgacagaaatataaggacaattgttttaacagtgatatatgcaacattattttcccccagaactccttcatttaatgaaattcaatatgtgcaggtttcattttatgaattataaagtcatcaacaatttagtttgatgccagtaaattcacatttaaaaatctgaattgtgcatcatactttatttttaaattgacaaattaaaaatgtatatatgtagcattcaatgtgatgttttgatacatgtatacattatggaatggctaaatcaagttaatgaacacatgtattacctcacacacattttgaggtggtgagaacacaaaatctaatctgtaagtaatttttaagtatataatacattgttttaaactatagtcatcatgttgtacagggcatcttgaattaaataaattctcctaactgaaattttgtatccttttaccaatacctcctcttggatgaacctggaggacatcatgttaagccaggcacaaagagacaaataccgcatgatcccacttatgtgtggaatctaaaaaaagataaagtcatagaatcagagagttgaatcatacctttctgtaggtactagcattaacttcatatagattacagtatcactgatatattaataggcaatattaatattaataggcaatttgagtattgtggtcttttctacccactaagaaagcagccctattcctgaaatgcactttgcttctttaaatacttcattggtaagtaagacacttcctcaattttgtcaggaacaacatttacatggtaggcagttatcttctctttacttccattatatttcatggacattagttttagaatttaaaactgctgattgggtaagggttgccttattggttagcactgattataatatattttaaggaaatagttataactatgtgaaaaaatagcatttttcacatacccaaccccatttagttctgggggaaagatgagtaagtgtgcttaatcccaggtgtgtgtgtttttatgtgtgtgtgcatttatgtatgtgcttaataattacttttcttatgtagaaagaaaatttatactttgaggcagtatttaatctcatttactttacactcaaaacataaaatcccctacttaatacattttgtatatcaagacaaatttatacaaaattcatttttggaagtgctgggcatagagggcttttaataaagagtgcctcagaaagccatcattggccatgacaatagacacgttaatgacaacagtgcttattaggaatgacttcctcatatctttttgttttaattaaaatagaaaattgtggtatccgaacatggaaaatatgtatgcagtctggatcctgctttgctacatgaaaagcatgaggttttgttcaggtatattataataattatatcagggaaagtgaaaactcatttttacatattaaaatttttgttcatttctgaagaaaaattaagtccacagtaacagaaaaccaaataataccctttccttcaaaaagaaatacgtatttgaaatttatttgctaagttcagtttctaagactagaatttgaaagggagccagattaaatcaaagccaaccacttacgccagtggatgaacacttcatggaaaaagaattgtattaagggatttattttccacatttatttgttttttaaaaaatgaagaaaaaagattctacagatatcaaaaaatatacagcattaataacattttgtatgaaagctatgctatttttggaggatctgtaattttagtactagaaactaacatgcataaaaacactgcattattcagctctgcagaagtaattacaccaagatttttctaattattttctattgttcccataaatggactatataatcacaattcccttttcggacaaatacctttttccagtatgtgctttaaaaagttataactggtaataaaacgtaacttctataaatggcaaaatgtttgaactagggtaaattctcagaaaaacactcaaattctcagaaaaacactcaaggtgccatatcttacaatttcatgtatttgctaaacagtcactgtacatattctttacattttcaaacaaattcataaatgcataaactcataaagttatgtattattattatgctacacattttactcaaaatgaaacagttatgaatctaacctagtacaatggggtaagagtcatctacttcttatataaaaaagatagacatcattttatcaaaatatatgttcatgcaaataagcatctaatagacaaaacttggactatatcaacagaaagccacaattagctcaaaaaataggttataggttatagtttgatcattttctacaccaggggccagcaaatgttttctatagaggaccagatagtaaataatttaggatttgcaagcaaagagaacatatactctgtacttgcgtctgaagcagccatccaccatacataaatgaatgagtatagtcgtgtttttgagaggcacaaaacaggtaaaggcctggatattctcccacaggacatattttgctaacctgtatctattgaattccaaacaagtaaagttatcaaattagtgaatcaactaaaaatttaccaacttaatcttgtgattttaatgtgtcattctggagttacattgtttatgtgtactatttttctttctttgggaaaaagactgtgaaatcactaacaggctcagagcgaatttaatcagaaaacaaagagtttctaagttttacaaatagaaattatttgagctttttgcatagaaactgaactcatagatggattatatatacactttttcaaaaattgtatttattcataacaataaaaaattcaattctagtgaggtattcaaggaaagtctttcctattagcattcaaaggttaattcttaacaatgctggttgctgtaaagaacaaagtaccttaaccttagtggtgtagcacaataacaactcataaattaatttgtttatctctcagtataataggggtattcctggtctgtgaacatcttttcatataagaattagggacctatactcttccatcttctggcttttctctagtttttcaggcaactccaagaagaatgtagaagaaatgaaaaagttaaaaactgtgagatatttttatgaaccacattgcaagataaaaactactattgattttctgttggtcagaattcattcacgtggtctcatctacatacaagataattaagcctgtgcctagtagcaaaagaaaaagataaacatgtagccatcttctgatataccagacatgtttccagctgaaagatgtataagaatataaactgaattagaatgtatttatgtctaggatagggtgtctacagtataaatttatgtgatgtgatttccagaaaaatattatacattattaggtatgtgcattttaaaataatttaaccttgtttttgcttttttgttttatgtatgtacagttccattgaacgtgttaatgtaccatataaagctaaggcactaccattaactgaagaatccttttcactataattcatagattaaaatatttagtatttagtatatgaaggttaaaatatttatgattacctaacatttctattcatgctttgcaaattctgttttgttttaatggaaaatattttggtttggttttggttttaggttttcttttgttactgttttttatttgtttattgtataaatggggtctcactttgtcactcaggctgggctgcagtggcacaataataattcacagaagcctcaaccttatggggtcaaccaatcctcctgcttcagcctcctgagtagctaggaccacaagcatgccaccacaactggctcatttttcctttctatttcttagagacagggatttgctatgttggccacgctggtctagaacttctggcttcaagcaatccttttgcctcaacctctcaatgtgcaggggctacaggtgtgagccactatgtccagcctaatgtaaaatattttgaatcagaaattatttgcaattgtttatttgtaaattaaacttttattttagagtagttttagatttacagaacagttgcaaggatagtacagagaggtcctgtatactccataacaagtttcccctgtattaatatcctatgctactatggtacatttgtcacaacaaatgaaccaatattgatgttattaactaatgtctgtactttatttgtatttccttagttttaagctgatgtctttttttctgttccaatatctcttccaagataccatattacttttagaagtaatatttccttaggcttctcttggctttgaaagtttctcagacttttcttgcttttgatgaccttaacagatttgagaaattctagtcaagtattttttagaatgtctgtcaattgggatttgtctgataattttttgatgactagactcagaaaatgtacttttgaaaggaagatgagagacaaaaagtgccattctcatcatttcatatcaaaagtttaggttattaacacggctgtgtatgttgatgttaaccttggtcctgtagctcaggtagcaattgtcagacttctccactgtaaagctgctcttccctccatgaccccctttttacatgccatactctttgaaagccagtcactatctgctgtccaaatttaagggatggggagttttgttccacttcattaagttcaaagtacctacataaattatttgggattattgtacaaaaagatgcatctattacttctcatttattcattcaaccatacatttccattagtatggactcttacatatttatattttgggtaccagccaatattcctttattttggtgctcaaatcattctagctttgatcattgggagctccttccattggctcgctttgacttaatctcagacttttgtgtttaagtacttccacattttctggcattacaatattattcatgctatatttcatgctttagtcctaaaatagctagatctctaaggagatttgattttttaaattgaagaatgtatgaaaatccaaaatctgggcagtagaaaaacagctattttttaaatgaagtctaccagcctgggcaacacagtgaaaccctgtctctacaaaaatacaaaaactaccctgatatgctggcatgcacctgtagtcctatctactcaggggactaaggggaggatcacttaagcccaggaggcagaggctgcagtgagctacgatagcaccactgcaccccaaccttgttgacagagtgagatcctctctcaaaaaataaaaaatgaagtctaatatttttaccgagattacttaggccattccctctgtatctttaaagatgtatgattaaataagtatgaattgatatcccacctgcccaagcatgataaaatagtgtctattatataaatattacatatttgttagaacattgttggaaattataattaaacaattattattaatttttggcagacattgtggtatttaaataacatttctcatttaaattacattcaactaaatgagctagatatattcttattgtcatttaacagtgagaaagttataacttaatgtgtttaaatggatgtaaaaatatttgaagtgaggcaaacaatcttacatttttcataagtaattataagatacctttttaaggtaaataggtataacattaaaaaaaatctaaattaattttatttagttgaacagtttcaaatttcttagcttagaaagagatactaaagttcaaggaagtactcaatgaattagtatctatatactagttgcaataatatattaacatatttataaggcaaagcaaggatttgtttagtttatggagaaaaaatacaattcctgaactgaagttgaagaaataccatcaaagttgaacactgaaaaattaaacagatgattagcttagaaagaagaagagaaaacttgacaatttcataagaaattaaataatacagaagaatatttcaaatataacatgctaggctggtaatatattccttccttacttttttattgtatcttttggtttcattggtgacctttcaaatagaaaaataagaaactcaactattttagtgtgtatgtaaacaaaactaatttcactctagtttctgcctaaggaataattggttggtcactttagaagctgactttaagaaaatgaaggactaataatgttgttggaagactgaaatgagttcagacaagagacagaagtgctttttaaagttaattatgtttgcttttccttatcccttggtgttcattacctttaaatggaggcacacactggcagaagtaattaccaggttggtcaatgcaggtggctccatttttgcagggatgtgaagcacactcatctatatcaatttcacattgcgtacctttggaaaataggaaaaaaaaatgttaagtgttaacaagacaggcatgtatcaagtcgtaattcttaaatttgcacaagcctttaatccacttaggatgacatctgaaaccaaatttattagataagaatgccacatatattactatcagaacccatttatttcaccttgctacaaactgtagtaacttctcttagaattactaaaaggacactaatctcttctgagtttgtaggcatgcaaagtctctttagatgtgaactaatttatcttttgctagagagtctagagatggtgcagatatttcaggttactgaaatgcagatcaaatgttaggtgaaaggaaataaaaaaggaacgaaaagaaaatattggtgaatcaataacatcctgatgtatgtccctgagggctgaatgttatttgttcatttgtttgttttggagagggaatctcgctccgtctcccaggctgtagtgcagtggtgcgatcttggatcactgcaacctctgcctcccgggttcaagaaattatccagtctcagcctcctgagtagctggaattacaggcacacaccaccatgccaggctaatctttgtattttcagtagagacagggcttcaccatattggtcaggctgttctcgaaatcctgacttcaggagatccacccactttggcctcccaaagcgcaggaattacagacatgggccactgagcctggccctaaatgttctttataaggcacagttattgagtactatttactaataaagccatgagtaatgggtagatgcatttcaatctactcatgatctttgtagatataatattatggtgccagggtgatgaattactttttttctagtaattttacaacgtaagcctatatggaaagaaaacaaataaatgtccattaactatatagtcttagcattttctttaaactgttgtccaattcatattttcattcatcctccacctagaacttgttttgctaaagctgacctttcttattataccacttagattgcttaatttcccaacagttgaaaatcatagcctcaactgacactgaattgatttttatcacttatgacagctaattttcttaccaatttataacaataatagaaaattgacattgacacaatgcaaattattagcaaattatttgaatggaaacattccttctttttttaaaaaaattctgtaaaacagtaacatgaatttagaaagaagaaaacctacatcaaattaatctaataggaatcaacgtactggactaaatagaaaatatcactattatcactgacaaaatgaaatatttagtgaatacctgacactagaacatcagggtaagctgagaaaaaaagtgaatattaaaaagaattatgtgagtgaatgaaaactttttaaaccttaaatatattagtttttttaatgagataatttaattttgtggaaattgagaaccctactgtcaaagcaaaagtttaaccagaaaaaaagttaaacaatcaggaaagattttattgaaggctattgcaatcaaggagagaagccaaaaatcagtctgagtttgactccattgtaacaatggttgagagtttttaagagctggggtaagagagctcataggtcatatgcatttgctatttagccttaacaaaaagaaaattagatttgtttttcaatcttcaagttaggaggtagtattacaacttggatcaaggtgcataccaaagttagtctcctaccctcctacagagactgggagattacatatgctatcttccttacacttcaaagggatggctcccaggtccttgagaaagatagtcttgggttcctaaatgaacaagaggcttttaaagatatttataccccaaagaggcaaagaaagaatttataattattgggttctgaagtaaattctctaagaaaatgaaggggaggaacttctgtggttagatcatttagatcctgtaaagaggtaacaagagaagcacctcaggaagaaacctgtttaagtttagtcacactgagggaaacctgtttgtcttgtgacaaatacactttgtggagattcctacagtcctcaagttcccaaagactggaaggaggaaagaaataatgaaatattaatttataatattaacatgatactcttctaaatttctggtgaagttggagaaacatgggtcacattcctgcacacaggggaatcaatcaccctgtccctctctaggttactattcttaaatatgtctctgtgtcttctgatcccagcttccccttatcaacctgaatgtcacactgccatgagcttgtatttctaaaagacaaatgtgatgaaatagctaacaatttcagccttcaatttctttccacccctcatccgtatttcccaaactaatctattagagcaatcctaactaatgaggataaagaatttatgatcttagacatcaggagggtttgacaagacacctacaaggaagactttttttttttttcaaatttgacactttaaattcatgcaaatcttggattttgcatcatattttatcctcattaatatataacacattctataacacaatacgtatacacccatagggaaacttgacagtccaagatgattctacaatcactgttgtgactttcatgaagctttaaattcatcccctaaagtacagtgctttagcaggagaaatacaaatttagaggatgatgtaaaaaactcacagcatactttacaggaacatcatggtctgtacctagccttccttcttggtcttctctctcttatccttccctgtttcttgttcaccctcttacccaagtaaccacaatgaatttttaaatgcctgtgattttgcctgggaatacctggtttccttttaaaacctggatcatctcaggtatcctctgcctattctttctgggtacaggttagcacaacacttttctagtgtttacaccttcttctgcagtcagttgcatatataaatacatatatatatatgtgtatatacatgtgtatatatatgtgtatatatatatatatatatacacacacatacatatatatgtaatttctttaaaatgtatgcttatgaaaatattttctagtatccatggctcttagaatagctactgtctgatattagtgctcaaaaaccatttgttaaatgaatgaaaaattaacagactaaatgcagaaaaatgccaatgatactgtatctgtaaaggacaggtaatcattttcaatcctgtttaggacaaatcattaacaaaataataaaattccaaatgatgtaataaatatcataaagattgccagaaacagattttgcgactgactcttcaatttcagagtgtgttccacatgatttggcaacaataggccacatttaaggtgtacatgtatataattttagagcttttattgccaaaatgtagattgaatttaaatgagatttcaatttgattcagtgagctgtagtaaaatttccacttatttgacaaataaattaataagcataagtagtttgaacacattcaataaaatagcattcatgtatccttttcaaaagtttctgggcagacaaattaaacaatcaagcattctacatctcattattttaaaatagactttaatttttaaatagttttaggttcacagcaatattaagcagagggtacaaagatttcccatatactcactccacacatgcgtaatctctcccattatcgacatcccccaccagactggagacatttgtgacaactgatgaacgtacattgactatcagacacttcattttaaaataagtttcatgtgttaatttctaaataatcatattttttcttcctcatgtatttctaggtctatgtttcaattccacctaacacacacacatacacacacacacatatacatttaaattagttttccttttaattgtttaactgaattttaatctgttacttaatgatatttacttccatcatattcctcaattgcttgcaccatctgggctaaatcacactgtgatcgttttctcctcataggaaccatcatgtaggaatcatccattgaccaaaaagcaatccaaataattagagttctgtttcatgcatagtatctcaaacattctatgctttctttactctgggttttctgtttcttcttactctttatttttttgtggtctgtcctaaatcctgaatttgcttcctgttttctcctgtccattggatgtcacctttatttttgtttattcattctttcatttgaaattatatttttctacctattcatgtaattgaaaccatcaactgatttacagaaacctcaaccgtatcatgccctctacatgacagactcccaaatcaaaatttctccagtcccaggaactcctggcttcaatgcctaattaaatattagttgacaacaccacttggacatattctaggcatctcaaattcaacatgggcaaacaaaactctctaagcagctctaccttccttattaactgtgataaataacaaaacccaagagttattctttattgttcctcaccctccctgaattattagtaaatctttgcaactttatgtctaaaaatgtaccaaacctgtctatttatctccatctctattaccaatatctagtctaagtatccccatccccaatgagaacaagagttgctttaactgtttttctgctttcactcttactctaatgcagtgcacaacacatccagagtaatttttttaagtgtaatataattaggaaatacaaatccagtaagaaagttaatggcagtactccaaactccttaccttatatgataaggccctgaaaacctttgagtttagaacacatagtaatcctttcttgctcacttattttccagccacactgaacttctttagattattttaccaaacccatttttacctgagggtcttgctctaacaacttctatcactggaaagtcttctctggaggataactcattcttatccagtttttggtgtaaatggaaaccgcataaagaggattatctttactatccagtaactcctctcacatcaccgtcttttactttgctttataaaacttattacacacatagacatgcatgtatatgggtatgagtttgtgtatttcttatttttgtttggttttcctcccacttgaaaattagcacacaatagcaagtaccttcttttccatccttagctgttggaaaatagttgacaaaatagttcacagcgcaaagttgggccacattaaatattttaaatgaattcatgtattcttggaagtcagagtccattattagtatatgaaaattacatagaaatgcaactgtttatataaaacaaagaaaaaatagaattataagaacttaatttacatattttacaattttctgaaattatatgtaaatgtctttcaatcttcaatatttatgaatatcattattaaatctggttattattaatgtagaggtggaagctattgcttatcctactgaacttgtttgatcaccatcaaattcctttttacatatattttggtttgtggaatgtattataaactacatttattctaaacaaaagtcttactttaacataaaaatctcactgtatagcacgttatatgagatttcttcttcagtagaaaagaaaaaggcactaagtactattactgtgggagaactagagcatagagtatggtcagaaaaatgggggtaaatgtcccataatttcaaatcaagtcagagcagtagctctttcacttacaacccaggtcagaataatggccaaaaggtgtctgatccaaggagtttgggagaaagtcaatactttcaccaatgatgtaattaaatgaggtagaaatctaaagttaaaggaaatgtcttttctcttccatgcttagttttcattcagagtaactttgccttaaaactcttgaccttctgttattcaaatttttttcttcccaaaaatggcacaaagagttatctaaatggtgacaaatagccattggctcaaagttgttagtttacagtacagctaaactttcaaagttggcagaagagtaaatcactgtctcttgccttcctcactggtactgatagaagccaatagtctaagtactctgctctgcagactggacatactcatttggattttacactaagctatatcctcctagactttattattaatgtaatactttgttggatggaagaattttacactaagctatacactaatactttacactaggctatatactaatgctctgccatatactaatactgctatacagtaacatactttgctacatactaatatactatatatagtatattatatattgcatattataagtatatagtatatataacatatataatatatataatatatagtatatatagtatactatatatcatatactatatattatatatgtatgatatatatatgatatatatgatatatatatcatatatagtatactatatatcatatagtatactattcttctctttatttttttgtggattgtcctaagtcctgaatttgctatatatcatatagtatatgatatatataccatatactatgtgatatatagtatacgatatatcatatatactatataccatataccatatatcatatatactatatactgtatatgatatgatatatagtatatgatatatagtatatataatatataatatagtataatatatgtactatatactaatatactctgctatatactaatatactctgctatatactatatatatactataaaagttatatactatatagctatatagtaatagctatatactaataccagtactttgttggatggaagaatatgatttatattatggttcaaactcaggcagagaaaaagaatgctatttcttggttcaaacactcacagacccaataggtctaagtgtggtctgtgtttctgtaataccagaagtggacttgccctctattccctcctcaggtagaatctagaaacgttatagatctctggagataaattggaaaaattgtatatgcaaaccttggactgaaagctgggaagtgagtacctaagatcttagttaaaggagctgaatagtcaggatggccctggaaggtgagtctcacagaaaggctgatccttaattttaatgttcacctctagagctcactgcaaacacagacactaggcatggaagtggcaggctgacttgagatctgattctttgtgtgagtaagccaccaggaaacccctaggcctctttctttgtgactaagaatctaggcgtgctgagccttcaggtgtctaataacatgatggagaacatgagtttatagagcaggtgtcaattaataggcatgtattaaaatttggggtgacataataaaatcatcacaggacctgtcttataaattgaaaattttctcacaactgtgatacagtttgttgactagaaatacttacttcccagatgataatctgctaatggctttaggccaactaaatttttttcagtgttgaaaaacaaatcaaaggatttacttaaaagtgatttgtctgggaaaaaaacaattttttttttttttttgagatggagtatcgctctgtctcccaggctggagtgcagtggcgcgatctctgctcattgcaagctccacctcccgggttcacgccattctcctgcctcagcctccagggtagctgggactacaggtgcccaccaccacgcctggctatttttttttttaatttctagtagagacggggtttcacagcattagccaggatggtctcaattcctgacctgtgatctgcccgcctcggcctcccaaagtgctgggattacaggcgtgagccaccacacctggccagaaagcaacatcttttaaatgggaatacacaagatcagatttatagtaattcttcttcacactattgccacacatgcctaggaaacttttataactggcagttggccttgtaaattaatacgtttgacagtgcacagaagaatgtgtcacatgtatttgttttcaatccccacacttactaccttatggttttcctatggtccttgctattagaacctatccaataaatgtaaatttcattggctgtctacattatttacagatatctacaactgaatggccctcctgcaaaataagcatattgactgccttcagtttttgttcaaacatcttggtttaattagttcaatgacaaccacaaaaataaagaggctagggacatcattgcttgttgatgggcatggcattttcaaagccacagcatctgagcctggccaagccttttcattctggatcccacagagattcctcatatcagtaaatggttaataaaataatctcaatttattaaacattaccacttgccactgtccaaacatgtatattgttactagaattgataagatgaagccagtgaaattacataaatttcttaaagctgtgagtcatgtaaaaattatctttgattgtacctttagcaattttgaacctatttccaggtcatgtacaattggtaataacaagattactcttggcaattatacacttgcagatttcctaatattctcaggtgaaataacaatatggaaacccattttcctataatgctcagtctcataaatgaatacttttttgtataatgaagcaggagcttattaggcatgtcatcagagttgaaagaaaaagtacaacagacctgtttcatgatacagtagactttatatcacagagtgcttcagaaagaagatattagatttatagaaataatcttgtctcagtttttagtcaaaattacaacatattcaaaagactgaatacaaattgattcaaacttgaattcattagggaagctatctaaattggttagattttatgctttcaaatgagttcctttcttagtagacatttgctaatcatgcactaatctcactgcagtgaaagtaattaattcacaaatagttacatattgcattgtgaagatactaatgatatactgtgcatgcaataattgggaaatgggctataaaatatctgcttaacaatatcaaatgggactggtcatttaaatgtgatatgtaacatttagcatatagaattattattcctgaaacgacagaggagagaaaggtcatggtcttttactaattctacttctaatcagcttaggaaaatggccttgttaggaggaaaatggcaatatactttcaagaattaagatatctgctattcttaataatctgtgtctgttggatcaaactaaagaaaagaagagaactagagagtgagaaaaagttaattatatccccaaagggacaaagagacatgtatgtggagaattcaattggaaatttccatttccaaactaactcaaagtcctgcagcaggtcatttttaaaatcaggcttaaaatacatatgtctacacccaagaacaggatattctttctgaatagctggacataattaaatgattattcttccttagtccctaaaaattggagtctaacacaaacagtaaaggataaaaaaaaataatgaaatctaagatgccacagattgctcaattcatcacaaaattgacaaacacaccattaattattggctctctggttttagatatgatgtgaagaaatacaataagtgtgctttagaatgtataaaatattgtcaaagccagaaatcaatgggtgtatcagttgggggtccagagaggagacaggaattacattagtaatttgaacaggaaaaattcttatacgtaattattaactagaaaacataattaactactaggaggagtaaagagacacctaaaaaatagaagattttgggctttcctaatatttgcaagtaatgtctcccattgcataaagttgtccactcatggacaggataacgcaaaagtaccatggcagtgagaagaccctcctaccaaactcaccatgtttttaaaaaatattttgtttcctgtttttaataattttaatatcttctgttatttacatgttatataatgagcatagagtcaactaataatttaattacagtttcagtaagggatatgcttattaaagaggcagatattaattctatcacatgctagcaggttaatagtgtgaaggtagggttaatatcctcaggtcacactgctacttcctggacattaattcctattcatataaaaatcactgtattgcaaagtctaatgacaatttttgacgttatcttctatgccctcattgcatttctccttctcttagaaactcttcctcttatactaaagattttattgcctgagagatttttcaaacctatttctgtcatcttggctaatgccaacatgcatttagagcatccatgaaatcagtgcatttctcattttctcaacattctactttccaacggagtcgaatgttaaggaaatccatttcacatcagtcacaccctcccatggctaatccaaggatattgccctcactgttctctcaaataatgaatacaaacattctgctgacatattattattcagttaatcaagtgtgacctccatcacctatccttgttgcccattctcaatttctcccattacacttttactttgaccttcaggcctttgtactattttttcttctattccatgaggccactcttgtgcaaatattttcactcctttgaatttttttagtgatatcaggaaagcagagagtagtcatagcttctcacctgtgtgtctatgtaccaacatgtgagttccaggtgggactagatattaatccccttagccctagcccaggacatagaaactggccaataccagtttctaggtatcataggccagctacctctggcttcaagaaggcttgtaagtatgtaacagatgtcagaaaatgttaccaatttttacttgtgctctgatgttaaaaaaaattgttggcaagcaattctttgaattaatgcaataattgtttgcttatgttcaactctactcataagccatgctctgcagtatctgttaaattctcatgctatttataaacctttcttagataccttagtatacttttaaatttctctgcactcctctaatatctaatcttgctaaaatacatcatcctttcaagagatgatttaaatttttacctcacagagacaatagaaggcagaagagaagcactccatcaaatttaggactcgtaatcttcatgtttacacacattttctcctacatttttggtactctctttttctttccgaaaataaatgtgatattactcctacacatgtggttgttactcaagcttgaagttttgggggattcagtatctccttcctcatctcttgcatcttcaaacttctgcttttactgtcttctttgatcggcatttaaaactattctagccttttctaccttaaaagaaaacagaaaactttcatcttacatcatcctcattctttctctcttccttcctttgatgccaacttcctttaaagatttaacttatactcattttctccatttccttaagtcaactcaatttcagtcacagaacaagtgacttctgcctttccctctacagaaattgctttttgccattgttacaggacatcattaaaggtaaatccaaactgcgatcttttggtccccatcttacataatctcgagatgacattgtttattgttgatgtctcttaagtgcactcctctcagctacacttctcactgttttttatcctttactttgtgtgtctctcgatgtagcttctgtggtttttctactcgtatcttaattattgacatgcctcagctttggtcatgggctctctttctcctctcaatttgtatacatacctgagtaaactcatacattatactggttttaatttttattttttagatgattgactccaagtttacatccttagctcagatttttcttctgtgcttcaaaatctctccttcaactgaaatatctgaacagctattgaaaggttaatttgggaagcccataaaatagtcagatttatattttccaatataaatcattatctttctcccaaacctttgatttctaatcctgtttttcagtaaataacaccaagtctatatagatgctcctgtcagaaaactgatgtttcttttcagaacctcactttcactaattaaactcaagtgatacacacgtcctgtaattttatctccatttacttcagtaaaaatatgaggttaaaacaattcctaaatactgtataataaatccactcttccttcaccactgcaactatctaatcctgattgtcattaaatctcccttccattacaaaaacagcgttctaagtggctttcctgctttgggtcttatctacgtgctaattcattcttcatccagcagcaaaacttctctctcttgaaacacaaatatgaacatgacatttggcagtgtaaaaccctcacatatgtctcaaatcctcttaaggtaaaagcccaaatatctcagcaagttttacaaggttctggagagtcttcacccttgttaggcctctaccttatgtcttgtcactttctttgcatccacacttagcagtcactcacatgcactcactgttggactctactcataacaaccttctctcaatctcctacaatatttttctcattcttacatctagagttttgtaattttaatttttttttgtttgtgggtacactgtaggttatatcatggctagggattttaatgctgttttcttggtgataaagaggtcactagcatcctggccaattcctgttactaactatatcccattctagatgagacttattttgagaaatcttctttttctatgggggcaaatctggattaggtccccctcctttgtgtcttcaatacttcctgttatgtatttgcatcgcatgataccactcatgtctatgtttaagtttactggtctgtatctcccactcaactgtaaacagaacagttttccctactattgaccatttaatactctatgcccggcactattcataatccaataaatatttactaaaagcatagtataataataaactcaggataaaatggatgataatattaaattgcattttacattatttagaaatcacctatacatacatttgtcacttttttatttcacagtttacggttaatatgacatttactatcttaaagacctctcttccttaagaaatggtcattcttttatcattgctggacatgttgttttagtttttaattataaatttgtctttactaaagccaaacaaaaggaatgtatttaaaatggattatggctaaatggatgaagtagttatcactaacttaaaaaattgcagaaaaatgtagaatttagaaaaaaaacaaaaacttattttaaaaatacaaataatttaaatccactctagagagcaagaaagttgttagtatataaactacccattagggtttttaactttcagcctatttgatatcagaaaatttgtttggaatatgcacttaaagtaaaaatacattggcatatatctaaacaatcagaatgggactattccatattataaatggaattctggaaaaaataatggtagtgttgaaatagtttttagatttctgtgaatgcccatctaataacaggcagatcaactagataataaaatttaaaacccatgaatggcatgcacaacaaaatttagtgacatggtatccccatgaatacatactcacatataccaacaacagcaactctaaaattattcacaagaaccaagaacaatgtgtcacatacatctgttcaactgacaaccaagggaaataatatggcatcgtatgggcctgaagacaagataattcttaaatagatgtgaagtattccctagaaagcatagtaaatcaacttgagaacagcagcatgattgaatgtgtcctctccaaaattcatgtattgtaaacttaatccccagtgcaacagtgttcggaagtgtaacattttgagagatgtttaggttatgaggtcttcactctactacatagattaatgccattataaaagtgcttgatgaggaattgcatccctttttgctctttcatcttctgaacctactagtgtcttgatattgactttccagcctccagactataagataataaatttctcttctttataaattacccagtcttaagtattctgttacagtacaaaatggactaagacaaatagtaagctccgaaggattttgtctgcttgtacaatgtgggattaaaacagataaacaaaaatatcttcagaacagtgcatccctataaactcacaatattgagctgcctcagttgtcttcccaaacagggctacatattggggagaaattgtaagaaatttaatagaaattgagtaggacagggaaaatagacattaaagacagagaagactagacaatagtaggagaaggaatcagagacctaagatatcttagcatgcaagcagatatacaccagaacaataaacaaacaaacaaacaaaaacaagagaagagacagattgctgtgaattgaagaaagctaccctgaattatgtctctttctaaacatccataaagactaatagtttgtgaaaataagcaaaagaaattatcaaaatcaactccaatacaaaattatttaaaagaaatggaacaatattcttaaagtgaatgaaagtttctaaaataataaaagcaaataatgaaaacattgtcaaagtgagatccaatctgcaatgtattactatttcaaaatgagctaaaacattttgagaaaataacctaagctatgaagatacaaaataccaattagaatactcagtaatgaggtcatcaaattcaaaaaagaatcacaaagtgaaaactttcagaaatgaatattataccaaaaagaacatgacaaaggatacatacaataattacgtaagataattatttgaaaaaaatcaagtaaaaaggaaattaagaaagagataaaaatgatttgagagaaataggcaaatattgaaactatgcaaagaagattcaatatttgaattaaaagactccctggaaaagaagcaaaagaaagaaaatgaacaaacattatataattaatgttttttatgaacaaacattatacgacattatataattaaacattattataattaaagaaaactttcctgaaaaagaaaaaggtttcaaactacatggaaagattaaagaaaatatagacaacactcagatatattctaataaaataactgcatttcaatgaaaaactaataccctttgggcatgtagcagataaaaaacagcaattgatttacaatgaaaagaaaattagattaacatcagacttttcaacagcaacatattatgccagaaaaaatgatatatttaaatacttaagaatatttaaactgtgagaaaaatagaaaatgtgagtcaaagattttacagagtaaaactgactttcaagtataaagatcacagacctatgatcatgaacacccaagaatgcaagaattatttccattagccctctctgaagtatatcctagataaataagctttaaacaaccaaaataagcagcagagatcaatatgagaataggtagtgtgcactgtacatctatctacttacagaacccaaactagataaaggaaagtgtattgtatataatgcctacaggctcagaatatagatatataataaaaattagaggaaaatgagggcaatatatgaacaaaatttaaaatgttacattgattatatttttatatatactttttaatattttttatatatgaaaaatgagatattctgattttgttgtcccttattttattgagactagacttttattatggaagaaaggatatacaaatattatgcagaagatgttaagtgtaagattatataatgctgaatttgaatttggtagctctggaatgaagtaatgaatacattgatctgtgccatatacttgaaagtatattttaaaaatgcgcacaactaaacactgccacctagaaatgaacacttgaattataaaagcaagaaagtgattctctgaaaatgaggagattggttagttttgcagaaagggaggtggtacgttgccactgggcacatggaagatgtttaggggtgaagttcgacttcttcccctaggtggtagttataagagtgcattaccttgttcatcttataataacttattaagatagtatttattttgtgtggttttatgtattttcacagtaaaatatgaaaataaaacggaattgttttctaactctagaaataaacaaaaatgaaaaacaggtaattccctttgagactacaatatgccgactctatggtaaatactggtcctgaactctgtaattattcctttcttcagctccacaggttcagccaacatagaaatctcggggtcatagcaggtacagcactgttttctcacctgcactgcatctcccaaattattgtcctgaatgaattccgtgcagccctgcccttcatggcataatcttgcctgtttctactcaaggtctcggtgagaccttgtagagaccatgtggcaaaacattattaaatatgaacgtctctgagtggctactgccgagggagtgcttaataattttacaaaagcaatattgttaaatccattttcaagttacgtttcatctaggaacttacacttcccttctagaagcagagtgtatgatattattccctctatagcagtgagaaagtgagtgcgaaatagcagcaaagcagtaatatcaatgtcaaacacagagcatcagatcatagcagagaaatgaacagccaagaggaggctgctttgtggggccaagtaacattttgaagaaagttttaaatgagaagtatctaggaacataattgactgctgagacaggtaaagacaggcctctgtttaaagagagaaatatgaccaactaaactgacatgtgcttcaccaaagatgatgggtgggacctcactgcatgcaaaaacagaagaaacgttcacataagattactccaaaaactagggcacattgtctaagagtttcggtaatttttaacagagaaacaaatgaaatggtattaaaagtcacatgatgtaatacaagtagtcattgtgtataatactgaaaatcactacttaataaaatgtatataattttcatatcatgttgtgagttctcacccactctacttgttatcttcagtatatttgtaggaggatttttaagttgagaacatgagttcttagtcactatcttgaacatttttgaagctcttagactgtgtttgtatcccaccaagagtttgggtacatttcttgaaaaccaagggtgtaataatctaaccacttctacaattcaatgagtttatcatttcacaaaacactgcctacatgcatttacacatattaatggttttaatattgccaacagcttaacacaaaatttcttcacattttgaaagtattaaatattttctaaaggatggaactactatataaacataaattcatttaacttatatataactaacttttaaacaattcataacaatatagttgctaatttatgtgtttttctatatagttttagaattactaaaagctttttaaaggaagagccagaaacgttaataatctgaggaagttcgggttaaagttttagatgaacccaaaatgttatacaattccatgttacagtgaatttcttaaatagtattgtatcagtcttttagttcagaaagctcttatgattccacctacacagaatactagttcctgcatctatggtaaatattcatataaatgcatagtaaggtaatatttgagtttctcacagcctaatatttctaaggagaattatagcaactcttggagaattgttaacatgtcaattctaacctctagtgagttgaaaagtttcatttgaaatgaaaattcatttgataggtctaaaatgcataaatatctgattatttcctggcaggcaactacagtaaaatctcacacctcaatttttccagatcttggaagtacattcatcaatgtctactgcagtttttatctgacagagaagaaaagcaagcattaaaacagtaaatcaagttggatttgaaaaaaacaggaagttactttacagtccaaatgacaactacataatttaatgataagaggtttgtaaaaccacattttatttttgctggacagttttaaaggtaaagatgatagatcatacatgctacttatacaaattaagttctccaaagaaaaaatgtctaaaaatttgaaataaattcagaaatacattgtatcactcttttattgtggcattttaagaatcttgtttttaggggacttaaaactaggaaaaaatattgaggtcatccaagtttgtattatatttctgttatcttttgaaatatcaaattataaaatatatcatacatattgacaatgacatggcaaaataatcagagacaaaattacatatgtccattaaattggtaaataatgttacaaacctttatagggtatgaggcatcccattgtttgatatatattctctcttggtactttaaaacaagtttgtgaatagctatcatcatcacagttttagaaatggaaatcctgggatatagagctaaacttatttgttcaggtttacacatctagaaagcaacaaaattatgactattttagttttgtctaaatccaaaatttatagaaattatcctcagagtgcattgataagcaatatatatgcataaatatatacacataaatatatacacacacacacacacacacacatacatatatatacattctctctcctcctctcatggtaatctaagaggcatgctgagtacttctactatcagggatctgggaggcagaaagagaagtataaagagaggcaggcagttgattaaatatgaatagcatgtattcattgataatgactatcagaaattagtttcctcacccaggtatcacctcccagatattcagactgctctttgaagctcagctcaaaccaggcagaaaactgaactgagaattaggaaatcagaaaacaggggccttagaaggaataacagtagtatagtacacactaaactaaagtcaacaatggggcaaaaagtcaacgattagtggggatatgggttacctgtagtcacgtctacacacacacagcatcaggtgtggaagcagtatagtctcatacacaactctggagtgcctgatgtactgctacgagacaggatctattagccctaaggttgagtgtgaacaaacctatgggtaatctataattatcacagtcatctatgtgtggttgtggcctctgcagaatgtcattttcacatgaggtacatgtttttactcaaagtatgcatttacaagatagctgcttgaatgaacgtcttagtccatcaccattaaagagagacaaacagtaaataaaatatttaaatcaatgttattggttgcattaacactatgattcaataaggtaagcccactaggcactgaagaaaacgctctaggtttataatgaaattgcatggtattaagagaaaatttaatagcagctaatataaacgcaaataaatgcattaagttagatatataaaacgaacattttctgaaacgctcaaacagaattacaacttcttaactttcagttttttctcaaattcattaaactcaaaattattttttaggttgttttatggaagaggcttgttgaacatagtcaaaagccttccttttgatgagattgtattcatttctagattaatgtcagatagataacagaatttcttataaacacattttaccaaaagtcaaaaaatcatggcaattaatttcatttatttgatcttaaaagtaagatgtctatcaaagttaaaaatgtgtcaacatatatttataagtgaacaacttctaaataattaaaaattactttgagataattttaatggttttagaaaaaataaatatgcttcttcctcagatgctttcagttgttgtattcataattaaacaagcaatgcttaatattcacagatgaaaagctgtcagaaaattatgccatcagaattcctgtaaacaaggtacttttgttaatttctaactgattgggaaagtagcattattgaaccataattgatttcctcttttctattttgtgcagcccagtggttgtcttgtgtggtgtgttattgtaagatgattgcttaatttgtggaatctaaacagcctattgtattctagtagtctcacatatttatatgccagcatgcactttatgtttgcagtcaggtttagaattttatgtcaactattatttcattatttatggtaaacaaatttcaaatttgagacattaagtatgatcagaaatattacagtagaaattaaataatgatttatttgttaaactatttttcttaatctatgccctgcagttcaattgtcaattgaggaagttttagaacacaatagcaaaataggaactgcagtaacaaagcaagattgccaagaagaaaaatgctttttaaattattcctttaaaaaaaagtaaaggtcaaaggagtgtgaccagtatctgatatttaaattaacctaagccactgaaggtattcatatgtatgtgaatgaagttccaaatgtagactgggtaaaaactccaaagcaataatcatgttggctacaataatgcatgcaaatcaaggtaattggtatagataataaataattgaggaatcaaatttaggtacattttccacggccagtaaaaactaagcataaagaacattaaaatagtttggttatttgtccctgcccaaatctcatgttgaattgtaatcctcaatgttggaggtggggcctggtgggaggcgttttgatcatgcaggcagatccctcatgacttggtgctgtccttgaaatagtgagtactcatgagatctggttgttttaatgtgtggaacctcccctcccactccctcttgttcctgcttttgccatgtgacatgcaagctcctgcttcacccctgccatgagcaaaagcttcatgcgtcctccccagaagccaagcagatgccggtaccatgttttctgttcagcctgcagaactgtaagacaattaattctcttctctttataaattgctcagtctcatgtatttctttatagcaatgcaagaatagcctattacaaacattaattgatttgattactaaagctgacagagtattgtgcatgaaattgatctcgatatcaagaagtctggtttcttataaaaagtgaattttatttaatagaaacattgagagatgcagtgttcaatatggtaatcagtagacacatggttgaacacttgaaatgttgatgcaagaggaactgaatttttaatttaaattaactttaatttaaatttaaaaactaattcatttgagatatttaaaaacttttaaatatggttgacaacttgatacatataaatatctattttcaaccttcagtttcatgaaatgtaattacagatcaattccaatgaaaagttatccaaattaagatgccctgtaaatataaaatacatgtcagatttcaaagactaagttagaaaaaaagcataattatttaaatactgttttaatagtgataacatattatatattgttaaacatattattcatattaactttacttatttttaatatagctctttaacaaattagaattgcatatgtggctcgcgtaatgtttttattggatagccttgagaaaaaatcaaaatctgcattgactttacatgtattactaagaatatgttttaggacaatatactctaatttacatatattttctctatcttcatacacatctgcttcccacttaccccacctcccttattgtttcccaaaaatcagaaattctgatgatgtaacctcccttattgtttctcaacaaccagaaaatttgatggggcttgaaagacagaagtgggataataacagagagaaaaatatcttagatttttcttttgtgtggtataatggtgcatttttattactatcattaattaacccagaatggcaaagaggaaaaggatttttgaattggaaccagtgaagagtcaaagaagaggaggaatgcaaaaattttcaggtggagaactctctgtctgtaaactctgttcccaatgaccactacaagatccatgttccctccaagagagctgagaaaacatcactacattcatcattcagaacagggtgagggaaggagccctcgacagaacacgcccagagttacaagttgtcctcagagtagtattattgccattaggaaaaattggccaactgtgagtacagtgtgaatgatctggaaagataaagagaaaggtagtaacaataacataattgttttcctggccatgtaggagtttggctgaagttgtccttaatgtgacttttttaagccaatgcttatttccatcaattttggtttcctactcaattctatttttatcagataagattaactcctatacatttactgaaattatacaacttttacatcttctctttcatggctaaagaatgaatctaggacttatctactgatattagatatcatcatttggcattgtctcaatatactgtggctcactatgggcagctcaaacactatattgcctctgcatcagaggcaattttgaattgatttgtttgggtttgttagtctcgaggaatctcaagatatgatttttaccaaaatgagtgtggtttctttccagctgtttgttaatttaaaaaaaaagaaatgaaaatgaaaactattagctaagttcctaaccttttaataaattggctagaaacacaatgtgctatttcaaaacaatgatattttctaatatttcataagcactaaattttgcatctttttacatgtactgatgccttagtccctcttatgttatttgaatttgatgaacaacctggtatctttatctatgtttaaaaatacatctcttcaggggagagcaaaagacaaacaaaaataattcccattacagtctcagcaggtagaaatgctcttactcaaaccacagacatttcttaaagcaggcctcacagctgtaatcttcaaatacttttattctaatagcaaggcataatgtggtaatttcaaatttgctttatcatgactgttttaaatggtgaatacatattttttctaagcaacagtatattattgaaatgaaaataatatatgtgatcattatgtgtcagatactgaaatgaccattttctatatctcagtagccccttttaacattccttctagtaaatcactatgatttctacttccaaggtgacaaaagcaagcttagtggggacccatagctaacctaaggcaacaaaacagggacatgttggagcctagagtcttccaagcctctgtttccaaactcatgcccttacttgttctgttagtctaattcttgtaatggccattatttgatattttattgtaaatttacaacaaatactttgctctattatataaaatactatcatttggaactgaaacttctcaatattatttaaagaaatcattcaacaaacagattttattttatcctacactatgttcactaaaaaactgagaaatataaattcattgatatgaatttcacttaaagagaattttgacagcacaaactttcacattgttttctttttgattggcaatatgaatttagtgcccaaagtactggttatttaaaaaaatgagattcattgatttttaatctacatttttctattcatcttgagattactaaacatgggtcacaattttaagaacatctaggaaaataagacttcttgtaacaagaactgctgaaaaccctttacttcaatttgacattttgtgctcttctaaatgtatcctaatgcatggtcatgctacaaaatgactatcattagggctgtcacaggccatggctgtgggaataccatgactgatgctaagctatcagcactgtcggtgcaaggtgtattctcagtaatttctcaaactgtccatggaaccaatttctactgatctctaagtcataaaactttacaattaccctgagttcattaataatgtattacagttctcattctcaatcacaatttcatcagatccatgtctcacaggaaggttgacaagtaagccacaaaattatccatataaatgtcaagatttattttcctaacataaatgatctaacctagtcaagcatagttaataataaaatcattctttctgagattaccattcacctgattgccatacccattttggccttatatctcaacctctctaatggtggaggttatggatatagtccacataaataaaccaattatttatgagtcatgttcatttctatattaaaaatacaaaaccatgaatacttatattattgcttattactcctctgtaataggcacaaaactaaattggtcaatttattccatgacaatgaggtaagtactaaaagggaaaaatatgttaaaacagtaattttagttacagatatctcaggttgctgttttagcaaaaatcataacatactctacttcaaatacagaatctcagaatatgtccaaatgggaaattaagtattaaggcactggcaaaattattgcattgaaaatgaacagaaacttgcttctacattgcatttttcctacactctgtgcataaaagtttattttgataatgaaggatatatgtaataaacagtttctgagttcttgaagctattccccccattgttacattactatcagcctgttttgatatattatattaatcatatcataattttaaaatatatgattttttcactgatatatgaaatcttaagtaacatattaaataactaattacagaaacatttattaatctaagtaaatgcatgcaatggactgtaatttatttgctttgaggcattttatagaagtaaacagatagataaaagaatgcagatggggtttcagaagcggcatattgataggcgaaatactatactatctttcaagactacaagtggagaatgttaatatattctgccaaattttatatactgtccatcttaaaaaaatcacattgtttagagtagtttccctcctgagaaaaaaacaaagttggtgacaccacttgacagctccactgaagcaggaaacataattgcattcatttattcattttctcagtattagactcacgaacctttaaaagggtggggtggggagtccttcaatagaagtccttcagtagaaccaagaaatcagtattctatgatttactacttcataaaggtaaataagtcagtgaattaatcaaaaatttaaacagtgtatttttctctcaattggctatacaacctagaatttatatctcctaaaggtaaattgataatataaaaatctataggtagcatccaacattatgactctttacatgactgtagaagttgtgatacatttagaattattgttagcaaaagtctatgtaatacagcatatttgttttgtttcctagataaattgatttatattcaatgatttgtctgtagcagataaaataaaatacataactgatacctcgaatattattttgttttgataactgttactttttcaaccctgttttcctaatcattatctttatttcctcctattaagaatactttaatcttactcattttctgtctgaacactgaaattcatcaatgagagtaaacattgaaccaaaaaaatattccttttattgagactggtctctaagtatgctttctattagagttttaattaaaatcactttcataatatacttttttatatttgtataatatatgatactatatttgattttcctagtattaatctgaaggtgataattttataatttgccaaatttttatattactctaagccataggttgacatgtatatttctcagatataaatgttcatatgtaccagaaatatttttaaaagacatattagaatatatatattttttaaataaaatatgctgaaaaatattttcatttctgaaacttcatttatctttggcaagagtcagtcagtatctcatgattaattcagggctgaacccaaacgacgttcaaattagcatgtcagcagaagaaataataacactatttgatactggtcttttcccttagaatcactcaaaaggttctctaagacagcacacagagtcctggttaacttctgaaaacattctttttcactgtaaagccagactattgttaatgacaattgccattaatttactatgaacttacatataagaataaagattctgacactgcattttccccaaatacgatgaacagtagaaaatcagtagaaaatattagagaaaagctatacttagaatccatgtaatctttagattgttaaatatctgtttcactcaaattgccaatttaaatgtgggctttcttctgaaacagtaaatgctactccaagaaagtaaaaccagtagtgaaattttattcattttactttttaaaataaaaataatatctgccctagagcttattttgtcaaaacatcttcttcactgtcgtgtatcctatggtatgcccttcctattctaagtgtcagagacaaggaaccaaatcaaattcctcatacccctggaaatgtatcaggtttttacttccctacaatcatctacaatttaaatgcaaatttaattttgtcagcatttcatgacattgaacgtagataaatgtctcactatctcagtgagtgttatgaaagtttaaaaatattcttgaaataaagttagtgttttagttggaaaaaactatagcatacagcatgctgaaacagaagaggatgtgcaagaagtgtgtagtagcatgggcatcattgtggaggaataagaaagagggtgtgttgctgggacagtgaaacacctcatcctgctgtctaaatctcaggctatattcctaagggagagcatctgggggttctccactgattgaattgttagaattctgagaatactggaatcaaatcttagaaaaaaactgatttttagtctgggaatctaggtcattagatgtctcaactggtgaacagaagaaaattataaataagaaattatgagtgatgagtgaagccagaagtcatgacaaaggtgaagagtaaaactaagaagtactggaaagttaatgaggcaccagacatctcaaacctttaatattaatcttttagtgaggctcagccagagctttcttgcttttatgacaacattcaatcagagagtaatcatatctcacagcatttgtgattgatctgaagtaaggatctctatttctcagtgttctttctcacttaattttctgtttggttttccctatgatttcatatttgaacctcctttcagtggaaagaacatctgtagtcccatgaattttctaatctgaaagggctacagaaatgaaccatcactgtgcttcaagccagccagaacaagatttatcacttgctttgtgtgtgatcttgaataggtggcttaaaatgaaataatgcaattcccagtttctgaaagtataaaaattaaataggataactgaaatatgcccagaaaaattcaaggtaacagcatagcttaatctccctcccttgatctaaattgtttgatgacttttttaaaaaaaatcttccagaacacaactcagatatcttaactcaaagttcaaggctttccatagtgtctcatccatctgcctttccaggtccacttttctctattccctttacgtagctttttgtttagtcaaatgggaccatttagtttatttttcttttgctatgtctgcctttgctcttgcttctttctccaactctatacttgcatagttatcctttccttcaaggaccagctcaaatattactgcacttctatatttctctcccttcccttcccaaaattaatctctcccttctctacgtctataaaaacatttttttgtcttctggagtacctggcttaatgtatcctcaccttctcctctttttttttttttttaaatccttctctattgtctcatttcctctatagttttaaatatgatagtttgaaattaatagatgatggcaaaaagaagactacagtacatggtgaaaccccgtatctactaaaaatacaaaaattagctgggcatagtggcacatgcctataattccacctatttgagaggctgaggcaggagaattgctggaacccatgaggctgtggttgtattgagccgagattgtgccattgcactccagcctaagcgtcagagtgagactccatctcaaaaaaactaaataaaaaaaaaagaagactacagcttacatttgtatcttagccaaagcagcttctttcttctaagctatgctactgctgcatatgtttggtcaaaattttaggctttcatggtttcttttttcctttttggggggatgtgtatagcatagatcacatatggaaacaaacgcaaaacagaaaatacaaatgggaatgaaaagggaatggaagcagagatattatttccaaaagcttaaaaggagaaataaggattgaattgttttaaactgaagaaaacatcatttatatagaaagagcaattagattatgcgatactggtaaaacgagtcagtggaattagttcacagaattatgaataaaaggtctgtctgcattatgtcttccttaaatctattgtttgttaaatttccaattatgtacatgagcataaacacacataaatacagatatatatgtgtgtggtggtgtgtgtgtatataaacatttgtaaatatgtatatgtgggttttttttttttaacggagtcttgctctgtcgccaggctggagtgcagtggcacgaactcggctcactgcacctccacctcccaggttcaagtgattctcctgcctcagccccctgagtagctgggactacaggtgcgtcccacaacacccagctaatttttgtatttttagtagatatggggtttcaccatgttggccagaacagtctcaatctcttgacctcataatccacctgccttggcctcccaaagtgctgggattacaggcatgagccaccgtacccagccatatgtgttattttttaacgcggtaacataatatccaggttaggatgtttaaggatggatatgtgaaatgtgttttccatcctctcacacactagatcccatatttcactttaacaggtatcatatttctcccttttcattattgcagatcatcctgaaagcttcatcacctttggtttggtttattttccattattccaccaaaatgactattttgtttaggccattggtgccctcttattgccaaatccgatgggtatttgaatatcttttcttagttttcctgtgtgcagcattcaaaattgtcaacaattccttacttcttgaattagttccacacattggctttatgatactacacagctgtgcatcttacctaactggctccttcttctcattcttttcactcttcctctttcacccacctcatattaattggaagactcagctgagtggtatcagatgtcaacactcatagcagttgagtgaatgagtggtgtagtcctgaagtggagagatctgagccatgggccagaatacacactaaacccctcatgtctattaagtgagtactaggcaccaaaaggaatatgtatatttgcttgaataataaatgacctctcataggcttccatttgtgattttctgatcacattcttcatattctatcattccatgcacatgtctaagctcaatgatatggtttgactctgtgtccccacacaaatctcactttgaattgtcatccccataatccacatgtgttaagggttggaccaggtggaggtaactgaataattaggacagttttccccatgccgttctcgtgattatgggggagtcttgtgagatctgatggttttataagagtcaggcatcttccctgtttgcactcactccatactcctgtcctgtgaagaaggcgtctgcttctcctttgtcctctgctattttagtgagtttcctgaggtctcctactaatctggagctgtgagtcaattaaacttctttcctttgtaaattacccagtctcaagtatttcttcacagcagtgtgagaatggactaatacagtaaatcggtaccacagagagtggggtactgctataaagatacccagaaatgtggaagcaactttggaactgggcaataggaagaggttggaacagtttggaggggtcaaaagaagacaggaagatgtgggaaagtttagaacttcctagaaacttgttgaatggttttgaccaaaatgctgatagtgatatgcacaagttcatccgtaagtggtctcagatggagatgaggaacttgctggaaaatagatcaaaggtcactcatgctatgctttagcaaagttcctgatggcattttgcccctgccctagagacatgtagaagtttaaacttgagagagatgatctaggttatctggcagaagaaatttctaagcagcaaagcattcaagaggaagcggggcatgaaagttcagaaattttgcagcctgaccatgaggtagaaaagaaaaacccattttctggggagaaattcaagcctgctatagaaatttgcataagtaataaggagcccaatgataatcaccaagacaatggggtaacgtctccagggtgtgtcagagaccttcatggcagcccctcccatcacaggtctggagggctaggaggaaaaaatggtttcatgggccaggcccagagtcccccttctttatgcagcctcctgacatggtgccctgagtcccagctgcttcagctccagctatggcaaaaaagggccaaggtacatctcgtgacattgcttcagagggtgcaggccacaggctttggcagtttccacatgctgtcgagcctgtgggtgcacagaagtcaagaactgaggtttgggaacctctacctagatatcaggggatgaatggaaatgcctagatgtccaggcagaagtttgctgtagggccagggtcctcagggagaacctctgttagggcagtgcagaagggaaatgtgggattggaacccccacacagagtccccactgtggcactgcctagtggacttgtgacaacagggcaattatcctccagaccccagaatggtagatccacctatgactagcaccttacacttgaaaaagctgcaaacactcaacatcagcctatgaaagcatccaggagagggtgctgtgcctgcaaagccacagaagtggagctgcccaaggctgtgggagcccacctcttgcatcagcatgacctagatgtaagacaaggggtcaaaggagatagttttggaacttaaaggtttaatgactgccctattagattttgaacttgcttgaggcctggagcccctttgttttggccaatttctcccatttggaatgggtgtatttacccgatgctggtatccccattgtatctaggaagtaactaacttgcttttgatattacatgttcataagtggaagggactttgcttgtctcaaataagactttggactttgacttttgagttaatgctgcaatgagctaagactttcagaggccaggcatagtggctcatgcctgtaattccagcacttctttgggaggccaaggcgggagaatcacttgaggttaggagattgagatcagcccagccaacatgacaaaaccccatctctactaaacaaatgcaaaaattagccgggtatggtggcatgcacctgtaatcccagctactgggtaggttgagtgaggggaattgcttgaatctgggatgcagaggttgcagtaaagctgagatcacaccactgcattctagcctgggcaagaaagcaaaaaaaaaaaaaaaaattatatatatatataaataaatacacacacacacacacacacacacaaacacacacacacactttgggggacagttggaagggcataaggccataattctgttttgaaatatgaggacatgatatttggaagtggtcaggggcagaatgatatgctttgtctctgtgtcaccacccaagatctcatcttgaattgtaatacccataatccccaggtgtcaagggcaggaccaggtgaaagtaattggatcatgggagtggcttaccccttgcaattgtcatgataatgagtgagtctcatgagatatgatggttttataagcatatggcatttccccttcttacacttctttctgccaccttgtgaagaaggtgccttgcttcccattcaccttccaccataattgtatgtttccttaggcctcacctgccatgcagaactgtgagtcaattaaaacttttttctttataaattacccagtcttgggtacatctttacaacagtgtgaaaatggactaatacactcaccaaatacagtaaggtctttgtggattagaaatatactggatttgactttatattctctacattgcaaagcagagtaccttgcatatagtatgtttttatttaatatttcctaaatgaatggaaacagaagagaagttaaaggataagtcatgggagcggctgatgcagtctctaccagtgtgtcataaatcccaaaatatttgaaagaaattatagtacagggatccacaacacaaagctgctgtcccaaagatccatttattctatttacttgtcaaagtaatagacaaagtaatagacaaagtaattgacaaagtaattgtcaaagcaattactttgacatccctacactgtcattttctggtctataaattaggggtagtaatactaacctgtcataaggtctgagaatgcaatgctctaatagggcctagaacacagtaaatattcaataacatttatttgttattaataaaaccttcatgaagttaatatttcatgtataatattctgtacctttttcttcctttaaaattaattgtacatgattaaacatgcattttttagagtataagaaataaacactaattgttaaattatatttgttcatattctggattaggagaaatttaattctcagtttgtattataaattttaaaaactgccaggcacggtggcttaagcctgtaatcctagcactttgggaggccgaggtgggtggatcacctgagatcaggagtttgagaccagcctggccaacatggtgaaaccccatctcccctaaaaaaaaaaaaaaaaaaaaaaaaacagattagctggacatggtggtaggcacctgtaatcccagctactcaggagactgaggcaggagaatcatttgaatttgcggggcagaggttacagtgagcttagatcactccattgcactccagactgggtgagagagcgagactacatctcaagaaataaataaataaataaataaataaataaataactgcttaataataaaaagaagttagataattcatacatgtattttgttacgattaaaaataatctgacaacaaatgagctgaatatagtaattatgaaatcaattttatggtttgttaaaatgctaaggttaatcttcacgtagtttgagtttttattgtatttatctgcttcataattttgattagtgtaaggggaatggctgtggcttctgtctggagtaggccaaggctgacatccagtacagcacgacacagcgggtttggagcagaggcgcacaaccccatgcactacataattacatttatgtagccattcggttgtaacctgtttgtgtgagctcatacctggctttgagccactgttgtctgtgaaaaatataactgcactgctgactctgtaggagagagaaagaataagtccacatcccacctgcctacggtccctcgagtgtttttcagctacccgccacccatctactgacttccctcggaccccagcttgggttgaaatctgaaaattaggttaatataacttttaatattgaaaatagtatttattatagcttttaatttatatttttgtgaattatttgacccaatctgtgtaagaagatgtacattagaatataaaaatacaattaccagaaaaataaaagataatttttggttctttcatgaaacatagaaactcaagaacgaaaatgaataaagctatattcaatccagtcagtcttgaattcatgtaaaatttttagtacttaacaaagttgcaaagattcatactattaaaacagaaaagttgtagaagtggtctaacaatgaaattctcagaaagttagaattgtcttgctttatttctcaggcattcctaacattatgatttctgtgacaaaaagtaataactactcatatatttaccagcgcctgaaaatcaaatgtgttataacatgaattatcatagaagtatatgactatgcaattgcaaatgcaaaaagtcatgcaacacactattttaataatataacaatcatcttactgccaatgttttcatttcactaatttcattgaatcttatcttctgataactgtttagctctttaattagatatcaaataattacacttttgaaatgcagccaggcatagttttttagttgccgtgatagcatatagtcatctttatcctgcacattttgtgttttatatccaagcacgtatctaattatctttctgactgaattgactacttacagcgcaggaagatctaacacaggtcatttgcaattgtgcagtcacaagtcacaaaaagaatgaaaaagagtgaagaaagcctaaggttcttttgagaaaccatcaagtgaaccaatatacacattgtgggagtcaaagaaggagaataaaaagagaaaaaggcagaaagcttatctaaagaaataataaccaacaacttcccaaagttttggaagcaaatgacattcagatttacaaaccccctaatacattgatgcattatcatcaaattatcagaagtcaataccaaagataattttaaaattaataagagaaaagtgacatcacatacaagcaaccctcataaaactatcagttggtttctcagcagaaacctttcaggcaagaatggagtaaaaggacatactcaaagtgctgaaagcaaataaaacacctaccatgaatattatccccagtaaacctgttcttcataaatgaaggaggaataaaacactttcccagaaaaaccctgagagaggtcatcaatagcaggcctgccttacaagaaatgctaaaaggaattctgaaagaatactaaacagcaaaatgaaagtataaaacttaatgagtaaatgtaaatacatagaaaaaacaagaatactgtaataccataatgatagtagataattctaatataaaagttaaaagacaaaagtactaagcataaccacaaaaatatgttaatgtatacacaatataaaataggtaaactgtgaaatcaataagataaagtacatgcatggaggtaaaagtgtagaaattttatactgtttgaatttaagttgccatcagcttaaaatagactgctgtaagacaagcatgcctcatggtaaccatgaagaatatatccctaaatatacacaaataaaatatatcagagtatgtcactaaaaaacaaatataattccacaagaagatggcaagggaaggaaatagggacaaaatacctataaaatagatagaatataagtttttaaaattttaattaaaagtcctcacttacaataattactttgaatataaatgaattaaacttcacaattgaaatacatagagtgcctgaatagatttttaaaaataaagatctaactttatgctgtctataagaaacccaccttagctttaaggactaacacaggctaaaagtcaagagatggagaaagatatcccatgcaaactgcaaaccatagagagcaggttagctatacttgcatgagacaaaatatatttaagtaaaaaggtgttacaaaaatatgttgataagttttatttagttagttcagaatgtatacatgtttgaaaacatcatattgaacataataagtaataactttcacaggaaacaaagaagattatataatgataactggtcaattcatcaggaagataaaacaattacaaatatataggcacccaacatcagagcacctaaatatatacataaagcaaacatgacttatatgaagggagaaacagacagaaaaaaatcacagcaggagattttaatactccacttcaataatgaatgggatatcttaacgaaaaaaaaaaaaaaaaaaagcaaaccgaggactaaaacaatactatagaccaacgggacctaacagacacatatgaaagattccatacaatagcagcaggataaacattgtttttaaacatgcacagaataatctttggaacagatcacaattgaggccacaatacaagtcttagtaaatttaagaagattgaagtcttaccaagtattatttccaaccacaaagaaatgaaactgagaataacagaagacaaactgaaaaattaaaaagaaaaggtaagtaaatgatacaatcttgaacctacaatggtcaaaaaagaaatcaaaatagaaattagaaactatctcaaaatagatttttttcttaaaaaaattaaaccaacagaaaaacttaaggcatgcagcaaaagcaatattgagggaagtttatagttataaaagcctacactataaaagaagaaagatcttaaacaattaactctatacctcaagaagctggaaaaggaataacaaattaagcacaaaattagcagaaggaaagaaataagatttgaagataaatagcctagagaaacaagaaaaaatgtcaacaaagtaaagagttggttttctgaaaagataaaattgacaaagctctaggtacatgaactaagaagagagactactcaaaataaaaaaaataggagatattacaactgatgctacagaaataaaaataattaaatgagactactattggcaattcctcaccaaaagattggataacctaaaagaaatgtataaattcctagaaacatacaacctactaagacttatcgtgaaaaaagagatagcctgattaggccaataacgaagaaaaagattcaatcagtaatcaaaaatttcttaaaaagccaaacctgcagaagtaaacagtaaaagggtggtaccagaggccgtagtattgggggactgggagatattagtcaaaggacacaaaatttcagttagacaagaataataatttcaagacatctattatacatcatggtgactgcagttaatatccatatattgtatgattgaaagttgctaagataatttaaatgttgaaagttgctaagagagtttaaaagttgtcaccagaaaaaaaaaaaagttaagtacatgaggtaatgtgtatcttcaataatgtgatttagccattctaccattatatataaatacattaaagcatcatgttgggcacaatgaatatacacaaattttacttatcaataaagtatatctttatctttctaatgaagaagagcccagtaccagatagcttcactggtgaactctaccagacaaagaataattaacattaattcttttcgttaacagaatgaaggataaacatcacatgatcatttcattagatgcaggaaaagcatttgactaaattcagcatgctctcatggtaaaatttctcaaaaactatgcatagacggaatttaagtcaacatgataaagactatatatgaaaagctcatggctaacataatattcaagggcaaaaaacggaaaacttttcctctatgatcagaaacagggtgagaatcgcactctcacaacttccattcaacatagtactaaatgttctagccagaacaattagacaagaaaataaaataaatgccatccaaatcagaaaggaagaattaaacgtttatctgtttggagatgacagggtctcatatgtagaaaaccctaatgatcccccaaaaatctgtgagaaatgataaacaaatttggtaaaatttcagtatacataatcaacaaatgaaaatcatggcttttaaaaatttagttttttaaatggtaagtataaattacatatatacttaaaatcagttgtgtttttatatataaacaacaaactaataatgaaattaaagacataatttataataacattaaaataataaaattcttaggaataaacttaaccatggaggttaaagacttgtacactaaaactaaaaaatatgatgaaagaaattttaaaagacataaatacatggaaagacatgctgatttcatggtttagaagaattaatattgtaaaaatgtccacaatcacaaagtgatctacagattcagtgaaatccctgtcaaaatcccactgtcactttttacagaaatagaaaaaaaaattgtgaaatttgtatgataccacaaaagaaccctcatagatgaaacaatgttgaaaaagaataagctggagacatcatactttcagaattcagatattacaaagctatgacaattaaagtaatttttggtagtgttgtgttagcataaaaatagacatatagagtaatcaaacagaatagacagcctggaaataaactcatgcatatttggtcaattgtactttaacaactatgccaagaatatacaatgaggagtgaaatgttttcttcaacaaatgctattgagaaactggatatttacatgcaaaataatgaaattggacccttatcttacaccctacaccaaaatcaactcaaattgggtgaaaaacttcagtgtaagttcttgaaactttaaaactcttagaaaaaaattatgaggaaaagctcttgacattggccctatcaacatttcttggatatgatgccaaaagaacagccaaaacaatagcaaatataaagaattatgactacatcaaagtaaaaatcttctacatagaaaaggaaatgatcaacagcatgaaaagacaatggaatgggaaaaatatttgcaaagcccatatctgataaagggttaatatacaaaatatataaggtactcctacaattcaaaaacaaaatcccaaataatctgatttataaattggcaaagaatctgaataaacacttctccaaagaagaaatactgatggccaacaggtatatgaaaaaatgctcaacctcacgaatcatcagggaaatggaaatcaaaaccactatgagtaattaatcgacagctgttaggatggctatgatcaaaaaacacaagataacaagtattggtgaggatgtagtgaaattggaatcttcatatactgttggtaggtatgtaaaattgtgtagtcactatggaaaacagtatgcaaaattcctctcaaaatggtaaaaacagtactaccacatgattcagaaatctcacttctgagtatccatccaaaataattgaaatcaggactcgatgaaatagctgtgctctcatgttcatttcagtattatttacaataagcaagatagggaaaccacctaaatgtctattgatgataaaatgatggtggatggtgaaaccaagtgtggtacatatgtacgattattcagtcttgaagaagaaggaagtcttgctacatgcaacaacatggataaacctgaaggacattatgctaagcaaaaataagtcagccacaaaagactcatgttgtatgattctactaataggaagtacctaaaataaaataaaaaaaaaaacaaagtacaatagtgattatcagatactgggtagaagggaaaatgggagttgttcattgggtaaaaatttccgttatacaaggtgaatgatttctagaaatctgctgtactacattgtgctcatacttaacaaattttccctgtaaaatattatgttgtttctgtgtgatgttaactaacacaagcacgtatttttgcttttgtttttaatttccacttttaaataggatcgtcatatctcaaaatgtcctaccaatatgtagggacagttatctcggaggtaacactcttttgtaaaatgcagataaaaggaaatgaaaaaagattctaaggaagaggcgcaatataagaatgcttttcttttccattgcagtagtcaggatatataactggatagaattgcctctgtttagagaaataaaaagaatatattggaatcagtaaatgcattttctttgagtaaaagggttagcgcacagatatttgtaactttggagatgtcactcctatagcctcggggttttagaagcaaattctgtgcttgagatgaatccagctgagatcctgtttctcttaatatgagaaagaatgacttataaaagaagatttaaagtacttgtgtaagctttgaactagtcaagctgaaacttaactcccatttcgtctagtaaagctcttagtgccagaatgttttctggttgtagaggataaatgacaatatgtaccagcagtaaattggcttatcttttggaccagaagagatactataaatggaagctaaatgccagttttgacaagttatgaatacaactcccaagaagccaaatacatttttaggattctgaacagctttttcttatgtagtaattagactctggtagaacagcaactaaatggtgtttacaacattacaaataaattttaatttcatccatatcatttcaccccttaggctgaagagtgatgaaacattatttatacttctattcagttctttctttttaagtggaggaagagctaaaggcaaaattcctataaacaaaaggaagctaaaattgaaatctgtaaggaaattataaagtttaaaaaaataataacaattttttcatatatgcaaagaatagcagagtacatatttatttctttgtatttgcagaaacaccatcaagctaagccatttgcaatgtaaatgtttaatctaaatattgtatagaccaaacaagaaatgaagattatgtatttcaaataaaatacaacaccagtaaagaatatatatctatatatatacataaacacacacacacctatctgtagttaaatgtgagagaaaagtatgtgttcaccaaattcaaacaccttaaataatctatatttataaattatatgtggcataggtcttagtgctttatgaatatacaataaatgctttgaatagatcaaatgcctacgaaaataataaagagagtgtcatcttaaaaggtgttctagtggcaatggatattttgccatctacatttatgaataaaataaaaatgtcatcaagattacatattgagattcattctttgataaacagcagggagtaagaaaatcatattctctaatatctggcacatatttgtattgctgtttcaaatagagagaagaataattaaaaagaaagaggtagtacattaagataaactttgctaaagaaatactaagtacctaaaaaagtagatgaatggcacagtattggggttaaacaacatggggatgaacactgcaaaataaagaattttgactcaaaacagtagattcagctaatataactgatggaatttccagggtaatgggaaatactcatattaaatgtgagattataagtattttgaaatatgtttaagtatgtgggatgggcatgaaatagagtatactttctactacattaattgaaatgtgtttttattacaaaacataaaaatattgtacaccaacatatctccggactgctgcaaatcagagggtttggtaattctcaataacttattttatcaaaggcaaaagacaagagatgatataggtttcaagaacaaaactggaacaaattgatcaacacttcatggcaaagatgaaaagactgacaaagtaagatgtagtgacaatgacatgtgattatccaattatctgttggaattctcatttacataaaaactagattgaatattcttgataagccttctcccagttgatatagagaagatactttagatttaattgttaccaattaagaactatttacaatgaaccagagatgaagggcacctaagaaaaaagtaaccctatgaccttttgtgcggacagttcacgattaccagatatgatgcaaataatattataacagcattctgaaaaataggcattaaaaatgttaggatttcttggtacaacatcatagatcacttcaagctaatggtcaggtttttgtccttaataaataaaagaataaaggtacaagctttttgttaagtctgaaaaagaatacctgacaattttaatcagaagtttttttaatgaagaacaaaaaaagagtcataaggcattctaagatgaatgcacattttaaaatgacattcaaagaataaaaaagaaagtcaaggaatctgtgccacatattgctataattgagtatcacatcaaataatatgatttcaatgataacaaagatgtttggaaaaattgctaaaggtaacaaaaaaaggaacaaaattatgttgctgtctaaacagaaaagaaaatattctatagtacaaggcttgagagactttgttatattttgttttgttttgttttaatataaaaggaacctgttgtcaaatgacttgcccaaggtcatatggttgttcagaaacagaattggaaaagtctattgctgacttcgtttgttttaccaaatcaaaactgcctctataaaagctccaaaaaaaaaaatagaatagagacccaaggtatatcataggaatcttaagatacatgaaagctgacaagaggaagtattaattggtcttgtttttaatcactcaaggaatgtgattagaaaggtagaataaaaagatgaaattaatatgacaatagatattcactccaatattcaaagatgaaatgagatacctttgggaagtactgaattattcctctctcaaaatattcacacttgagtaataaatattagtcagaaatgcaggagttgggattcaagaatcattgggatggtaagaataaataaaattttgtatctgagaagtcaataattaaaattacatgtcaaaaggaatgattctggggaagtggcaagcatttatttacctgagaacttaatagcttaatttcctaagaatttgagaaccgttcaagtaagccttagtttgaaggctgaggaacgaggcaatataatattgaaaacatttgaagtttttaaattagttaatgagccactacaaattacaaaccactgtgtgcctgataatatagttggtaccttgtaagtgaatgcaaagcaaatagatgaaagagcaaattaacttttagaaaaagtatttaaaaataaagtggtccttcttcattactcagcttttcattctaaatttatcaacaggccatatgacgtattatttgttttcattttcattactccacttaaaaacatgaattttgtttacatacaatattaagaaagaaacagccaaatctaaagcagtaaactacctcagataataaatagcatttattcattgtgttctgtttgacctttatgtacttacttcttggtttgtgagttgatgagagatctctaaattacactgtcctggaccaaattgcagagtaccttgtctgctttctgacttggagtcacagttcatcttgaccttgctattggtataagtatcagattgggtaatgaccttatttttttgctatattgcagtccctagttatccacttggcatttatggtcagcttttcatttacagcctggtgctgacattccccagacaatactgtatgttaccctattagcattagtgctcgctatccaaaatcatgcactaacataaatcctccaggtctcccagacacattgtgctgtgaaattcttatgaacttgaaacaatttaccagataatcaactgttttatctaggagtataccacatcattattcacatacctgctattttcccactgacatgaaacatgttttctttcaaaagtcaaaagaaaaattaattatattttattgtgtttataagagcaaattactttgtgaggcatagaaaaaactatctttgaaacatagcagtacaattagacttaagcaaatagcacttgtaagatttttgaagatatttgatttctattctatacctttaatgactttgagaaaatatgtgtagcttgcatttcaaccatttaaaagcaaaatgacttacattaatattaatttatatctcctgaagcatatcactcatttttaacacagcattatgcattgtcatatttattcgatgctaattttttaagtgacaatattctaaaagcaattagcaattttattgtagtacaaaaaatagacaaacccagtattcatttcatttttttaaagtcaaagaggctgaagaatatcatggctctttctactttttttatgtagctataaacaataggcaaatatttatacagaaatttaatttcctttaattaaatatacttcaatgtcctaatttatgtataaaatataatgataaataaaagtattttttaaactttaaatttttggggaaagtttaacaggaatgaatttcagttcaggcttgataatttcacacagagaaataaaaattaagttaaaatgctgaattttaaaactctgctggcatatcatgacagcttttcagggaaaacatctattttcctttaataagattatgaaaattaaagctcattattgtgttacaaagatatagtttaacaaatgctattaatttcattggtcttaattgttttattaggatataattatttaaaggtgacaacattcataaattagttttctttaaatttgttcaattgcagatgtgacatgacatgactgtacaaaagtgtgtggtttaaacactggtcacctaacttattaaggatctattttgtttttcttgttttaacatatggcagtagttctcagagtgtggtctttgaggttggcagtatcaccatcacctggaaacttattagaaaagcaaaatctctggcctctcatcctagctgactgaatcagtaactggggagagggtcaagcattgttatgtcttaacaagtccaatggataattcagatacacattaaaggtcaagaatcattaacctatgagttttcagctgtggtgtcatattagaatgatcagaggtgttaaaataaatacatgcataagtcttatgctataacaattgaaataaattatctggtgagaagacacagtacttattaaagaaccatatttctaatgtatagccagggctaagaaccactgattttacctaacatccaatagagcttttttattcctttttcctttctctggacctaagagtgttctttcactgaccttttcattcaaaaattactatctgatcaccagactctaatagtcaatgccaagtcttcccatttttgcctaacatcctgatgggacccatgctgttgacttattttgtattgtaagtgacatatcaatttaaataaactactatatccatacacaaataacattgtattagtgatttttaacaaatacaaaggtgacccacaaagttcactgcttctttaggctactcatcttatcccattagatcttttttccagtaagtatttagatgatgttatgcagtaaaaacgcattataagtccactgaatttcctgctcacttaataacctagcttgttcctactatgctactatgctatagcattaatagtcacccccagaatcaaaattattacctaacaatgagattatgaaaatgtaatgctaacatagaaatgcagtcaggtggtaattcttcaggcctaacaaactcccagtcatgctagggatttactggtcattaaaaatgtttgaatgtccagaaattttaagtatcagtttcttttatcttgttgttcatgactctaagttcagtgtttctcaaactgttgtgatacctaagaattaacaacaaggttgcattatagaacattataaatacagtactttatttgtgaagtagataattttcaaaggagtttatgttaataagatgcttaagtattaaacattggaagtgattacactatcatcacttccaatgtttttctaaagcaaaaatagttaacgattcttttctgaatgttacttatgaattcatgctttgtgggagaaacagattattttacaaaatgtcttataatgtgtccttcaatgtttagaatgttgtttctttactatatttaataaaatatcaattactgacacattttaatttacatctttcacataccatttctaaataacttcattgcaaacctcatagtatcaagcccacaatttgagtaaatgctaacatattttttgttgcttcaagtctctcttactcatcctaaatgcagatgttgaaaagtttttaaaatgtaagaatttttctcatcatggaaaaaattggaagtaactgttttactcaatatcttcaggtttacctacaagtttcttaaatgcccagttccagttcacttcttatcaactcacttcatgtttcttttctttctttctctcctaaaatgcatatcacgacctcatcttgtgtaatattgtgacctctcttcaaagtttgtatcgaatacaaaatcttataaaaattatgcgtttatttatcagcatgaaaccctaatcatgtagcctatcaaggttatattttctttatattttcctttaagaatttcagaatgatacacttttatcattgtaaatatgtggattcaaataatatattttctgaaaacacaaatatttagctttcaatgccacatttaatgaaatcacatactaattttgtggaagactgagatgttctaaaaagaataagaaatcatgaaaatatttctgcaggcaaacaaaattcagtctttccactagtctttccacacatgtgtgatatacatgtttttccatggttaaaaaaacatgcacactacacatgttgatataaaatgtttccttttaactattgttttgaaaaaaacttttgaataatcacatacaggatatatatgagtatgcaggtttgtatgaattttatgaaagacaataattactaaacatgcaaaaatcaaacaattttaataaccatgtatatgctagaaatcagctttgcctctactgaaacaatttcttcagtcttctactgactacattcttataatgttgcatttcagtaacttcaaaattatattgaggaataagtaagtgaaaattgtaattatataaaacaatctataatcataatgtagtggttatatcattatatacacacacgtacacacataaactatttttctgaaaaaccttgttttcctttcctaaaggaaacataaacatgcgttatggttttcatttaatttttatttaagtatttcttcgaccacgcattttacagaaaatttaaatgactatacatttttacatttctgtttatttgttggaaatagtcacatttgcatacattttattatttttgaatcttgacctaatcctgtctgtgaaaccactgcggtgcactatataaagggcaagagagatggggtgagatttgaatccctattccgtgaatgatgtctgtacttctgaatttcctaaatctgaagagattcagagaaaaagtcatgagtatgtgattcctctttgaggagacaacatgaacctgtaactggaggttaatttacatgctattgctagagcaggaaaattatatctttggagagattaattgaagagcataaatctttactcatatgtaaggaaaaagcagtttcctctagtagctaagaaagcaaaaaagatgaaaaagttgattcatagatgaccatggagaaagatagtgaagttaggaataccaacaaaggtgttagcaggctagttcttacagaccatacagcagcataataccattatgatctgaaaaatcatgaaaatggggctacttactcagtaaattctggaattgacctttcattggagaaaaattagacacaaagaaactcttacgcagtatggatagatgagaatattaaaagacttcaaaaaatcttgggcttgaaggtagtacgatctctagacgtatacttttggtttatttcctttcttttaacataacttcctttcaatagacacaatacatatattataaaaatttcttcctatgacccttattttttctttacttgtaactgaggctattttaatttcatgtaatgtgacattaccactgaggttgttttacttcctttttcacgtagtgcccttaaaagaagaaaacagatgtcttaaatacataattatatttgcctctcaaaataactttgttctgttgttatcactattttacacattagaaaactgatgttcaacaatgttacatcagcctacaaaaggcatacctacgtgagcattaaagctaatatttgaaaccgacactcttgtttatctgttatgttttcctgatgcatcgatcctagtataatcatgaagcgtccttatataactctggtaacacatttcttttgaaattggctttttaaaatattaatatagccacttcagacattttatgttcaccgtttttaaggtatatctttctccttctatttactttcagtctttcaaatagacctacataggtctttacatgtaaaatgcatttttgtagatactatatatattctaacaatgtaaatatatatgttgctatgaactgtgaagggtttgaaatgttacacatcatgcacaaatatttatagatagatggccactacatggctgggtttgagaaaaagaacttaatattatttatcctcacagcaaaatgaacaactgtggtaacatttcagtgctgctcctcacccccgctcctcccagccagcatcaacatagagtgatgtggtgagagtcacatgtagaaatatcttaaggaaacaccagctttcactcaataggtaagggatacaggagaaaaaaaaatgttttcagtgcttataaatggcagagactattcactttccccgattcctttaagggagtctttttggagaaacaatgggaagaatccttaattttaccttcgtcataaaaatacatttccttgggagtcagataaggcctttgtcttcagcttcaaatcttcaagagtctgggttgcatttttttttttttttaatgtaaacacctgggaagaaaactctccagctttcctcgaggactatttgcccacctttgatattaatgttattgttatataacacctacaatataattgattggctcttgggaacataaaagaaacttgtattatctttttaaatctgaacaattggctcccttggggaaacaaatggctgcgatctaacttttatggtgtaagaaaatgttcttgagaaaagtgagagctatactctaactttatagtatattataatgtattataatatattagattccatagctccagaggctgtggttttacagaacaactacaaaactaaaatccaggaaagatttattttcccacagtacagtgggtgtttttttttgtttgtttggttttgttttgttttcaatattctgacaatttctgccttttaatcaggctgtctcatttgttaatgtctaatgcaattatccacatggttggtttaagtctgccactttattttttatatactacttggttgccctagatattatgatttacatccttgattttttatagttcaattatagttaatgcaatatttcatgagaatatatatgaaaacattaaaatcttgctcattctttgttataattcttaaatgtatcacacatacaatcattataaatcctgtaagatgatgttatattcttgttttatacaatcatgtttttaaagaaattgagataaaataagaacaagggaaaatagtattttgcatttactagataattagcatttacaatgctagtctttctttactgaatatatgtatgactgttgacctggcacaattttcctttagctcgaagaacttctttttgactttcttgtaatgcaggtccgtttagagataaatgcctttagcttagtttaaaatatctctatcacttcttggttacggaaagatatttattctgtatagaatttgaggttgactttaaaaaaattacgcactttattttttttgagacaggagctcactccactcgctcaggctggagtgcagtggcttgatcttggctcactgaagccttgacctcttgggttcaggtgagtttcccatctcagcctccttagcagctgggactaaaggcatgtgccaccacaccagctaattttttatatttttagtggatatgggtattgccatgttgcccaggctgggatgcactttaaatgtgtgttcattttcttctgtctttcagggtttctggtgaaaaagacaactcttaattggatttttattaccatgtttgtaatatggcaattgtcttttgcagctttcaagaggcaattgactcttaataatttatgtttctcagcatgattcctttgtgtatagtctacttcatgtttgactaacttctgtctgcaaatttgtttcattaaatttgggaaagtccagtttatgatatgttcatatataattttttctgccctatgctttctccactctgttactaaaattatatatatgttggacatttgaataacatctaacaattgcctgagatcagtgttttttttcttttcaatatttattctttctgttcttcaccttgggtgaactctgttggtatacttgaaagttcactttctttctactctgccatgtgcattaagctcttaagtccacccagtgattttttttcaaatttcagaaattgtattttttttagctctagaacgtctttctccttatctcgctgagatttcctattactctgctgagaattttttatattaaaaacctattttgtctattttgtaaaacatacatgtaagataatctatacaaactatttttatttttttctttgatgatagttataatagccacttttagaatttttttctgttagttctaaacacatggttattttagggtcgaaactcttgattttcctttctcttgaacctatgctatgtgttcttggatttttgcatgttagtaattttggcattatattatagctattataaaagttaaattttagagattctaaatttcatcatttttctctaagtgttgtttctcttgttatagtagaattttttgtttgtttgttttggtaggattgaactgcaaacctttttttacttgggcggtagctcctatattatttcatacatttgtcattacaagagttgtcttgagtcttttctgcacgtgtgcttaaggtattagttgggcatgtgagaaggtaaagttttgagagccccccctttggctctttcccttttaaacatttccccattctttttaacaaatcctggtttccttacttcacttttacaactccttacataaaaaaaaaaaaaacacctttttttcatgtgtgtccctgtcacaactgtgagcactgcttgtactgtccttagacgtagtccaaagcccacagtgacagtaatttactctgcctacctacccttctacaggtaagcaaaaactctgctatagaacctgcctacttctattcaccctctcgtaccttcagatagttgcttattgtattatatacgtgttttataattttcttcagggatttgttcactcaattcctactgtgaaaactggaatcaaaaatgttattccctttttgtttaatgaaatagccaaaataagactagcctttcttctcatctgaagtgctcaagcaacttggtttataagatataaaacatctcaaactatgttcttggcatttttcctaatttttaagaattcacagcatctctattacacaaaacttcctgaaaccctttatatcatgttttgtgaagaagagcctcacatgaaaattgtcctagaaaaccagtttttctactatcttttacttcttacagtaattgcaaaattctgttctcttttcattccgtttacattgttcattcattaatcatttaatgacccgtaactatgttccagtagttgttaaattccaaaacaaaagaactaaccaggaagatccgaaccctgaattgtgttctttgaaagtagttttgaaaacaaatgtgtaagcaaataaattataaaacacttttaaaatggttattacacaagtaccaaaaaagctaggaaagtgaaggaaatttttacctctgttttaaggtggaaggtaaaactttatagagggcaaggacatttgaattcgttcttgaaaaatgacaagatgttttccaaataacatctgtggcatagagctttccagacagaaataagagtaaatagagataatcatttttccacgtatcatccctatttctctctgtggcttttttttaagccaaagatgcaaacattcatcatattaaagtacatattttaaaaatgtgtatctttttttcaaaataaatgtttttctatgtgtttgacatataaggtacatggaatggatgtagcattgtgtcaagatgcatgatgctaaactgataaaacttgtcctccatcgtcaacagtgcagtataaaaaatcattgaagattaaatcaattaatgccatgataaaatttatatattagaaagatagtaataactccggttatagcatagagaacaaatttggaaagagaaaattgtaacaaagcagaccatctaatgcttctgaagagtgattataaggatctgaactgcctcaatgataacaggtattgaaacttcagatcacattaggaaaatatggcagatggaattgacttggcagctaataggaaatatgtgcatagaaaatattaacgaaataagactccaatattttatttttagtaattacattaaaaaaaagaagacattttcaagatggaggaatgagttttatttagccattgttgagtttggcgtatatattataaattatgacttcttatatcatttaggaagaatatgtagacaacagaataacctgctttttattttttgtttgtttgttttggtaatttaccattattatttctcccttgtctctctctttccttaattctttaagtgtttcttaacccctgtttgttttggtttgttccaaccctagccctaacccccaaatttattgagaaaacttcctagcaatatagacaaaatatatatttattaatacaatgtatgtttattaattcattttcttttcttggatcaccaattattttgtcacaaaattctacataattggcacatcttacaaacctttattttggactgcctgccaaaatggcacccacatgggctgggtgaggtgactcaggcctgtaatccctccctattgggacgccaaggcaggcagatcacctgaggtcaggagttcgagaccagcctgaccaacatgatgaagccccatctctactaaaagtacaaaaatagccaggagtggtggcacatgcttgtaatcccagctactcaggaggctgaagcaagagaatcatttgaacccaggaggtggaggttacagtgattcaagattgcaccactgcactccagtctgggtgacaaagcaggactctatttccccccaccaaaaagttacccatgttaactttggttccatatactattccatagccacaattttcatctaatttcattatgttcatctcccagaaaaccttactcactttcaacttggagcttatttgctccagtatcaatgtgagatcttttaacctccgcttgagatatgagataactaagactctgcattttaacaacttgccaaacgcaggcccagagcagtttttctgatgaccatattaacttgctttccatcatagcatgctttctctgcagtcaaaaattgtgttattcttggcattttattatatattttctttgatactggatactaataatcatgaacattcccgagtatgcaaaatgacaacctaatcacaaaaaatcaaatataatcttttaaatcatttttatgatagattttcaaagctgcttaagaagaaaaatatcacctgatttgctgtatatatgacctacctttatactttctcaaatctcatggctaaaaaaagaaagtacaatagatagacctttcatctaattttcaacttgcgaccatggcctaagcttgtaataaacatcaaattctattaaaaactatgagaatgttaaaaataaaaacaaagaaaaacaaaatcaaattcctctgctctctctgctattttaaaaattctgaataggaaaaagatctacatagtgaaataaatgtgattcaataaatagcttacattacattgtgaattcctgtatgcttacatcaagttaatgcccagtaattcaattaaatgaacacaatttagaaggagagatttccttaataatgtagcagtgcagtttctgggtaaaatataaaacagtatttatggtcatttactcaaacctctactaacttcagtggatattactttatgaattttacagtatgacacaaaagcaagctcaatgaagcagctatttctctaccagttgaagataataaaatactttactaagtagtcatttgtattacagttgcccttcataaaatactggtgctgtatatttttactatttgcttccactcttatggtatgcaaatataatcattataccattttactgaagtgttcagcatgtttctacaccttctaaattggtgaaaatgaattgcgatagcatgcagtattaatataaaatgccaggaaaattgcccacataatataactctcacattataagatttaaaaatgtcagtttagctcttgcaaacctccttttagttgtgcacgtaagcagaaacatgaggcactaagtgttatatatcttttgaaaatggcccatctctctagggatcagaatagtaatactgcttgcaaaataatatttgcagaatcaaagagaagaatactaatctcagtgaaacctaaatgtattgctttactgctattgaaatttaggaaaaagacaagactctctctgtgaagaatacaatgagaaattgacaatctatatgatgagtaggtctatacatttccctttcaattttatagagtgtattgagatctaaaaaaaaaattgtataggtttattcctgagaaaatacagagttcagtcacataataatgcttttgaccaattttgaggcaaaatttaaaacgaggtagtatggatccttaagacaacctataaaattataagccatggtgcttcaaatggcagtatcttctagctgtattcaatacagaattttaatttttgaacaagaatatatttacttggaatgattgcttaacttctttcttcatgccatgttcttctttacttcttattcgaattcttatattgttgaatgaaagaaacaaacgtggcatcttttagctgtgtagggaattattgggaagacaaagcaatttactggttttgtttcactttttcctatgactaattttttcctgtaagtagctggaagtgagtagcacccacactacatgattgttaagacagaataagttaaacaaagagaaagacaggagaaaaactaaaatcagtcttttctaaagccagattcctctttgtaggtgtgattacagaggcactgtcaaatggcagctctgcaaagtactcttgcttattaaacgatggcactaagaaatcagcatgaaaatctttggtctcctacatagaactgaccttatttgtaatatctccatccaccaaatagggataacaaaacgtatgagaaacaaatataagaattactaatgaatatatttaatacaaataaaacattcagaaacctagaaatatccaacaaatgatagtttcactggtatcaaaaaagttactcactgtatttattctctccattacataaaaaatgttaaagtattctaaatacatgaataaaaatacaaagaaatgccaaatatatgtaactcttatgaaataaaacaaactatatttctttgccttacatttttatagaatatcatatttttttcttattaaaactcataagtagatttgaaaaaaaaaaaagcagcagcagcagcagcagaatctttagttccagaaggacttgaactgaaatcctggcattcttattctagacatttgggtaatctttccaaactaattttttttttttaaatttctccatctctaaagtgatatttcagggtggttactgagaaaatacagtagtattttctgtcctgtctgggatttagtaagtatctccagaagtggaaaaaatctattctatttttctccatagatattaatattaataaagaagataatactgtctttcttggataccattctttctttgtggtatgctatttctctgctttgaagttatttatccctctttgatgacagttctctacactccggagtcacttcttcaagtgatttcatccactattacaggttaacaaccaactgcatgttgattgctcccaaattcagatctctagattctgaatactcctatgtactttatattttaccacaattatacgccctctatttcacttacactattcatcaacttttctcataatgctagtcattcccctagtgattcccattaccctataaacttttctttggcaccactaaagttcatgttatcttttacccttgcatgttttcagtcaataggtagagctgattttacttaataaataatcctcaagctgttcctgtttctcggcctactacatcaacttgaattttcagtacctattacctgaaattctttatttggctgtatttttgcatctttgcctgcaaacttccacaaatacatactttgcacagttatcaggctgatcaaaatatcatgaaatgtggctgaaaagctcttattttttaaattatgaaatgaatttctatcaaatataaaaacaaaaaattttatacaaagtatcataatatacctttcctatgaccattgaagttttcaatgacctaatgtatatgtgcctatccatgttcatctttatcactcactgttttgcagttattttagcaatagcaaactgcattcttttctgtatgcttttgctcatgtccccacttcctgaaattatcttttaatcttgctttacttaatttctactatattctgtgtctcggatcagactagctaacagacctatcacatgctttgaaaaaaatgcctgacactatgttaaagggagaaaatttaaaaaatttatatattacatcttatcttttcattaggtacattcatagctaagccatgccttaagataatactaataccaattagaaatagtctattgaggatttttatatatctgaacccatgttcaggattttataggtatagccattaaactcaaaacagactgtggcagacatatcactattatccaccggaggccatccttaatatgcctctctgataaaagacatagattagatttcctcagagggtaaaattaagatgtacagagtttaggttacttgtaggacatcatataactaagtggtggatctaggagttcaccccacatgtttctgacttccaacattatacttcataacactgtggtgtaacttctctcaatgaaataactatgtctgtctgtctgtctgtctatctaatctatctatctatctatctatctatctatctatctatctatctatctgtttctgtcctcatgagtatttaaatgctggcttgacatctaaaacaaattagatagtagacaacactaaacagtaacattttggaaaacatacctggagtaatttaccctctccctacattcaaatttaaatattcatgaaaacacagaaaaacttatgagttgtttaaagtagaatggaaactaagcttagtggtctataatatgccaaacattcataagctcagtatgactctattaccaaccatagcaccctcctcttttacccacctacaataaacaaaagaagtcaacattcttcacgtctaattaacacattttccccatagtactctggaaagtgaggcatggatgcatgattcatggagggtgaattattttagtcatttaaggtgctttgtggctagaaggatggaaaaaggggatacaagtgctataagtggatcacttaaagagataatctatctctgtgggaagcctgtacagaatgagacactctctagcccaagggcaataactggcttctggagcaagatgctggctattgaacgtgacaaggaactgcttatggctcctcctgaccaaggctgtttctgtacctgagtccttcaggagataggaaagaaaactagccaggaaggtaaatgaagctgcttttaaataacaattctatgaaaacaaaacaaaacaacaacaaaaaaacaaaaacagagatggttgcatttacttccaagacaatatattttatatctacattaagcagaatagggtttgtgacttaagttgttatacaaaaatgacagttacatttacttttgaaaatctgtgtttgtgattatgaaacttgagtctatcaaaaaggagaatatttcctgccaccctatcagttactcccttcctcagtggtttaggggcttctgtgggcatttcaagcccttatcaatgtccaatattcctttcttcccaggtgcatggaacagtggcacttttcttttgtcttgaagttgtagccattaaactgcactggccagtcaaatgtgagtaggtgatatgaatcactttcaggaaacatttaattgccagactgcaactctcctgtgttctcttctccagcccaaaggctgccttaagcttttgaggtcacaggtttttaccatatcattacttagcctaacccaagtgaaccaaatgaacgaaccaaatgaaccaaatgaatgaatgaaaactgctttctttctagctggaactctttccaacatgatcccaaattagacaaagcaccttctaaagctatttatgtaccatcatttccataattaaaacaggtataggacaaacatgggtagatggtagaatttgctgtcatagacataaagggaaccagagaaaaggcattgaaagacattgtgatcagtaaatgctaagtgttgtgccttttcactctctaattacataaagggagtaatttacagactgcttcacattacccaaaatatctgtcccgcagtcaattgaacataaattttcaagaataagtccctcctcacatgaaccacagcaggaaataaaaagcagtaagaggaattagactagctgatttgaggaccaaaataccatccatttaatattagagagttcaacaacaaaaacataatatactttatgtttatatgaagaactgcatgtttaggttattcaagaaataggaaaagcagacaacaaaaaagaatgggcaactgaaagaatttccaaggaagaatctgacataaaaaagaattaaatatgttattaatgccctaggcactgatagatgtcctagagatagagctatgactagcaataccagatttgtttttattacatgaaaaatattttgaggaggctgtggaatgtggtgaattattacatctagaggcagaaggaggcaaaacaatgacataaaaaggaaggcaaaacttgaaccagatacttacagacaataactacaagagataaataaaactgatagtacgaggaagaatggggaaggattgtggttgttggtgatttagagtcagaaggctgggaaggtctctctagaagaagaaagttaactgagattcaaatgatatgaataatccagtgttttgaggttttggtctctgaggtgagatcacgttggcagcatttgaggtgtagaaagtattctagtgaaactgaagtgttctgagcctgagaagaattgtatgaaatgatgtaggagatgtgggctgggcctttttgtgacagatgctggtagtcacatgatgagggcctagttaggcttcatttagaaaatgcatccgaattatgaactactatccaaatacatttaaaatattctggtgtattttgtaaagttaaatacttctcttgttaattatgtctgtttagataggtcttgttaatgagacaagaaacacctgtgtttggcttgccatgaagaattatactggctgttttgacctctggaggaaggctgagccctttggcatcacatgtgtttgcagctcgtcaagctggctggatatcccacctctccatgccctatagctctgtctcggaacctgtgattgctgtgaattgtgtcatctgcacacagttcactaaccagttatgtatagactggttatgctacatttagtagtttgtgttttattctgacagttggaaagccacaagagagttttaagttggggagtaacaaataaatctataatttaatgggactaccatgcctgctttgtgacaaatggatcactagaaggcagaaattgtagtggggtgaccagtttgaaggatgttgaaatgactgcaaataaacaagtttcacaggttctttaaggaaaaaaaaaaaaagaaatagctgacaattctatgcccaatcaagttgtcattgagataaagttaacagaatgtttgttaatatataaaatgtttaaattaaatgttaaatatattaaataaaatctattgtaaaaataaagctctatgttaaagcaaaaggaataatggaaatggaatgaggggagaaaacataccaaataaatcaagtaaaatatcaatagttaagtttttctcttttcaattattatttctagaagaactagtttatgtattacttttatacacttaaagcttctagttaagaaattgctgctctaagacttgagcctctgccagtgaatgctactgtagcacataaggcttaggaagtgggcagcatgcttgggaataccattatcttagagacatttgcaaaagttcaaaactaaacatgtgtaagttacttccagtaaaagtcatcatcttataccaaggcacaaggagctaccacgtctaaaccttaacacaaagagaaacagcaatagaactggtgactgcagggtttcagaaaccaacaaaaccaatcatattatgattcaaatataggtaaacttgagtcattatcagatgttcaagcactgatggtcatcattcacccagatatacattctactcaatctagtattcccaagcacttttagggtcctccactggggtttgccacactctggtaaaaagaatcccatttttaaaatttcttagcctttttatcttttttttttttttgcctaaatcagttgttctcaaccctgaattcacataatattgaatcattctttgatattaaaaacaaacaaaaatagctaggcatggtggtatacacctgtggttccagctacttgggaggctgaggtgggagaatcacttgagcctggaaggtagtggctgagctgtaattgtgacactgcattccagcctgggtgacagaacaagaccctggctcaaaaagcaaacaaagcctgtaattctagcactttgggaggccgaggtgggcggatcacgaggtcaggagatcgagaccatcctggctaagaccgtgaaacctaccccccctccccgtctctactaaaaatacaaaaaattagccgccgggcggggtggcgggcgcctgtagtcccagctactcaggaggctgaggcaggagaatggcgcaaaaccggcaggcagagcttgcagtgagccgagatcgcgccgctgcactccagcctgggtgacagagcgagactccgtctcaaaaaaaaaaaaaaacaaaaacaaatttaaaaaaaaccccaaccaaccaaactaaaaacacaacactcacagaaaacaagcaaggaaacaaacaaatgaaaatctacctcttccccatatgaagatgggtttaaatcagaaaacatactttaaaacaacacctttttttaaaatagttttcttcagaaaacaagcttcctctgcggccttcttaaggctcttctcttacacatcacatatgtcagagacaaggactgacatggctcattatcaatgcttccagacattactctttttctttaaataagcaaaaaaaaaaaaaaaaaaaaaaaatctttggttcctttaagatatatattgtctttccataccagtgtgtcacacactttaatgcaaaccatgtggagtttgtattaaaatgcagtgcagactatgattcagtaagattggaatagacaagattctgcacttctaaaacctcagagggactccagtgctgctggtccatggaatacacctaaaaagcacaagccaatatcatcctctctttctgtgaatcacctcttcgccctcccattcttttgctcaattttagcctctcgttcacagacttttcttccccatctccttttatcaatcccaatgatataaacatctatatagatgaaataatctcaacctgaacatttttatattaataatctaacattcaatgatgtttccctctacttcaccttaacacttgtaccttatcaacaagaaacaagactacatttatatgtctattttaaatatctggttttcatcttccgttctgctgcaccatcctatgtcccatattcttacagttctcctgatattgtacattcattgccatcatttcctgaattcattatgtccctgagcattttgactctactactttctcagaagggcccttcttgtcattcttggtggggagcagaggcacatgagaatcctattctttctggtatctgcatgagcagtcagcccactaaccactgagcaattcgtttcatgtgaatcttgtcagtggccaagacacttgtgcacattgatcttgactgacccaaaagagtatacaccaagtaagggaacagtcttctctgtttagagatggggatgaaacttatacagttgaaaaaggagacaaaggaagagaacaaatggggaacatttgagtctctattttcattaagatggaattaggcatcagattatctaagtttccagccttatttcatcaaatcctaattctggtactaggctaattattactaaattttcatgtggtgtgctttgctaatcacttcttgtgttttcatgagtgtcttattggaaatttgtgaaaaaacatgtcaatcctatcaggacatgattttaaggtagaagctaaaaaataattcagaatattttggggggagtgagtgattagagaacatgtataatggagaatgatcagctctggagcatgtttactttagcagtgaatggcctaatctacaattacttgcatgtttcttagaacattttcttctctctgtattctactactctacagtgatacgtgtataataaattgccatagtgatttggaattttaaagcaattcaggttaggctatagtatctcaaagcccctaggtaaaatttaaagcagaacacaatttacttaggttattttcattttctgcttagtctcacctttacttatttcttattattagtcttcctgtttgtttcatatagctaatttatttttgtttgcaacctgaaaaaaaagaacactaaaactaaatttggaaaaaaagtcataaaatttcttatatcatgccttatgcctaatatatttaaaatgacttaagagaaaatagccacctatgtcttttagataatttgtaaaataaactttcatatgaggtgtaatggaagaggtctcatattgaatcttgaattgggacagatattaaaatatcagaatcccaaaaaattgttttaacaagtaaaacattaaataaagtacagaataacatatgcacagaaatgaatatactaaaaaagcaggtttttcaaatgtagtccagaataacttggctttcacaatatcacaaaaaggggatttgccacaccagaagaaaccattcatacatatcaccccacttgttttttcctaataataatgtttataattcagacaggtcttcaaagacagggacctaattgggcttatgcactggattggtagacataataaggtgaaagttatgaagagcgtgtcaatgagaaaatttgatagtcttgaaacgtaacatattaatttgcagtcttatctcagcaaaacaagtaactatcttattttttgaaattcgtactgtttatcataggaaaaaaaagtgtggtcccattaatgtttaacataggaaattatgttagtttcagttttcacacaccactgaactgtcttttgatgccatagtttgaaattataaaatgtggaataattaaacatttattgaagttataaaaagtgagaaaaaatataatttttgagtcaagttttcacaaactaaaactattttctgttttactcttaaatctgagtaaatcatctaaaatcttaaaatatcaattttagaaataaaatgaaaataataccttgtttgaaaatttaacaatgattatgtgagaaataatgcaacaacacgttgagttcagtgcctggcatagatatacatctatccatttattcagtaatatttgaacatagatattatgagcatatattaatatgaagacacaattagtcgtgatttctaaaaaaataaatacagataaaaatgatttttatgagtacttgcagctatgctatgtctatttaacttaaatataaagctcatataaataaagggaaacttgagcaactgtaattttaaattccaaagagacttcttgactaattgctacgtaaacatcctttcttcgactggggaaaaagtgaatgtacaaacattaaaaaaatttgttcaccctaatgttgtatcctaatacaaagcttgagctattatttttctaaagagatagttaaaaataaattacaaaagaggaagaatgaaagcataatgtattctgtaatacagttatgttttattttgtgttaaatttattttttgctgcttttaatataccttattagaaaatagaggaagtcacctcacattgccataaatgagaaaaagttgtaattaaatataattaattgaattaagttgcgtatatggacagaatatataaggacacttccccttccaccaggaaagcaaagaaataaaaggtcctttgaacagagcttgaccttctaagacagtttgtgataggaattcactgctcaaacctatgaaataattgcaattgaggaaggaaacaatacaagagcagaaggttgacaaaccagagtggctaatatatgtttattacttaatgttatgtcttttcaaaagtgaaagcagctttggtgaaaaacttccaattggtggctatttcttggctttcttaatctttcaccagctgacttataacacccacccacccacacacacacacacacacacacacacactagtttagtctcccaaagagaaaagtttatcatatttcgccaagaatttccctaaattctgaaatggtgaaaacagtcactttatcagaaggatgttcataatgttaaattaacatttaaagcaagccaggcctgtaatcccagcactttgggaggccaaggcaagcagatcccttgagctcaggagttcaagatcagcctgggcatcatggtgaaatctctacgaaacagacaaaaattggcagggctggtggcatgcacctgtggtcccagctacttgggaagctgaggtaggcggatcccttgagcctaggagtccaggctgcaatcagcctagattgtaccactgtactccagcctcagttacaaagtgagacactgtctcaaaaataaaaatataaaggaataaataaatgtaaaaaaaaacattgaaagcaaaagggactttgtagacctcctacacatggatacaaataagaatttatcattgagcttgatgttcgctttgtcacattgagaaaatttaaatattatttccagatgaataaatttgttgcattaaatgtcaatggtacactgaagcgagaatgtgatttgaactcaagagtctttagaaatttgtatcaaaagataatgtacatgcttaatttttatatgtaattcacaaattataaaatataatttgtcagaataaaaaatggagttttgtacttacatttgaggttttataattttattacaacttaaacatctccatgtctaatgaacaatatatgcattacttctcctgactacatcaatctgcattaaatcatagtgacagttgcattaaatcatagtgactgttacattaacagctaaatgcagatagttctcttcatttaggaacatgcttgttaatcagaattacacaaatcttgtacatctccagaaactaacactgacctagaacttaattgttcatctaaatgctctgtgaagtgtttgaataggtgtaatttatttacttagaaattaccaacacagatgctgtcccccattacacacctcttttgtattcaactatgatttaatggtttcttgtacaaaactagtccaagccaattaaaaagcaaataaatagtcacagtggagggtaaattgccttttctgccttcttgaagcatgtgtgcaccactaagataagatgttgtcaatctgttaaaatctccgtgaatccatccttcttcactgctagtagcaggaaagctttaacactttgaacaactaggaagggtcatttgtctaagttgtggcaaagcctaaggggcagaaaggccatagtatttcctgcaacacattaatctagactttaaaataatggaaaatattccaaaagtgtcactgttaaacacactgttgttggcttaattcaacttcctttttcccttcatttattcaagataaaataatgctgtacattttatttacaaacatgaagcaaagccaatgtcattaggattgttcagtgtagacaattcatctatagagtctcaatgaaaccagttgctaagcccccatctcaagtaacttaatgctgtcacttcctcatcaattcctttgtcccccgctgcccatttgcagttgtttagaattttgtttctgttgcctagaacaataatgagtattatgatgaagttatcaatgacagaaatttttaagcacattaattatgcagttctatttcaatgttaccaatgttcttttgataatatatgtctattatttctattttgaattgcatttattatagactaaagctgttgtaataaagaatccgaccaaaatttttgatgtttgatggcttacagcttctacatctcactcctccttgctctcctactccctcacatctataaaaagtggataagaaagtctgtgtgcttcctactttggcacaggtcagaagctcaaaccatgtaaaccccttcccctcctggccccacctcctaacaataaggatccaaagacaatctcccttcccttgcttttaggccaatttaggaggcctgccttcctctcttcagaaaagccccattatgtgagtaacaaaactttttgtgcgctcttggggtatgtgtggctttatcagtctctacatctgaaccaaactgtgggtaggaatctagcctgcatcttctggttgtatacaatggttttataatttacgtatgcatatgaagtacctggtaagattataaagcatagattcctaaaccttctgcaagtttgtgaattggacactctagtgagacaccaacaagtcagggttttgtttctttttgttgtttgttttttacagatttgtggcatcaacattttaccttttatacccatttcttggataaacttattaactctttcatttaaagtcttgctttaccttgtgcattattctcccactcttctttaaggcttaaatctttgtatcttcaatgacaataagactttagcacacgaatgtgctcaatgttacttctatctcagaactaatcaagtaaaacttgagaaatatcagcaacaataataaatagaaatgtcatcatggtttcttatgtcaatgctaactctaaatttgacaaatttctggtttctagcttgatttagagatggatcctaaataggctgcttgaattttccatcacgtctaattctttgttgcatgtagtttttaagtgccagttaataggcaagcacctgcctgaccacatcagcaacaccagaggcagaaggcattattaaaacacagatttttgggcccactccacagataagttggtgtagggcccacaaaaacgatttttaaagaagcaccccttcaggattcttatgcagtcagctaagtataggaatactagttagtaatgaatgtgttctggagcctcaaaatattttagagcaggaagctgccacttattgtgccaagttttctctccaactcttgcagcccagcatgtcaactgatgaaaaagtgctggcgttccaaaaagcctgggggatggtgctcagaaagcccctgctaggagctagattggattatctcaactcatacctctcagctaacaggtgacaccctgctgaaagctgttgacctgaggctcttttggattgtggtaagagtgtgaattgtgatccatcactctggagaaccctgatcagaggctattagcaatgcacctggtcttggcaattgatagaaaaaggaacactgtgccaggggaagcttgcgacaatgaaaactgtttcaaaattcttctttatatcagcaatcctaactctagaatcatcaaaatataactaggttttattgtgtgtgaaaatgtgataattccaatcaacacagttgtactacttaaatccttcagttagaagaaaaatactaaaaaaatactaaataaacgaacagatttttatgaattttatactgtaatttcccttacacctagtagggaagaatatttgaatttctagaaataatgtatgtatttatctacatataaaaataaaattaagactttacataacacccacctttaatcaacgtaacattttctgacatttatgcattttcagaaaagaaacaactagcctgcaaagcaattgttaaattttaaatgtaggcctccaaaatacaataaacaaactacagaaaacagaagcctatcaacacagtaaacatttgcaatggttttaatataaccataattataaactgaagaacagaaatatattaatggaaaaacaatttactgtagctgtgttattgtcctgaaacaggaagcctatgtatctaataataaggtggaattgcatcatgtgtaaatatataaaatgagactttttcaggcaggcattgaacacatgtttactcagacttttaatgaggtgtctgagagaatagcagtggtcccttcagtatccatttcttcattttcttaggcatatcatctcccaaatgaagagccagggtgatgggctaagacctcatatattaaatatgtacagaaaaaaatgtgtgtgcaactttcctctcactgtttgtgcagaactttctctattttatcttcctataaattgcttgtacaatactttattttatcttcctataagcaaaaacacagacagacatctagttttaatcaatcaaataataataataacttacatgatgaaagatcccaaaatggaagcaattgtctttctgaatgactttttggtaagtaaatctggtcttccagtaagaacttcccatggtcaaactattaagagatgaataaatatttatcttacccaaatcattacatttttgggtctaatttttacagcagcttaacctttaccatatccgatcaaggtagaaaaagaaaaatattcaaagttatatttacagagaaatctaaaataaatattaacagaaaggagaagtgagagattgagaagcaaaaccaaggatacccattgtcactacacctattcaatatagtattgaaaatcctagctagaacaatcaggcaagtgaagttaataaaaggcatcacaataagaaaagaacttgaactatctttcttcaatgacaatacgattttatacctagataacactaaaagactctgccaaaaagctcctagaactgatagacaacttcagtaaagtttcacagtacaaaatcagtgtacaaaaatcagtagcatttccatacacaaataaagtttaagctgagtcaaatcaagaatgcaattctatttacattagctaaaaagaataaaataagcaggaatacagctaaccaaggaagagaaagagctcttcaaggagaactacaaaatactcctgagagattacacaaataaatggagaaacatcccatggtcatggatcaaaagaatcaatattactaagatggctgaactgcccaaagcaatgtacagattcagcattatttctaccatactaacaacttgatttttcacagaatcagaagaaactattctgaaattcatatggaacaatagaagagcctgaatggcccaagcaatcctaagcaaaaagaacaatgctggaaatttcacattacccaacctcagactatgctacaaggctgcagtaaaaaaaaccagcatggaactggtacaatagacacatagaccaatggaacagaataaagagatcagattaagtcatacagctacaaccatttcatctttgacaaattttacaaaaataatcaatgaggagaagactccatattcaataaatggtgggtgctgagataactggctatccatatgcagaagagtgaagttggaccccctatctatcaccatatacaaatatcaattaaagatggattaaataaagacttaaatgtaagacctcaaactataaatatcctagaaagaaacctaggaaatatccttttcaatattggtcttggcaaagtatttatggctaaatccttaaacgcaactgcaacaacaacaaaaattgacaagtgaaacctaattaaactaaggaggtcctacacaacaagagacattctcaatagaataaatagacaacctacagaatggggaaaatatttgcaaactatgcatttaatgaaggtccagaatctataagaaatttgaagaaaacaaaaggcaaaaatcaaataaccccattaaaaaatggtcaaaggacatgaacagacacttctcaaaacaagacagactagtagccaacaaacataaaaaaaatgctcataatcactaatcatcagagaaacgaatatcaaaaccacaatgagataccatctcacaccagtcggaatagctataatcagaaagtgataaaataacaggttacctctgaggctgcagaggaaataaaacacttatacatagttggtggtaatgtaaataagtcactggaggggcagtttgaagattcctcaaagaactaagaattgaactaacatttgacccaacagtcccaatactggatatacactcaacggaaaataaatcattctgccaaaaagacacatgcacctgtatgttctttgtagtgttattcacaatattaaagccatgaaattaacccagggtatatcaacagtgtactggcaaaagaaaatgtggtacatatacatcatagaatcttatatagccataaaaagaaaaaaaatcatttcatttgcagcaacatggatgtagctggaggccattatactaagtgaagtaatgaagaaacagaaaaccaaataccacatgttctcacttacaagtaggagttaaacattaagtatacatagagataaaaataggaaaaaatagacactggagcctagtagaggagggaaagagaggagggcaagggctgaaaaactaccgcttgagtactatgctcagtaccttgctgacagattcattcaaactccaaaccttagcattatgcaatatacttatgtaataaatctgcacatgtactctctgattctaaaataaaagttttaaataagttacgttcatgaaataaaattaggaataaatattagcttgcccttcccatacatatttgaaatatttaataacaatgggaaaatagtttttgaagttgtaagacaattgactgcaattaagaaaatcacaacagggaatacgatgcagtcatagaaaagatcatgtcctttgtagggacttggatggcactggaggccattatccttagcaaagtaacacaggaacagaaaaccaaatactgcatattgtcacttataagtgggagctaaataatgagaacagatggacttatagaagggatcaacacacagggggcctatcagagggtagagggtaggaggagtgagaggatcaggaaaatgactatttggtactaagcttaatacctaggtgataaaatagtctgtacaacaaacccctatgacacaagcttacctgtggaacaaacggcacatgtaccctggaactaaagttaaaaaaaaaaaaagaaaaagtacatccccataaagactaaaaaaaaataattaataagttgtttttaaaaatagttttaaaatatgctaaaaaaactgtttattgtaagtggtaaaaatgcaattaactaactcaataagaaagaaaaaatacattgacagaaataaactatttgggacataaatgatgaaagacaaatttatttcttaagtttttataaattatatatacatataaactttataaaaaatatatatttggagtacaacatgttttggcatatacatacccagtaaatgattaatactgtcaagctaattaacatattaatcacctctcttagttacctttgtgtgtgtgtgtgatgagaagttagttttattggagaacaaagtagtcatttcccttgagcttagataagtcaataaaactataaagtaagtaagggggaaagccagaaacaacagaatatacattcttcttattgccacatggcacatactctaaaattaaccacataatcagatataaaacaatcatcagcaaatgcagaagaactgaaatcataccaaagacaatctcagatcacagcacaataaaaaatgaaagtcaagattataaaaaaatcactcaaaactgtgcaattacatgaaaattaaacaatatgctcctgaatgagttttgagtaaataatgaaattaaggcagaaatcacgaagttctttgaaactaatgagaacaaagatacaacacgtcagaatctctgttacatagctacaaggtagtgagggaaatttatagcactaagtgctgacatcaaaatgttagatctcaaagtaactacctaacatcacaactgaaagaattagagaagcaagagcaaaccaaccccaaagctagcaaaatacaagaaataaccaaaatcagaactgaactgaaggaaatggagtcataaaacaacattcaaaagatcaacaaatccaggagttggttttttgaaaaaattaatatgataggctgctggtagactaataaagaagaaaagagaaggtccaaataaacacacttaaaaatgacaaaggagttgttaccactgaccccacagaaataaaaataactgtcagaaactaccatgaacacctctatgcacacaaactggaaaacttagaagagagggataaattcctggacacacacactaccccaagactgaagtaggaaggagttgattccctgaacagaccaataacaagctctgaaattgaatcaataataaatgccctgtcaaccaaaaaaattccagtgccagatggatttacagccaaattctaccatatgtataaggaagagctgattcctactgaaactgttcaaaatattgaggaggagggattccttcctaactcattctatgaggccagcatcattctgataccaaaacctggcagaggcacaacaacaaagaacactttaggacaatatccttgatgaacattgatgcaaaacccctcaacaaaatacttgcaaatcaaatccagcagcatatgaaaaagataatccatcataatcaagtaggcttcatctctgggatgcaaagttggttcaacatatgtaaatcaatgaatgtgattaatcatatacacaaaaataaaagcaaaccccatgtgattatctcaatagatgcataaaaggctttcaataaaattcaaaatctcttcatgttaaaaactctcaacaaactaggtattgaaggaacatacctcaaaataatgaataatctatgacaaacccacagccagcatcatactaaatggacaaaagctgtaagcattccccatgaaaaccagcacaagacaaggatgccatctcttaccgcttctattaacaacatagtattggaagtcctagctaggttaatcagacaagagaaataaataaagcgtattcaaatagaaagaatgaaattcaaactatcattgttagcagtcaacataattctatatctagataaccccatagtctcagcccaaaagttccatcagctaataaacaacctcagtgaagatttaggataaaaaaaccaacgtacgaaaatcactagcattcttacacaccaagaacagccaagctgagaggcaaatcatgaatgcaatctcattcacaattgcaacaaaaagaataaaggacctaggagtatagctaatcagggaagtgaaagatgtctataatgagaattgcaaaacactgcttaaagaaatcagagatgaaacaaatgggaaaacatttcattcttattggtaggaagaatcaatatcattaaaatggccatcctgcttcaagcaatttacagattcaatgctatttgtataaaactaccaatgacattcttcacagaactagaagaaaagtagtttacaactcatttgaaacaacaaaaaaaagtgcccacataaccaaggcaatcttaggcaaaaacaaaaacaaaaaaagcaaacaacaacaacaaaaaacaccaaacaagcaaacaacaacaaaaaaacaaagttagaggtatcatgttacccagtttcaaactatactacagggcaacagtaaataaaacattatggtactagtacagaaacagatacatagtccaatggaaaagactagggagctcatcagaaataaggctgaacacctacaaccacctgatgttctacaaagctgacaagcagtgtgaaaaggactccctattcaataattttgctgggataactagctagctatatgcaaaagattgaaactggactccttccttacaccacatacaaaaatcaacacacgatggattaaacacttaaatgtaaaacctaaaactaaaagccctggaagacaacataggcaataacattctggacacagaaacaggcaaacctttcaagatgaagacccaaaagcaattgcaacaaaagcaaaaaagagacaaatgggatctaattaaacataagagcttttgcacagcaaaagaaactatcaacagggtaaacagacaacctacagaatgggagaaaatatttgcaaactgcaactgacaaaggtctaatatctagcatctataaggaacttaaacaaatttacaagaaaaaaaaacccactaaaatggttggaaaagtttgaatacacttttcaaaagaaggcatacatgcagccaacaggcatataaaaaaatcttaatataactgaccattagagaaatgcaaatcaaaaccacaatgagataccatcatattacaccagttaggatggctattatgaaaaagtcaaaaaacaacaggtgttggcaaaaattgtggagaaaaggaaatacttatacaatgttggtggaagtgtaaattagtttaatcattgtggaaagcagtgtggtgatttctcaaacagctagaaacagaattatcatttgacccagcaatttcaaaggaacataaatcatactaccataaagacacatgcatgcaaatattaattgcagctctattcataatagcaaggacatagaatcaacctacatgcctattaatgacagattggataaagaaaatgtggtaaatatataccataaaataccagatagccttaaaaaaataatgagatcatgtcctttgcagggacatggatacagctggaggccatcatccttagcaaactagcgcaggaacagaaaaccaaataccacatgttctcacttataaggggaagccaaatgatgagaactcttggccgcaaagaggaagacggaaacaacagacactacagcctccttgagggcggggtgtgggatggggagaggatcagaaaaagtaactattgggtactaggctcagtacctgggtgacaatctgtaaaacaaacctctatgacatgagtttacctatataacaaacctgtatgtgtgcccctgaatctaaaataaaaagagagggaaagatcaatttatcattaaaactgagatacattttaggaatggcaaattacattgtggggccagagtaccccatacatatcataatattttgggtcagggattatataagaataatggacaagatcttgggatactcttgcaactgtccagacctagaaaaaatgggaagttgttgagaaaatctgtgatcatatgagtgagtgataggagatttgtaagtttggaaactgatatatatatattttttcagattagagatgatttaggttggaactcttgcagtggctatagaggttgaatggtgagtgatgacacacttcagtaatttagactcataatgtctattgatgtcttattttggaaaattgatttgattcctagggaaataatagagaaaatctatttcaactatgggtgagatgctttaggttattttgtttgcaacggttggaagagtaaaataaatcacatcacctttttaattcttagaatatttagtcagttacattccctatgttatcctcaaccaaaaagttaacttttccaaagacaaattcattttatgaagttgtgttactttttattgaaaaaaaattaatgtcactgaaattttttttcattctacctcttatttaatatgcaaaaacttgttagtaattgagatagaagacctgtagtttaaatgttgtattattcctgatggatgattatgaatataggacttgactatatttcaagtttatagtttataaagaatgtagtttcagtggatttaaaatagatataaatatagattaaaaaattatttatagatggtttagcatgaaagttttctgctaaacacttacaagtctgttaaatatcacttcagttaacagtgaaatagtgaatctcattcatttttttttaaatctaaaatcagattccatctgtccaatttggtattttggcactaactgttatttgtgatttcgtttgatatggttcatctggaattttagtagtgaccattcattgtgatttgatttgattatacatagctctctgtgatgcttactggaacgcagctttataaatgcaaattgtcctgtatgtctcagttactctaaaattggatttaactatttggaaattgtgggccaagagaagcttcatgaacttcttttaaaaattctgtaaaacatggtatatagcaaatctatttttgaatcttttacatgtaaatttaatggaaacattaactttcatggcagaaataaatatgtatatatgattctaaatgattcattcatcaatatcagaattaaataataaagacaaataaaaaaattcctgtcaatgtggccttctccttgaattataagtcaaatgtattccatacagtacattgaagaatttgtacctatgttaacacaaaagtttgatccatagcatattcttcatgaataaaagaagtaagccatagagggatatgtgtaaattggatacatataaaagtattaggcaatataaattaatagtaaaatatgatcaaatttgaataaactttcttgaaaataacaaattttcaagcaggaataagtaagttatattttataatttccaaggtcattatagtacaaatcatattacgatcacttttttatagttagaattatttctaataggactatctgagctacttcgagaaaactagcaaggtctaccctgaaaacacttcagatatgtgatatttcaacatgtaataatatttataatacatatgtcagatcttaggtgatagactatttactaacataacaattaaaaacaaattacaaactgaatttctaacataaataatgaagattaaatatcctatgcactcacacatatattatcaaaacagtatgttactagacaaaaaaatatcacaaaattataatttttcttcctttttcgagacaggatctcatactatcaaccaggctggagtgcagtggcatggtctcagcttactgcaacctctgcctctggtgctcaggagatcctcccacctcagtctcttaagtgggaccacatgtgcacaccaccacacctggctaatttttgtattttttgtagagatgaggttttgtcatgttggccagcctggtgtcaaagtcctgggctgaagcaatctgcccacctcggccttccaaagtgctgggattacaggtgtgagccactgcacccagccaatttatttcttttttaattcaaaaacttttatattgagtactaaatgtatgcaacacattgtgcagatattcgagatacacagatgaacacaatcaaatgtcttctgacctctaaccttatagaagagtccagataagaaagtaaacatccagcaaataatcaccccaatgtataagtaaataaaactgacaaaaataaaaaaggatagctatatggttccaggaaaccccaatagagaaattcactctagtttctctgaggaagtaaagatttagttatgaaacagcattataaagcaattagcaggatcagagaagaagcagtgcggaaagaccattccaatcagaaacagccaaatgttaaaaggccctcaggagtttggcatcgtgaagaaatgagaccatttgaggtcaggttgagaggtaagactgtacccagactgtgggccatgataaagactgaccacttgatattaaggcaatagaaaagcactggagacttttaagccagagatggaatggagaatcagggagaagatcagatttgtagactggaaaattttgacttcagtatacaaaaagaagtatctgaggaaaagagaggtctggggaaagcaggaagccactaaattagctcatgtgagtgataatggctgctggatataaggagatggaaagaaaggcagagaagtaggtagaatcaataaatatttaagaggttaaaatatataggattagtactggaatgggtggcatttgtgtattgaaagagaggaaggaatacaagagatatttaagaggaacaagtttacaaaactaaaccatatgtttggttataaatatgttgaatctcaattatatttatgatatttacttggaaaacataagtaaacatttacatactaaggtatgggcttcagtgagataaaattttgtgtttattacatattggtgataatatcacaccttgggcagaaaagagactgctagagattataatgcctaaataaaaaaagaacaaaaaattaagaaatctttaaatgtaatgttttgtacaaaaagatgaaccactgaaaaagactgagaaggacgtttttaaaatatcacctgaggccaaggacagtaccgatatcaatgaaagatttcaatgaaagagactttttcaatgagaggatttgagtcctattgaggaaaaaattaattacttaaattagggaaaatagttaatatcattagtaatcacagaaatgcaaattgaactattaagatataactgcaaattagcaacagttaaatgataatatagaatgtaactataaaatgagtatcacaatcttcacatgtctgcttcttactttttttggaagcccagtattactttaaaatgtatcatgtaatctactaccagcgatatttggaacacagtagtaaaaataagaattattaaaatatattaagagtgtatatttggttccacgctgaaatggaaaaatgcatttattcctattatttctgctaataatggctaacaatcctggacattatttgtaaaacaaacagaaaactgaaagttggagggaagaagcaagactagctagtaatcctaggatccgagaaataacatattggtgagcacactgggttttctttatactttatatatcccagatcataagtgcttagaaaaataccttgaactaccaacaagagttcagataaaaatagcacccccaaatgcctgctttaaccaaacaaaagcaatgttgcaagacagaaaacgttaaaataactgacctgctctagccaaacatcatgaaaaattacattcatgaggccaacaagcatatgaaaaatattcaacatcactaatcgttagagaagtgcaaatcaaaaccacaatgagataccatttcacaccagtcagaatagctattggaaagtccaaagataacagactctgccgaagttgtggagaaaagtgaatgcttatgcactgctagtgggaatgtaaactagttcagccattgtggaaagcattctggagatttctcaaagaacttaaaacagaattaccatttaacccagaaatcccatcactgatatacccaaatgaaatataaattattttaccataaagactcatgcacacatatgttcatcgcagcactattcacaatagtaaaggcaaggaatcaacctagatgcccatcaatggtagactagataaagaaaatgtggtacacatacaccatggaatactatgcagccataaaaaaagaatgagatcacatcctttgaaacaacatggatggaactgaaggccgttatcctaagcaaactaatacaggaacagaaaaccaaataccatctgttattgcttgtaagtggaatctaaacagtgagtacctatagacacaaagaagggaacaacagacaccaggagcctatttgagggtgaagggaaggaagagggtaacaatcaaaaacctactcatggggtagtatgcttattacctgggtgaaaaaataatctgtataccaaacctccacagcatgcaattcatttctataacagacctgcccacgtagccctgaacctaaaataaacatttaaacaaatacagacccgctcccaccctcatcttcaaatgttgagtgggaaactagacttctacccatgcccattggaaatgatgcactcctcccgttcttagccagagaggtgtcagcagaggcccagtgaaaagcccaatatcccactttcactgctagtaggaatgtaaactagtttggccattgtggaaagcattctggaggtttctcaaataacttaaaacagaagtgacgaggtatgtcaaaagatgccatttggggaatctggaccttgacccctacctggagctactgactcaggactcacttcccccaccagcagtgtcagaggatgccagctaaaaagatgattttttaaaatatccagaatctcataatactatatctaaaatgtccaggatagaaaacttatgttttccaagtaaatatcaccacgaaggcaattaataaatgacaataccaaaatgtgacagattttgtaatgatctgaaaagaattttcaagctgtcattataaaaatccttcaacgagcaattataaaggtgtttgaaaaaataaaaaattagaaagtctcagcaaagaaatataagatattaagaagaatgaaatgcaattttagaaataaaaacataagtaaaatgtatttttctattttcaagttcacaggagaatggaaaaggcagaggaaagaattggtgaacttgaaaatacaaaaataaaatttgttaaaatgaataatagaaaataaactgaaaaaaaaatcatgaactgaacttcagggacctgtgggactataacaacagtttataagatgtaactttgtgtcatcagagtcccagaggaaaggagaaacttgagggggaagtttaaaaagtatttaaagaaataatggcagaaaatgtaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaattgacaagaagaaaacaaacaaccccatcaaaaagtgggcaaaggatatgaacagacacatctcaaaagaagacatttatgcagccaaaagacacgtgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatagacccaaaggactataaatcatgctgctataaagacacatgcacacgtatgtttattgcggcactattcacgatagcaaagacttggaaccaacccaaatgtccaacaatgatagactggattaagaaaatgtggcacatatacaccatggaatactatgcagccacaaaaaatgatgagttcatgtcatttgtagggacatggatgaagctggaaatcatcattctcagtaaactatcacaaggacaaaaaaccaaacaccgcatgttctcactcataggtgggaattgaacaacgagaacacatggacacaggaaggggaacatcacattctggggactgttgtggggtggcgggagcggggagggatagcattaggagatatacctaatgctaaatgacgagttaatgggtgcagcacaccagcgtggcacatgtatacatatgtaactaacctgcacattgtgcacatgtacccaaaaacttaaagtataataataaaaaaaaaacaaaatttctaaatctggcaaaagatattaacaactacagattcatgaatctgagtgtaccctaagtggataattctaaataaatccaaacacacatctattcaaactgaagtcagtgagtcagtctgtctgtctgtctgtctgtctatctatctatctatctatctatctatctatctatctagaaaggaatgaatacaaacatgttaactatatgagtaaaacaatttaattgacagcatatttctcatcagaagttcgggggcaagagtgaagtggcacaaaattttcaagggttgaaacattttctttaccccaaattctatggtcagcaatcctatctttcagaaatgaagacatttgtaggtgaagaaaaacactgagaatttgttataagcagatctactctaaaaaaatttttgaggaagtttggtaaacagaaagaaatgataaaagaatgaaccttggaaccccaagaagaaagacagtacaatatgcagagcaaacatgtgtaactccagtacactatcattaactacagtcctcatgttgtacatgattagatctttcaacttgttcattgtacatatttgctactaccatctaagatgatgggtaagttaatttgttcactatagtaattattttatagtatatacgtattttataatgtatcgtacccctcaaatatacacaagaacagttttcaaaacaatctaatatattttatttctctttagtttgaagcaaaagcttaaaattatctaatgggaatcccagtgtacaaaaaggaaatggttaagacaattacattataatcaggggaaatcaagagacttaaaaagaagttacagtttcaacacttcactcaaactggtaaaatacatcagtagatctttgttgtgatgaagtagttctgtacttgactcaggtggtggttacaggaaacatgataaatggaatagaaatacaaaacacacacacacacacacacacacacacacacacacacacagagttccaatactaatttcttgatttcataatagtactatagcagatgtaactactgggaaaagctggttaagggccacatagaatcactctgtaatatctttgcaacttcctgttactctatagttattccaaatttaaaaaaaaaaaactaataaaggacattagttatagggagctcagacatagctgaaggtcctacaaagtggaggccaaggagacatactgaatatttcagaatgttgccaagctttatggtatttttcctgacttctcatctaaaactatggaggctagaagatagtggagtattttaagtgtcaaaacactttaaaaatgaagcatattgattctgagttctgaaactgcccaaaatatcttttatgaatgaagcaaattaagacattttcagataaaagaaactagcagaatcaatgtaactacttttgaaatatatgtgacaccttcttccaacatttaacatacacctgtccagaaattccatttctacatatttatccaggaggggaaaaatgtatgtttatgaaaaagactcatatataaatgctcatgataaacttgctaataacagaccaaaacagtactagtgtccacacacccgagaatgaatcatatgctgatatactcatgcaatggaatactatgtgggagtaaaactttatgacttattaggacataaaacaacatggatattccttaaaagcattatacagactgaaagatttttttttttgtaccacaggatatagtatattactgaatttatgtaaaattctataccaaacaaatctaatttgtggtggaaaagagcttcaaaacagtggtcatcaatgggatataaagggcattaaaatgtaaagaggccagaaaaaacctcctgtgatatctgtaagtatatagatttattataaccaataatattcaagttgaaaaaataaaattattcgatttagataacaaaaatattattttgggaaattaaaacacactgttgggatttgtatataaaacatttagcacaatggaattaaaacaagataaaatgatgaaaatgacaaattgagatgtaatttaaggattctatcattttctcaatttacggttttgttatcctccaagacatagcttctcttcacattgtctcacttgtcatctccattagatatatttcctctgtgctgcaactgcatcctatggattcatctaccacagtatttcctttttgcatatgtctctgttactcctctagaccagagaacgtggctcatttatctttattcttattgctatcatctggcacagaatctgcctacagcaagtagtcattaaaggatcagcaaagcaattcacaactaccaacaattaagtagaaaattcttttcttccttttttttcctattattgtacaacagtgagttcctcagtattgggttaaatgaagttcacaaatgaaaatgtccatattgcccagttaatacaaattattgaaatgggttgacacaaataacttctgaataagtaggaagttgtgtcttatctaaggaaaatcacactcctctcaatgcctgctaaacttttgtcatggaggaatataacctgagcacttcagagcttcagattttcaagagaagagacatatttcagcttttttataatatcagctcaaacttcacatcttggctaaatatctgtgtcacatatattacaattctattctagattctgatctgagatacaccactttgtgatctatgctacgtaatttcttagtctcaagtaaagagtacggaaaaagaaactatgttagaaggtattcttattgtgaattcagtaagctcacctgagcaatatttctttagactttttattcaacttagaaacttgaaggatatggttatattacctttgaatggaaaaatttaaagagagaaaacgaatttggttaaaccagtgatcagttgtaaatatctaacatctgggttcttgatccaaataatttcacagcattcgcaggaaatatttgtgcttaaaaacttaatacaaattgcaaagcaaacttttacaaaaaactcttacttttttctctgtctccatgatcataattcattgatttaaaattgaacagtatatgttccatattagaataaatttttttaaaaagggattaattcactgtgtctactcataatcacagaagaacagagttattttacccattagtttacttactttttttttttttgagatggagtctctgtcacccaggctggatggagtgcagtggtgccattttagctcactgcaacctccgcctcccaggttcaagcgattctcctgcctcagcctcccaagtaaagtagttgggattataggcatgccccatctcatttggcttgttttttgtatttttagtagagacggggtttcaccatgttggccaggctagtctcaaactcctgacctcatgtgatccacccatcttggcctcccaaagtgctgagattacaggcatgagccacagagcccatttactcaccttttgaaacacacacacaccattcttcaccttaataactacctccttttattttttattacacagaaaacaaaaataatatcccattggaaaattgttcacagattttattcacttaatatctagtccactactactaatttatttgatattaatatttaaaaaacacaaaatcgaagaatattatgaattttttcaacatatattgttactattttttctttatgccactgttttatgataataattatatataggtattttccctcacattttatgtaaagttactagtggagttatacattaaaactttacagatagttaagtttattgaagccctgtatctttaggtatttgtgtctaaaagacatatagatggttacaatgaaagatgcattattgtattttagtccaggtctgtcagactatgtaagaggaaaaaaaaaaaggatgtggaggaaagaaatgcctaattaatataagtgacaattcagggattggatgatgcttaaagagagatttcataatcaatacataatggcaatgtcatcaaacagctagaaattaaaatctgacaaatttgacaactcccaggaatctttgcaccactggtatttattcagtaatacacagtttgatcctaagatattcatcattgcttcctcgttcttgccaaaattttcaaatttatataataggagtttttctctgcaggaaaaaagacctctgattttataatgcatttcagaagaatattagtgatttataatcaacagaattggaatatatccattccatataggaatatattactgaactctaatatgactaggtttaaaaaacgtttttacattttggatactctattccattaagtataatttaatttatatttactctttatatatgtttatatcctagaattatactttaaattcaacttttctatgaattcagaatttatttcaggtatcaataggaggaaagttttgactacttttttggtcagtttccttatttttaagagtatatttaaagtaaatatagcactattttgttgagttaagcatataacataaagtaacacttgaaaaaaatactttctgatatttatttaaaagataatgatctctaagcaacgtttagcttatttgtaagaaaacatttttcccccaaggccaaagttcaaaatcacctcattaggaaagaaaataactgacataaacaatcgcaaaaacaaaaataataatgatccattgaatactaattctcttacacttagaaagaattcctaatagttcttagggcatttcaaaaggaaaaatgagaaagaagtgagaacaggatgtgaataaatcatggaaatattctcatcatggtttcctgttcttcctcaaaattaaaagaaatcaatattaatttttctatgcaccagggatgatggtaaattctttaaacacattttcttcaagtaatccttgctttcttcaagtgatggttgctacgtaattacaattgaaatctctttaattattatcctagtgttttctttttgcatgtatttggttattttgttagaaaactattggtttcttttacaaaaacaaatttgcttcaggcagacctgtcaaattttacattttcttccttttttcttattcagacaatcaagagatttgtctcaagggtaagtctaaaggaaacaggttctgaaaatacttattctttttaccatttgaagagttccatttatcagtttaatttttattaattccctaatatgaatgattcaaaaacgttgtcaaagtaagtatatgggtgtcttttttctgtgatctacaatggtgacatcatttaatgctacattatttcatgtgactcattgtcattgtgtcctgtaagctttggaatagtgcattctactttttgttgctttgtatatatttgtactttttgtatggatttcttctttgctctaaaaattacctaacagtatgttttttggtttttaaactgcatttatatttttggtaaaaattgattattaatttctacttttattagatatgactaaagatggtgacatgagcatatctaattattttaatctataaataatttactctgtagccaagcacatgacaaatatttgtaaatactctccaaacaccaaatatatgttctccatttgagggatacatgattaaatatgcacacacatgtcatctctgtataaatattaacataaataaaataaataatggaacatattttttatatttatcatttcaccagaatatttagtttataagagggatattagaattttcgatgaaaatgttgcttatcaagttagctttgcattgctaaaacttcagtatttcttccaggcagttatttgcaagatacaagttcactattattatatatttcccttacatttttcttatgattacataatgtctcatgtcatatatttaggccctttaattctaaatctaatcatatcttgatattaatgttgtcactccttcttggcccattattttaaacttttcttatactttaataaatttgtcccttctaaatagaacatagataggttttgcttctaaacaaaatacatgattacctgttatattagtctgttctcatgctgctctgaagaaatacccaagactgggtaatttataaagaaaaatagtttaattgacccacagttccgcatgactggggatgcctcaggaatcttacaagcatggtggaaggggaaacaaaaacggccttccttacaaggtggcaggacagagaagtgttagaaggggaaatggtatatgcttggaaaactatcagatctcctgagaactcactcactatcatgaggacatcatggggaaaactacccctatgagccaatcacttcccaccaggttcctcccatgacacatggggattacgggaaccacaattcaagatgagattcgggtgagcgcataggcaaaccatgtcattccacccccagcccatcccaaatctcatgttctcacatttcaaaacaaaaacatgcattctcaacagtcctcaaaggcttaactgattccagcatgaactctaaagtccaagtccaaagtctcatctgagacaaggcaagacccttctgcctatgagcctgtaaaatcaaatgcaagttagttaattccttggtacaatgggggtacaggcattgtgtaaacacacctattccaaatgggagaaactagccaaaacaaaggggctacaggccccatgcaattctgaaatccaatagaacagacattaaaccttaaagttccaaaatgatctcctttgactccatgtctcacatccagggcatactgatgcaagagataggttcccatggccttgggcagctctacttctgtggcttttcagggtaccgtgcccctcctggctgctttcatgagttggcatttagtgtctgcagtttttctgggtacatggtgtaagcctttagtgtatctactgttctgggggctggaggacagcggacctcttctgacagctccagtaggcagtgctctagtatgcactctgggtggggactctgaacccacatttcccttctgcactgttctagcagaggttctccatgaggtctccacccctgcagcaaacttcagcctggacatccaggcatttccatacaccctctgaaacctaggcagagtttcccaaacctcgcttgacttctgtgtacccacagactcaaagccacatggaagccaccaaagcttggggctttcaccctctgaagtaatggcccaagctgtaccttggccccttttagccatggttggagatgaagctgctgggatgcaaggaaccatgtcctgaggctgcacggagtggggagccctgggcccagcccaggaaacatttttcccacttaggcctccaggcatgtaatgggaagggctgctgtaaaggtctcttacgtgccctggagacattttccccattatcctggtgattaacattctgttctgttttacatatgcaaatttctgtagtaggcttgaatttctcctcagaaaatgggtttttcttttcaattgcatcatcaggctgcaaattttctaaatttttatgctctgcttcctcttgagcactttgccacttagaaatttcttccaccagatatcctaaatcatgtcttcccaagttcaaagttccacagatctctagggcaggggcaaaatgtcaccaaaatgatttgctaaggcatagcaagagttacctttgctccagctcctaagaactcatctccatctgagaccacctcagactggacttcattgtccaaatcactattagcattttggtcaaaaccattcaacatgtctctaggaagttccaaacttttccacaagtttctgtcttcttctgagccctccaaactgttccaaactctacctgttacaaagctgcttcctaagaactcaactccatctgagaccacctctggctggacttcattgtccaaatcactactagcattttggtcaaaaccattcaacatgtctctaggaagttccaaacttttccacatgtttctgtcttcttctgagccctccaaactattccaaactctacctgttacaaagctgcttccacatttttgggtatttctatagcattgccccattacctcagtacctatttattgcactagtttgttctcacactgctatgaagaaatacctgaaagactgggtaatttataaagaaaagaggtttaattgactcacagttacacatggctggggaggctcaggaaacttacaatcatggaagaagcaaaagcaaaatgtccttcttcccaaagcagcaggagagagaagtgccagcaggggaaatgccagatgtttacaaaaccatcagatctcaggagaactcactatcatgagaacagcatgggggaaccgccaccatgatccaatcacttcacactgggtccttcccatgacacatggggattatgggaactacaattcaagataagatttgggtgggagcacagccaagccatatcacctgtcattatggggggaaatagtgtgaacacttttatctggtattatttctttttatattattttatatttactctttgttttactttttttccccttttttctttttcttatttcaggaagatttatcaaggtgtagattttctggttaatttaggagttttaatactcttttcaattttatataaaagcacatatttctgatcctttatatgaagatgacttattttctaccaagatatctatgcccaattacatccacactaataagatggatattttaaaataaatcactcccctacatgtaggttatgtggttttgttatattaaccccagaataccagtatatttattttctattatgtctttccttattcaagatttcttttccttcacttacattactcattttcaaatagtctgtcattacaggagaatctatttctcatcatgtttcctttgttcttcatctgccatatattgatttgtagactttttcttattttttatcatttttaatatcactctctagagcattttgttctaataggttagtaactaataggttactagtggattatttttcctcatattctttacataaattttaaaaaattttgatttttatctcccaaatttattgtttaataatgtttaatacttattgattattaccaattctatctatttgctcccttgggtattttggtgttcctctttgtttagctaaatgctaaattaatttattttcactttttcttatttaataaatcatatgatcagggctctgaactttttcctaagtgaaactttggcagtattcacatctaatcttcaaaatgtttcttgagtttacaatatttgatagaatctgttgctgattcattatggaaaaacatagaatattatgtattttttagtatgacatttttgacaatgattacataaaataagtttatgacctatttactcaatttgatactaaaaaaaatatggaaaacatttgtagaacatcaaaatcacatgcagacattctgaaaaatgctccaagcatcagaaaaagtaatgactgtgtaattgtatcgaaaactctgaggcagagattaacatgcaggaggttattagagagggcttttagggtcttcatctgtagaagatagggaaggagagataattgggcagagggacaatttcagttctggtataatccgaagaaagtttttaactcaacctgtaggaagctttgaagctagaatggctatttaagattgtcaagatttggggaactaagtgactcattggattcaggctgcctcagaaaataaatgtgatactgctctgactaggtgattcttgaagaaaattgcatgcagaaagctgtctaacagcattccttctagtaactagaagaataagtataagccctcagtccatcacaaatagtaatagtttgattagatagtaatgttctatagcatgtttcattctaacgtgctattttgttttaaatatacaaacacatatatatgcatttaattgtactttgtttacattttcagagattagctatgtattttcagtcaacatataatacattatatttttcttatttaaaatatttggacatagtctcttaataattagattataggaagtctaatttttcaggaaaatatttccagtgttaaatttgttatttaacttatattactggttcagatatttagaattttcctcccactattttattgatattctataattttgttttgatttaatttttaacctaaatgacatttgtaaaatatgtttttattaaagagatcaatgttagtgaaaattacttaataattaaattatataagatacttgtattactaatagcaaattacttgcaaaaggccacgaaccagcataatatttcctaatgttgttcttcatagttgcacccattgcctcatgtcaccatcattgtcatagatctctccaaggtctaggacaaagaaaatgattgtgttgctaagaaataaaattgggtttgcattctgttagataattatgctggcctatgttcttctaggcaggaactgtttcatttctctccatactttacacacctagtgttatgagaggaattttgtccaccaccctaaagatcccagtgttgaagctctaacccctagtacctcaaaatgtgactttatttggaaataggactttaaagaggtgattacattaaagtgagaccacaacagttggccctaatccaattggtctttataagaagaggaactttctacaaatacagaccagggcacatgcacagaagggcaatcaggtaaagagccagaaagagggtgaccatctgcaatccaagcagagacttaagaaaaaaataaacctgccatctttgatctcagactgccagcctccagaactgtgaaaaataaatctttgctatttaagccattagtttgtggtattttgttatagcaaccctagcaaactaaggcagctagtatagtaaagagcatacttaggtcattttgagtactttacttccactttaatagttcagccatgaaataaaatatataaatatatgaatcatagataaaacaatgtaaaataaaaaatgataattttaatattattcattaaaatataaataaatattttcatggctttagattttatgtaacatacaccctgatgctgctctagcaattaattaacaatatgacttcatattgttaattaatttcatgccaataatacacaagagcacagacggcgacacttgtattagaccaaaaaaaaaaaaaagtcaaaaactgcaacttgcctcccgtgttcatgtccttgtgtaatctctaccttgaatattgacaggacctgttactggcttttaactaatgagaatatgctacataagattgtaacatccatctcgcgagattaagctcttctctgctggcattgaaaatgcaagctaccatattataagccaccatatgggaaggccatgcagcaggagctgagggtggccatgttcagttgacagcattcaggagctttcacctcaaaggatctcacagttccagtcaatatttttatgcaaggaagagcctaagcaaaggactcaattgatctgtaccggacttcttacccacagaaattcagagatcataaatgtgtgtgtgtgtgtgtgtgtgtgtgtgtgtgtgtgtgtgtgtgtgtgtgttaaccactaaatgcgtggtaatatttttgtgcagcaatagataaatattatgcctatcttcaaacattatatgacatgttttgctaaatattttagctgggtacttatttttcaccatatctacacgaaggctaattttcttctctattctagagaaaattttcttataaacgttatgctcagtgctgccatgttctttatcaatagtatcattatgatttctaatcagccttctgtattctcttgttaactgcatactgacaagtgacaagggtgatcatcagtgatattttggtataaaatctaataaacagattgaaaagcatctctctggatttctttaagcagaatatagtcatgtaaaaattctttagactgttaatgtaatcacatctttaggcatgatttgttgcactctctggctttaaaatatcattgttaagtagataagactattatggccttctcttcacaagtgacatttatattattaatagatacattattatcatctgatatcattcaaagtgcctccatttattttgcaattagctaataattgtctaacgatagttctattaatactaactacatgttatgccactcagctggtgtccatcatagattgcctttggattcacctattcatttgtaggtcttaaatccttcacaatattttaagctctcggaaaagagggctcaagtcttttgaacctcacagtgccaactcctaccacatataagtagatattttacttacatgatcatgtgattcgataattcattaccttcaagaatcttgaagcatttaaggaaatagaaaattcacgtaggtacaggtgaaaggaagaataaactgccttaaaatggacaaaagtagaaaaaatttcaaaagaaaggagcaaagaaaaggtggaaggaagaaaagaaaggagtgagaaatgaaaaaaggatgatatactgaaaaatagaaaatgtaagacaatgtattttaatagttttatacaatgaaatgcttggtgtattaaaattaatgctaaagtagattaactgtgaagaaactgctttactggataattactatgacagatccgatataaagtaattttataattatatgtttaataattttaaagatcacactctgttatttgataattattaatatatctcttctaaactgtaatggttatatgagcaaagaggaagtgagaagagcaggagaacttttaatacttaggataatctttgagtagtcccttcactaagtacatttaattacctccattaagcatacctactgcttgattactagagcagattattttttccaactgaaatattaaaaaaatggacatgagtctcagattttcagtcaggatatgtaattatactgataggaagggtaaaggtgatttattttcatatttaaattagacaagccactcaaccaaaattaatagttaataaggaattcaaccaggtcacattatcaaaaagtacaatattagttttttatattatttaaaaacaggaaaaattaaaatgccataagttaattgacaaatgggtttagaaaggaaaataagctcatataatacatcttgaaatgtggacaatggaacacaggcatgctacatttcccaagtatttaagttattacacataagcaaatgcactcaggaattttacatcattttgaatcttcagaattacagaagggtagcatgcctttgtagagaagggtggtttttatttcaggtaacattctatcagcattaccactgacaggttagtattgcctgcactttatctagattaagccttaacataactctttcatcaaagctactacactgacatgtaggtgactgattctaatggaattagatgaaaagaagacaaagaaagggctgtcgtgcccacaccaagagctttgccacccaacatgtaccattatttcctttaaagctttcaaatttgactttgaacaggtttcaccaaatacaacactgaagcaattgctattactgatcatgccagagggattagtagaattttctcctgaattatttctttccaaagggggagtttgtagattaaatgagtcttggaaacgtttgctgaaatgtatagattcattttatgactagctttctagtcactgtcttgtgggttattaaccctataaaatgaatattttgattaactgtcctcatttttaaaacatttgacatgaattgttcttggaaattttagtgacagcactcaatatgatttcctcagttatttattcaacagaaagttgtctattatgtaaaaagcattgcagtgtagataaaaattaagcaagtcaaagcattgactaagtaattacattgtgtttggagacatgttagcagtttgactctgctaaagctttggctgaatatgtccaaaggcaggaaatgccactagaaagtttccagattataaagatccttgcataacatgccaaggcatttaataaacagtgagaatacctttatatatttttaacagaagagtaacaaggaagatctgtatttcagaaaatcagccaagcttcagtctgtagattttaattgctttaacttttaacttcttttcaaagagaattaacacaagctaagttggtgacagcagcaatggtgaagggaggaaggagagataatagaaatagtcaagaaatataattaatgagacctagtgcctaattagatttgattgcataagaggaggagaaagtaaaaatagtaataagactgcttcagagactcccttggaattatagtgtattccagcaacaattaaatcctaaaaagacccagagtacttttcattcaattcctatgctgtccaatttctgggactgacagctgtcaaaattttggctcctttaaccatatcccgtattcttgtagtcttagatctttggcccagatatatgactataaattatatatcctctcatattgttcctgttcccatattttctggacttcctctttccaagtccaacttccttcagttccctttcctcctaaaatttcccactgtgctctctcagaactatattcctcagttaacaaatttgaccatataatcattgctgaatatttcaattaaattttggctgttcctgagaacaaattatcttactgctaccctctcaatttaagggaaatttcctccacattcctcagtcattaggactgtgacatgaggatggcattccacatactctactcataattatccagaccatttccctctgatattatccaaaatacccttgctctttggtacttaaacttagtcacacacacctttttattcctttctacatcatctaccaacatcttcatcagtctttccctggcctcccattctttgcttctgcttctcagtttctcatcaaagataatggaaaaatctacttggattatccctctgacaaattggcatcccagtcccttaacttaaactctagtgacattttcatctattctattttagccactcaattctaaaacaaaaaataatgaccttattcttctctagaactgctcaacctctacaaactcctacatctgttatttgactcagttctcaattttcttagcaagttactcttttaagtgttttgacttcattgactccttaaaatatctccattagagtgtcgatttcttagtttttctttaatagcacctattctattgaaatattttctattatgggtttaaatgatcttgggaaatgttaactcaactaataggcctctgtgattacgtaatctacaccactattaaaataattataacaacttggatcatacaatgtcttgatgtaaacgatacattaggtcatgttatggaaatgtttactagccattgaatattttaatcttatttagaatctctaatcaaatctatagagtttaattatttcccagatttttctatttctatacttacctaccactgacattattcttatctctgaattttaacctaagttatttgacaaggtagttaattattgcctactcagtcatagaaatcaaaattcaaacataaaaagatatttgttgtaagttttactgttcttgagatcagagaagctattacaattaatagcataaaaattactagaaaagtagaatttttagataaaagaaaaatttagttctctaaactagtctgggttagaaaaatgcatgaaaattatatagtcatgtaatttcttaaaatattatatctattttgagcaaaatatctgaaagttttctttaagaattcctttttgtttctattataaattatttaggaaaaggttatatttttatgacaggttttttccccccatattataactttaacatgttttctttgatataaaaatataaatcaagtaccattatatttatatgtcattaaggtactgttcttgagcctatatcatgtatagcgtattgtgcattattttttctggcaaccataatctagaaatgggctatagaatgaaattcattaatgctatgttatactagaaggcacagaacataaagtaaataaatcttttgtaatatcataccaaccttataaattgctttaagggaataacaatctataggggtggtagatgattttctaatcagatattacacaatatacatcaaatattctcattctgtagtatttaaaataagcagttgtctacaacatacaatcaccagtcacaataaactattcatgcttttgtagacccccaatttgataactgcataaaacaaccaaatattttagaagaagaaatattataaggaatgtatatccaagcttctgtggttcgaccaggagctattgcctgaactacacctccttagttggactgaacaattatggaatgtgtcaaaataggcctaataatttatctcaaaaattaattaataatcaatgataaagctaaagagttttaaaattaatgcccagtaacattcttttacaatgtgaaacaaatgtaattcttatgtcatagtcatattcttagatgccatgtcttggctcactagtgttttaggccctttgcaaagaaatatgtttgtgttgataacagaaagtcaacatttgtagataatttcctttttaaaattagttgactaaacttgtcttagtttagttcaaatatgctttatttggtggcagagaaaaaggacagggtttaaaaacaaggaaattattcataacctgggtatctctaaatgaaagtattgtaatttcaaagacatatgtttcaaaattttattccagttaaaataaaactgtattatggtaagtcctatttaaaattgtaattttatttcagcacaaaagatatacacccatagataatgcaacactttctgcctttatgaatttgcactgcggaatcatttctaatagaaacaattccaaactattccaaaaatgcaagttctatgaagcattctgagtcccaaccaagcatgcaaccaacaaacttttagcattgcactgagagggtttttttaaatattgctatttttttgtttgtatttttaatagtgagaacatgccacaatattcctggaaaaattctgagcttcccttcttatcttgctcttttgggatctgtcttttatgttggaaatctgtctaaaacaacacataatttttgcccctctattcaagtttaagtataacagattaagaagccaattggaagaactctacatctgggcacaatgcattaattattgagatccattatagatagcttgtatagccaatattcttattacatgtgaacttctactggccaactctgtagaccccttctggttctatcatccagtgacctggcagtgggcattctaaacgttaatgtagaaagagtgctctaggtatgtcatactacctaatacttccgttttatctcctttgtgtttgcatttaataggccaatgacattttggcttaatttttgtatctattgtcttttatatgggtcagggagggacatcttttagactgtacaaagtcaggaggcccacagaatttaaatgtttttttgagcacacgttcaaaatagctcttcgttttcagttaccagtaacctctatcaattaccaagcttttcctgagttttcccagataagtcaaattacttcccattaatatctacttccgtaggttcttaattctgacctctctcagcactgctaagtcacttaacaactctccatctactctatactcactcatattaagttttggtattgtagatatcctggttttgtcaaagacagaattgtgtttcttttccttactttgtagctttgaaagaaaaaatggtgtaaatgtcattactccactatcatgaaatttgaaacaattagaaataacagttggagagagagaagagagggatgtaagtgtcattactgcataattttgaaatgaacaattagaaatgagagtaacgaagagtcaaagttttaacttcaaggtgattgatgggacatgggaaatgagttacaatgggacgtctagaatatttcccaccactgttaatatttctgccacaatttgattttttgtgccaaaatttttctcatatttgttgctctatatgtttttaaaaatcagtacagcgttttttttgtttgttttcttttgttttttaacctcagcatttatgaaagctaactatggtctactggatgtaaaatttggagagctgggtttgagttccaaggttgttattctctggtcatgtaactttcagtttttaacttttcctttctttatctcagttccagattactggtataggaaatgtattagagagacatttttaaatgtcctctctaaaatagtgactgttttgaatactttgcatattgtttttaattcttcatgaaacctttaatgtaactgctatattctattggttttgaccaaattatctgagacataacttacccaaggccataaagctatacaattatagatgaatatactgataaccttcaaattttcaaagttgggggcacttatcttttgtttgactacttggcattgttggcaaccaccccattgaattttatggccctaattcttggccatttcttctccacactttttgtagatgtctctgatgtttatccttatatttcaatattttccaagctctttactcagcctttcgttcatcccacgttaaagatggcatttgaataaattttttattttcccttaaaaattatatttccttaaaaattctagccaagaattctctgatatgcacaagatttgtatatgtaaattccatatacctgtggatatcacgagaaattcaaaccaaatgtctctataattatatttattatattttcccccaaaactacctatcctgttcctggttcccaatttactatttactgacatctgaggcctcaatttttggtctcattcatctatttatattcttatatctccctaccttctatctcttctcatctacactctttttctacatctacactgatttttctaagccacaaagttttcatggtataacctacttaaaatctatgtcttgacacaaattttggtgtatattttatactctttagattatcatgtaagtcttttcattttatcttcagtaagcaataaggagttggctactgcttaactttctggtcacttcctatgattcccccagtatacttgttaatctgtctaaagatattgttttactgtctaaatgtttcctgatccatttttctgccagcatgtaagtttctttctatgtgatattgctattattcatcttttaaaattcagctcaaatgtcatccatttcaggaagatttcccttaaatctcctctctactttccatggctcttttttgatattcccataggataatgtacaagcctctctcagagcatgagcctgaatttattgcaaaattatgcatttttgccttgcccatttcctccaattttatttatagaatcttcaatgctatgtttatagattcacttatagtctcagaataattcttatcatataataaacatacagtaagaaaatttcaaagaaagaaaaacaaaaggaaagataaagcatttgattcattgtctttctattaccaaattctaaattgtttccccttcacaatgctgccttacttatctcaaagagatgttctgacactgacaaaatttatgtgaaagcattttacaaatacagaactatattcatttacaaacaactaataagaatatgtattgtgaagcaatatgtagtaacagaaaaacttgaaatacttggaagtaaaagaatagagatcaaatctcagtatcctttatttatgcctgagtatacttgccaacaaaattaggtcaaacattctaaaatccagatggtttctgtataaattgaaatatttttagtttccccgcctcctcacatggtccataacctcaagtaatctatgtgaaaatttggttaaatagcaaagcattctacaaatataaggtcttacttatggttaactattaaacatctgaaacaggcaaaccattgcaaggaatacacagttacagaaaaaagtagtgtgttttaatggaaagagcatggactttggagtctggcaaactaaattctacttcagccagttaccaagtgtatttgactacaacacttggtctttaatctcagtttctccatgtataaatggagataacaccagttctgtccatttctcaggattctatgagacaagtgacataatccatgggtcagcttttgaaagcaatgattctgaatgcagataaaataaaatattgttattttcttgagcttgaaatacaagaaataattagaatgcgtgagatagagaggaaaatcctcggtaacactacctgacaatgagcagttctaagtttttattttattttgggaaggtaattctcaattcacatcagtcatcagctttaggcctgtgactgtaagtctacattttgatattttaatattagacacatatagtacattacatacaacaaaaagaatataatgttataaatttccatttttcaattaactaattctgattaccactttatggctattttattttattttatttttttggctactttaaaactattacataaatatatttccatgtcctgatagtttttcttatattattaagaaaaacagtcctgataatcctgataatttttcttatattattctcattggtgtttaggtgctctgtgccctaaaactaaaaattaaaatgagacatttctttttgaggacaagccaggacttgaaaatgttttgttttgtgacaatctccatcatccttggcctatccagtgaaaatcacacgtgacttctcttgtcactgcaacaaggcctcctgttctgtttgtgtgtgtgtgtgtgtgtgtgtgtctgtgtgttcccaaccaaacacatatttttcatgctcttgtttttttccaaaatacattcatgttatcagaaatctaatcccttcagtactaaattgccaaaatttaggggtcaggagtctgtgtcactgcagaaataatttgtggttctaaagttctcatagccatgtcccaaatctgattttcaaaatctctttatgcacctcttgagttctccattattttagagctttttcaaatgtttatttactttttaggtaactttaactacttttattctctcctatgtattttaaaattcattttcataacagatacaaaactttagttttgaaaacacagttcgtaaggtttaagaaaatttccatccaacataacatgttgtaactataaaagagagttaaaatagagctgaattaccattttttcaaagattaaagactctagaatgaaattaaacactgcattaaaattgtccatatgtttcttacatgaaatatgttaaaatttaattttcttgttttacaattctaaaattggaaatgtctttgtcactcttaaagaaggacattctgggccagtgtactagatcaatggtgaggggacgagcgggtgggtaaagaagtgagtgtaaaaggcatgtctttattgacaaagaaggattgccaatatagttattctacttcaggtatgtagagcaaggataaagcatatgggccaaagctcatccgattcctgcttttatattatccatgaattaaaaattatttttacatttttttaactattgaagaaaaattgaaaagtagaataatatttctgacacatgaaagctatataaagttcaaatgacatggtccacaaattttcattgaaacccagccaggctcatttgtttatgcattgtccatgacagttttcacactataatggcaaatttgaatagttgtggtagataccagatggctccaaagcttaaggtatcaattagctggcactctgcacaagtttgcctggttcttatcagatgcatccctgagactaaaacaagtgttttctccatttccccatattattataatacagacagcagcccctcctgactctagcttaatcatacatgagcagataactgaggaaaaatgaatattacaatattaactgaaataattgtgagttgtttttaaaaaagattctcaggggaaaaagtatacatttatacatttgtaaactgcatatttgcaagactacaatcatttaaatatgttaactttgttttatggcttggagtatgatatatttcggcaaatgttcacatgcacttggaaatcatgcgtatgttatataaattaatttaggtcaagttatttaaatgtgttgttccggccttctgtatttttaatgattttcaggtctattgatctattgattgctaagagaagactgcttaattctacgattatacttttactgcatttgttatttttttcctttcagtttcattactgtacactttccttttcttactatatgctttccattttctctgcttctttttttatcacctctcttgacttctgatttatgaaatattgttttatcattacacatttatgtgaatgtagacagatctagatctatctatctttattatcttgaaacatatatactatttacactgttttagaaaatctgtattagatctctagggctgtcataacaaaacattacaaactgggtggctaagcaacagaaatcaattgcctcatagttccagagaccaaggtgccagcgatgttggttacttcggagtgctgtgaaaaagagtcggtttcacggttctcctagcttctggtgatttgctggcaatattcatcactcattgaattctcgatgtacaaccccagtctctgccttcatcttcataatgtgttctgtcttgtgtgcttgtatctgtgttccccttcttataaggacaccactcatttcaattaggggccaccataatgatctcattttaacttaattagtgctatgaagattgtgcttccaaataaggccaaattcttaggcaatggggtttaggaattgaacatataactttaggggtacacggttaaacctataacagtagctatcctagtatacacaaaacaaaatgcttggcaaataaattctaacattaattggtactttttttttctaacacagttcatgcaagtatgtcaaaataccataactccattaagctaactcttgacaaatgatgtttttgtaaatgtttatctatattttaaatctcacaggggttattttttatcccttagctttgcatatatttaagttttctttgttttttttttttaatttatttgcacatcttcaagctttcatctcaaattatctcctgtttgctcaaacaatatactttaaattttattttagagtgtgtctacttgtaataaattcagaaaatatatcatatggttatccttgaaagatatttttcttaaaacagaatcctatttttcagaaatcttctgtgacatattcaaaatattttatcatcttatgaattccatttcttcatatgaaaaattagttgcatttcttacttttattcattaacagttcactttttctctttttaccctttggcttcttgtgagattttatttccaagacctaccaaaagaaaatcctcagctacattatacttaatggtgaaagactgaagttctccccagaaagattaggaacagaccacaacattgtactgaatattttttccagggatattagggaaaaaaaagtaagacaacttatttggaaagggacattaaaactatctctatggcatatgacacaattttccatatagaaaattctaaggaatagacacacacacattcacacacaaacttagaaccaagagtgggtttagcaggttcacaggatgaataatcaatacatgaaaatcaataatatttctgtacacatgcaataaacaatccctaaatgaaatcaagtcccattagcaacatcttcaaaaataataaaggctaatatttataatggtaaaataaatataatcaaaagtaatataagagctatatactgtaaactacaaacttcactgaaaaaagttaaagaagatctaaacaaatggaatgatgtcccgtgttcatgaattggaaaattcattattaaggtggcaaaaattcccaaattattctatagtctcaaagtaagccctactgaaatccaagctgattttttttagacattaacaagctgatttgaaaatgtttgcagctatgacagagtcacaaaatcgtccaaataatcttgaaatagatgatcaaatttggaagacttgcactttgtatttttaaaacttaccacaagaaacactaataaagacaatctttactaacataaatgtagttataaaagatccatgatggaattgtgaatccagttatatttcctcacatttatggtcaagtaatttttaacaaggatgctaagatgattcaataagcatagaatatccttttggtattattttgtttatccacatacaaaatactaaagttggacccttatctcacattatacaaaacaaattactacaaatggaccaaatagttaaatataagagctaaacctataaaacttttagaagcaaatctatgaatacaccttcatgaccttggattaagcaatagttttttacatataacaaaatcataagtgacaaaaaatattaacatattttatgtttcaaaggacaccatcagaaaagtgtaaagacaacccatagaatggtagaaaatatttccaaattatatcttataaggaaccactaattcagtatatagaatgaactcataagataacaataaaaaggcaactgtctcaattaaaagtggacaaggaatttgaagatacagttcttccaaagaaatacataatataaacagtcaataagttcaaaaatatatgatcactatcattagctgttagagaaaatgcaaaacaaaaccataacgaaataccccttcacacccactaggatgacaacaattaaaaaaagatgtaacaactgttggtaaaatgtggagaaatggaaccttgcatataccattggtgggaaggtaaaatggtaatgcactttggaacacactttggcagtccttcacaatgtttaacatagaggtatcatacagcatagcaattttatcctaagaaaaatgacaacatatacccacacaaaaatatgtacatgtatgatgatagcccaaatgtatcaactgatgaatgaataaacaaatgtggtagatgcatacaagggaatatatccaacagttattttaaaagatgaatggattgtggatataggctacaacattaattaaccttgaaagtattatgttctggaattaaatagtggcaaggattgcacaactttgtgagttttctataaatgggtatattgtacacttttaaaaagtgaatttttatggtatgtgaattatgtctaaaaatacttttaaattaaagatcactttctctttggttttctgcaattttgctatgaaatgcccaggggactatataggtacatggatacacagatatatagatggattaaaagatagaaggataggaataaagatagataatttcaatcttgctcctgccttatagaacttctggaaactgacttgagagtacctgtttggggcaactattgattattatatctccgaatattgcttctgtgacattctttatcactgtgtcttttgggattccaagtgcctgtattttataccttcttcttttatgctctaacttgatctattttatatattttccaactgttcagttgcttgaggttcatttggtataattatcaattcccataccttcctttttagctgtgtttttttggtgttatgtttctatattttgtttgtgatttgtttattgctttgtttcgattttagaattttcacttgatatttttacagcttgtcaatcttaccatttcttcttgaacagagagaacagttattttaaagtctacctcaaatgcttgcagcccttggggactgctgtattctctatttttttctactagtttttgttcaaattgtcctttttccttaaatctatggttatttctcaatctgttagtgacatgacattttttaagttgctgatggaaagcatgtgaggcagggaatgaaattatcttttcttatataaaaagtaaatatttttacatttggcaggcctggaagttcagtagcagtccagtaccaccaaaatctaattgcaaaaaataagatggcttgaaatggtcctgtagttcatgagtcttagtcgatttagggctgccataacagaataccataagctggtggcttacaaataatagaaatttatttctatttcattctggaaattgagacttccaagatcaaggcaccagcagactcaaggtgtggtataggcctccttcctatctcttcactgtctcttccctgtaacatcaaatgacagaagaggcaagctatctctcttgggtctgttttgtaaggacactaatcctattcatgagggctacactctcatgacctaatattgccttaaaggctccacccaccctccaataccatcatcttgggggttaggatttcaacacagaaatgtagagggtacacaaacattcaggtcatagtaccatgtaaggatatatttatgttcaagtcattcttccttttaaattgtggccactttgaggttttcaacttctttcaagacgggattttactaggcaaactttttaaaattttgtaccagatagaaaatatcccctctcttcctcaattttttaaagctattgagtttttaatctcacaagcaactttttcaaaattggccaaagagatcatggctgatatctctggatatccatcttcttacattgctttggtgaaaattacaaccattttacctttaccatgttttaagacatatcaaaacaattgttcagcatttttaattgttctaagcaggaaaagtgatctatgagaaatcattccctattcctgaacatttactttatgtactaatgtacttgtattgttatgtgactgagtccaagaagaaaggtttttgggataattcatatatatgttttcaattattttccataatgaatctgttttcatgtagagaaaaatgtattctattatttttaactagttgattatctttcatgaaattagattggaaaaggccaagagctgagttggtgcactatattagtaccacagggaatacccaatgtccacataaatcacacctaagctgtacataattgtgcaagataacacaagcaaatatgataatttgtggcattgataaatagtttgcataaatatttaattgctatatctaaaatgtttaaaaataaaaatacaaatatatgtattacgttctatttttaaatgtttacattttaattagagatatcagaaaacacagtataacctctaatttccttggatattccattttccagataaagccaaaataaatcagccaatacaacacatgctttttcaattatggtactttttacaagagttaaaacaattatttaaatgtaaaaaattaaacataagactgtgtggaaacttttaaaggcaaaatttttttttgggtgagagcaagtctatatatactgacttctacctaactacagtatccaaacttatgctaaataaattattttacattctataatgatcctcaaattttgagtgcacttacactcttctttctaatatatgtaagtcttttaaggatgttttactaaattgttacactaaacagttggaacaacttcctttggtactatacacattgagaagagattcaatgaaacacactaagctctagcactgaaaacaaaaattttaatgtgtattgccttgaattgtatgcaataaaacagaagagaataagcacagattattgtagtgcaatcttctaaaaatgggaaacttactttcacctgcaagaactatttttgtgataaggtaatgatggtgctataaaataattatagggacactttcctgagtgagtcaatttagagaacagctaaataagtcaattaccaaagaaccccatggtgaagatgttggatttttacaggttttagaacacacatacacacatacaaatacagatgcacacacgcgcgcgtgcacgcacacacacacacacacagagagaggagagaaagaaagaacccattgaatgatagaaaagaacatccctgaaatgaaaggtacatggagttttttgtcatatagaaaaaagaggttgattttaaaatgaactgacatttttgaggcgaatatattatactataaaccattttcttgaccacaaaaagacgtactaaagtgggaatgaaaatgaaagcatggccaaatgatctagctctgttgacatcctatgagtctaagtggtgatctaaatttcaaagaatttattacaatttctggaaataggccagttttctgccaacttaaaaggtcagaaaataactactaaacttattggtacaaggtttccaaaatgtctaagccaaaaatggtttcaatagcataaatactaaaagtagcttatttcatcttatttaaatattattaaaatacttgaaacctgaggaagcacagttacattttaatacatcagccaaatactatggcattaagaattgaattactactaaggatcaaggaaatagaaatcaatgacatctaagatgaaaaattaacaacaaaaatcatcataaattttctcacttatttttaaagttatttagaaatctttgaatatccaataacaaaaatgagaaatttgtaagacacaataagattctccaaatgataacagttttcaccacatttttctcaataattttatattttaagtggcaactctctcccttgacttatgaaaccgtcaactactttctctcctccaggcaactccaacagacaatgaataatttactcataattctaattaaaaactgaatagaagctgcacagcctgtgtaagttataaggcagtgtactaattatctgttacttgaattttaaatagttataggcagctttaggaaagcatgtatagaattagcaatccaaaccaaaccagtttcctgaaaacactgttgagatattactgatttcctaattattgggtcttacatgccttctaattacccttacaatttatatcctttctttttccatgaaaatacataaactatagtcatctactatgaacaggtaacacattaaataatccccatgatatccatgcaagacaatgattcttgtattaattgctgatcttcttcagaggctaaacctttacttaacttttcaatgcttacatttcaacttttatgtcacaaagtccagtatgctattcatacttatgaagttaaacagaaacaaagaatttcaaatgtaagacccaaaatgccagatgcatatttgtgtatatgtggtaaaacccaacactgaagtatatttctttagttgtgcgaggtcgtttctggtgctaaaatggaactggtgatgacaacagttcacaccaagaaaaaacaatcaaaactctgccacccaccctaccaagcaaacactgctcacaggatcatttgacctcatttttatatgcattgttcattctacaggaaagataaagctggcaaattccaccagaggaaggtaaactattttttaaaatgtttcttgacactgtaattctatacatgactgaaagtatttttaaggactgagaagaaagttattcaatataatttttgttgtattttatttaattaaaaacagttgttttaacttacttttaattttaccaagtattatataccatgaatattatgagttaacagaattttattaatttagaaagtagccaatagtgccatgttaggaaaatatatgatcatggaaatttcccagaactccaaatgtttagtttaactttggcataaattttagaggaagaacaaatagtaaactgaatttaagcagggtctccctcttatagagaactgcaatactcattgaattattccttaatatcacaattaagttgataatttatttttatgaaagtttgtacttttgattaaaataatcataggataaatcagtctatgatttcatagaaggtaaactgagttacagaaaatctttgtctagccttagccttttaagtatattagtaccttggaaatcctacttgaaagtcagctgatatggaaaatatgcccatgcaaacatcatctaaatttctttctcaagtgaaattttgacaaaggggcatacatacaccaataagaatgctgacaaatagcatatgcaggttcccaaagcctatgatattggccattctgcttcctgaagagggaaagataaattcaaagaatatatttacctatttatgtttaatttattgaatatagatgctgttactgtttttcttaaatgtaaaacatgtaccaaatttatattaaaaattcattattttatatttctaatatggcaatcagctattcaagtagaaaacaggaaggaggatacagctgaacagttcataaggacataaaacagatttgtattttgttaacagtttccaattttggtccttgcaaacttgtttaggaaaaatgagagaacactttgataacatggtcttgagaggtctatattaatatcacgtcaaataatacttattgagagtatttttatgttgatcttagataagagaatagtatcttgagctctgtaattaaaacatagaagacatagtatgcttgacatgtattatcagaacatgaaggaacccagtgtggtcaagggatcaaatttgtgttgcactggtttggaaagcaatatgagccctaaagcctggaaatttaaaaaaaaaaaaacttagagccttatataagaaacatgaattttaattgaaattctctactttagaatgtacagctttatcaagaagataataaagaagagattaattagcttgtctggattctggcagcagattccatcatgttggcctaagagttgcaatggataaccttatcccatcttaaattacggtggtgctgtgatagccttacatttgttatgctataaaaaatattaaacttcagtggtttttcatgtctgtagttcttttggaacatgcttcccgaaaatgatgatggtttatagatcacgttctgtagaactgtaaaatatttagcaggagtgaatgagacagaacttcttgctacttcactgtaaatctactaacctctctaaaatatgaatcagaagaataaaatataaatcaaaatagaacgggggactcaccaagtattacaaaaaataatatgtattatcaaacaccaataaattttccctgacatctaatgttggtcttacatttattaaaaaatgtaacctttgaagtacaactttacatgaaaacctattttaaggaatcataaagagaaggcaatgatgggattatataacaatttttcatttccatatgagaatataaattattaagcttatcatttttctttttattttagtaacaaagacattactgaatgttgccaacagatttaacattggcaaatcatctgacatacagcttaatctcctatgatacaatatatgaatatatagatgtaattctgttgtatgaacaaaattgttatagcacattctggaattgattaccttgaaactaaagtaatagattagagttacttgaaatttagttgcatagtaaggctaaatcttaaataaatatgctacaattacattgacagaataaaagatttttactaaaatttcatacatagccttaagtgtatgcttgagtaatcacaacgtatatatagcttttttcttaaagataacataaggactctgacttcataaagattgaataaaatgagaaataggacacaccaacccacatgatacaaaataataaaagctacaagaaaaaaatgctataacagggacacagtttgggaaatttttaaagcaaacttcacccacaaacccaacagatggtaaatctacatctgtttacacagcttataatgaccactttcttatgtagaaaaaaggctgtgaaagagaacataattttatataaagcacactccacattacatttatatggctgtaaatatggcctagaactttccattgctcatcattgtccacaaatatttctcactcttttccattaaactaagcacaagatacatcagttgatagcactgatttctaaatacaaatttcaaaaatatttgtaatttctctgtccacctttgaaaaaggaaattgccattagactttaacattctacaaattccaaaactctttatgaccagaatagagtccccaacatttgcttaagccaatcactgatgatttatgataatttaaagtcaattgatatgtcaacagtagttggaaaaagtttgtgaataataccaagaacaaaatgtcttaaaagattttagaagataattcgatcttctaaagtttcatctgacaatgaattttaaaaccagaaaaaaatagctgacattcatgttagcaagcattttttattccacattctctatgcttgactgatccataaattgttgcaaatcatctaagtgaagcactaaatataaaaagatgagcactggaaattttcataagaaattacatttgtatgtattataatatgataatacatatcacatttaactcatattgcaactaaatattaacagaaattttggcagctgttaaaaagttcaaatattcactcatgtaaaaatatgacatctatttttttcttaaactaagattattttttgttcatggatacagatacaaataacctctctctaaagtcactccttatatagtatcattcatttcacaaaagccagcctgaacatgtcacacactgaaattcaaaaggttttaatgaaaaagtctcttttattttttgaaacagtaccattgggatatctgaaaagggtaatacagttagagagactgtgaaaatggttctatcacaaacaaaaatagtaggtcaagaaaaggaaaggatgttttaaggtaagataatatcattcattgaatttggatctactgagtttgaagcattgatagaatgttcaactggaaacagttttcagacatttggaatataatagtaaggcaagcacaggagatgtgcttaagctatagtaaaaacttttagatactataccagtcatagttaaagttacaaactatgcaggatatccaaggtaaataatgaagacagagaagcacaagaaaagattatttgagcaaagcatatcatttgagtggtatgagaaagaagagataaggaaaccttactggaataagtggtgctctcaaaaaaattaaaatgaagaaaaataaagaacaagaaaagagtgttgtttgtggtcataagtgaccagacaggaaattattcataaagcatttctcactggttttataaatgagtaacaaatatgaataaacaggtataagatcctgaagtgtaagtttatatatgaaggtgaagattttaacaagtggacttgagatcatggatcatgatgaaataatatcaataatggtgaatgacactgagtcaaaagttttgtgtgataaaatattctaatttaataaaatcaacaaacaactgactcaatgaatatacaagaaccataacctttgtagaacttactaatttacacacaaggcataggtatgcttagttagttgtgcttgttaccaaaatgccaatgagatgtttattttcccccaaatctttactgcattatcattaacaaataaaaattgcatatatttcatatatgctttgatgttttgatatatgtaatacattgtggaataattgccacaatcaagataattaacattcttcacctcacataattaagtgtgtgtttgtatgtgtgtgtgtgagagagagcacttatgatctattttcttaggacattttaaatccacaatacagaattgttaactatattctcattgctgtacattagattttcagaaattattcctcttacataactaaaactttttatcccttgaccaagatcttgccatttcctgatcctctcagcttctgggaactaaaattctactcttcatcagttgtccttgttatgcatagctaaatgtatacttaaaaccaacattgtaaagcaatgtagaagtcaggaaggagctctggtccctgtatgttgacttcccagacgaaaattagaaattgacacagaaatagcaagataatttagtgaatagtaaagattcacaacacaaaacttaggttataattttacttttatataatgacattttatttaaaaaaaactataacaatagtaaactatattgaaataataactttctatatacttttcacttaaatcaaaggccttacttgtctatatcaacttccattcttcatccacataaaatcctgggatttaagtttctccaccacttaaagtctatgtgaaaagtgaggaagtattttcaacaatccaaatttcagttccttgtctataaattagagatagtaatgtctatgcaaagattttaagaattaaatgattatataattttgcaattatttttttaaaatttgaaagcttacctaaatggtgggtaacatcatttgaaattatttgcattaagttgcagtaaaatacatgctaattataaataactagaacatgttaattttaagaaaattaaaatccttcataattgtgaaataatggaatttttaggtatatgtttttcatatgtcagttcatatcattatcatatacctttgtattctggtttttaacttagcactatgataatttaagtgttttccaaatcattacttattttaaaaagtgtcttaatgcctgtataaacataacattaatttgtgagtgtttcaattaactaagggaatttgtaatttttaacttagcattttgagtactttcagaattttttataaacaagactatattcaaaaatctttgctggcaactaatttgtctgccaagatttcattagaaaaaaatgtcaagaagtaatttagccaggttaaaaagcaatcacatttcaaagactttgatgtaaattatcaaattggccactagaaataatttgcgattattcatccatttgcaatttgaggaatagttcatggcatataccctccgaaataaaatgggcattatgttaatatctttctaatgtgttagaataaatattctattttattattatattaatttgccaattaagtgtttgtcatagcagttgagtcttttactatatttcaggattgtttgtagtttgtaaacacgtttagctatacgattatgctatatatattcttttgtatctgtctttttttagcaagtttgttctctttccaattcagtatctgtgtatgtgcatataggtacatataccctcacatatacatacataattattttaagtctgaattgcattcagagatggctttaaccagtttctctaaatggacaaatgaacaatttttttttcatgttggcaaattttatacataatctacatagatcactgtctttttttgttaatgatataattatttggagtcatttccatgaagagtaattagtgagtttaaaacatgtacctatgttacttgatgttactcattgtaaaaatgccttccagagacgttttagcaatgtatagcaccagcaacaatgcatcatgtatgagaatgattttttttctccacagatcattcccagaattagatttcagtttgttagtccctttcacttttgtggggcactaaggagttaaaataaaattgacaaataggtttagcttgcagaaacagacaaatgggtaggtgggagtgaatgttccaagaaatggggtcaactgcaaacagcttactggcaccccccgagtatcctgccacaggccctgagctcaccagctcacatgcacccaagcatcttgtctgtaagcattcagactaagcagcatgaccttataaaatttccctctagctcctgcctctttgcagacagcagagagccttctttttactatcttgcctgttgctcccttgcaacgtactgttcccttttctctaataaatctgtctttctaaacttgttactgtcttgggtaaattcctttactacccaggcgccagcctctgacagttgaccatgacaactttgtctaattttgactgaagtaaagagaatggggggtggagacaagatggacgaataggaacagcttcagacgaagaaggccattacataatggtaaagggatcaattcaacaagaagagctaactatcctaaatatatatgcacccaatacaggagcacccagattcataaagcaagtcctgagtgacctacaaagagacttagactcccacacattaatagtgggagactttaacaccccactgtcaacattagacagatcaaagagacagaaagttaacaaggatatccaggaattgaactcagctctgcaccaagcagacataatagacatctacagaactctccacccgaaatcaacagaatatacattcttctcagcaccacaccacacctattccaaaattgaccgtatagttggaagtaaagcactcctcagcaaatgtaaaagaacagaaattataacaaactgtctctcagaccacagtgcaatcaaactagaactcaggattaacaaactcactcaaaaccgctcaactacatggaaactgaacaacctgctcctgaatgactactgggtacataacaaaatgaaggcagaaataaagatgtcctttgaaaccaatgagaacaaagacacaacataccagaatctctgggacacattcaaagcaatgtgtagagggaaatttatagcactaaatgcccgcaagagaaagcaggaaagatctaaaattgacaccctaacatcacaactaaaagaactagagaagcaagagcaaacaccttcaaaagctagcagaaggcaagaaataactaagatcatagcagaactgaaggaaatagagacacaaaaaaaaacccttaaaaaaatcaatgaatccaggagctggttttttgaaaagatcaacaaaattgatagacctctagcaagactaataaagaagagagaagaatcaaatagatgtaataaaaaatgataaaggggataccaccaccaatcccacagaaatacaaactaccatcagagaatactataaacacctctgcgcaaataaactagaaaatctagaagaaatggataaattcctcgacacatacatcctctcaagactaaaccaggaagaagttgaatctctgaatagactgataacaggctctgaaattgaggcaataacagcttagcaaccaaaaaaagtccaggaccagatggattcacagccgaattctaccagaggtacaaggaggagctgttaccattccttctgaaactattccaatcattagaaaaagagggaatcctccctaactcattttatgaggccagtatcatcctgataccaaagcctggcagagacacaacataaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccgtatgattatctcaatagatgcataaaaggcctttgacaaaattcaacaaccttcatgctaaaaaatctcaataaactacgtattgatgggacgtatctcaaaataataagagctatctacgacaaacccacagccaatatcatactgaatgggcaaaaactggaagcattccctttgaaaacgggcacaagacagggctgccctctctcaccactcctattcaacatactgttggaagttctggccagggaagtcaggcaggagaaggaaataaagggtattcaattaggaaaagagaaagtcaaattgtccctgtttgcagatgacatgattgtatatctagaaaaccccatggtctcagcccaaagtctccttaagctgataaacaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccactgctcaacgaaataaaagaagatacaaacaagtggaagaacattctatgctcatgggtaggaagaatcaatatcgtgaaaatggccatactgaccaaggtaatttatagatacaatgccatccccatcaagctaccaatgactttcttcacagaattggaaaaaactgctttaaagttcatatggaaccaaaaaagagcctgcattgccaagtcaatcctaagccaaaagaacaaagctggaggcatcaccctacctgacttcaaactatactacaaggctacagtaaccaaaacagcatggtactggtaccaaaacagagatatagaccaatggaacagaacagagccctcataaataatgctgcatatctacaaccatgtgatctttgacaaacctgagaaaaacaagcaatggggaaaggattccctatttaataaatggtgccgggaaaactggctagccatatgtagaaagctgaaactggatcccttccttacacctcatacaaaaattaattcaagatgtattagagacttaaatgttagacctgaaaccataaaaaccctagaagaaaacctaggcagtaccattcaggacataggcatcggcaaggacttcatgtccaaaacaccaaaagcaatggcaacaaaagccaaaattgacaaatgggatctaattaaactaaggagcttctgcacagcaaaagaaactaccatcagagtgaacaggcaacctacagagtgggagaaaatttttgcaatctactcatctgacaaagggctaatatccagaatctacaatggactcaaacaaatttacaagaaaaaaacaaacaaccctatcaaaaaatgggtgaaggatatgaacagacacttttcaaaagaagacatttatgcagccaaaagacacatgaaaaaatgctcaccatcactggccatcagggaaatgcaaatcaaaaccataatgagatatcatctcacaccagttagaatggcaatcattaaaaagtcaggaaacaacaggtgctggagaggatatggagaaataggaacactttcacactgttggtgggactgtaaactagttcaaccgttgtggaaatcagtgtggcgattccttagggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccaacaaggatagactggattaagaaaatgtgtcacatatacaccatggaatactatgcagccataaaaaatgatgagttcatgtcctttgtagggacatggatgaagctggaaaccatcattctcagcaaactatagcaaggacaaaaaaacaaacaccacatgttctcactcataggtgggaattgaacaatgagaacacatggacacaggaaggggaacatcacacaccggggcctgttttgggtaggggtaggggggagggatagcattaggagatatacctaatgttaaatgacgagttaatgggtgcagcacaccaacatggcatatgtatacatatgtaactaacctgtaggttgtgcacatgtaccctaaaactaaagtataataaaaatatatataataataaaataaaaaaacaaatccaactttaaataaagggggtgttaaatgttaaaagaaaaaagagaatgaaacttatttttaaaatttgaacacaataggctattaatgaaactttatttaaatctttatatttttccaggccaattttaaagcttttaaaagttttgtttttttaattctgtgcccatttttagtaaatatagtatatttttcttaatggttcttaaggttttacatcataataatgcaaacatttctccaaatacttgatgtttagtatttccacgtcactgcatttagtgcattttcatgattttttaaatttccttgacatgttttgtatttccttgacatatataatattattaaaacacacactcaatcataatttaaatgctaatcctcacaaatctattagtctcaattttgtttaattggttttttttgtagtagatatataattttttatagtgaattacatcagtcttttctgtttacttcttttatactttgtaaggaattggataagtctcaaacaagacagttactcatcattctgggttttttgttttgttttgttttttgagacaaggtctcactctatcacccaggctggagtgcagaggcacaatcttgactcaccgcatccttgacctctctggctcaagtgatcctcccaccccagcctcttaagtagctgggaatacagtcacacaccaccacgcctggctgattttttgtatttttttgtagagacaggatttcctcatgttgcccatgctggtctcaaactcctgagctcaagcaatcttcctgctgtggccttgaaaactgctgggattacaagcaagtggcactgtgcccagcctctattctgttcttctttcatctgcatttatgtttaaaatttcaacttttaaaatttaatttttaaatgttgagaaataaaggacagtattttttcgtatagttattacctgaacatttattaaatgattatttagcataatgccatatgttctcattcttaatgtgtttgtaatctctcaattggttgcattttccatctgtcaaaaggtctcacttaaacattttaagctttgctgagtaccttttaaaaagtgtaaaaagggtgatacaccacaaatttcaccagaatttttaaagtatatattcctatttataattccaaatacaatttcggagttattttgagtttctaaaggatcttctttaaattttatatggaattttgatgatgtgataaaagtgaaaatacatatcttatagtactaaaaagtttatttggaaatacagtatgttctccactcatatccttcttccttaattactttatcaaattttgtgtttgtgttaccagttatgatatatttcttgtttaatattttttcttctaattttatatgcttttaaactattataagtgtactgattttattatactttctacccagttagtattttatattttctatttttgattctcttgaaacaaatgtgtcatatagatggagacactgaagaaaaaaataggaagattaggattagggaaaggttagggaaaaaaagtgtagttggtattttcttccataatcaatgagtgaaataaaattttctcaagcaatgactgcattgttacctcatcctcctccccaaacaaacattttaagctgaaatacagtgtgtctatactgcacttcaagaaatactttagctggattaatatctcaatggaatcggaattccatggaacataattatatcatttgactaaagtaaattcatagtcttttgttgcactgacttgtccttagtttagggttagttataaatactttcagaatatgttatgaatgactttaaataaattgataaagtaaagtcgcataaaacatcgtgatgtgttttaatctgtttgtgctgctttaacagaataccacagactaggtaatttataaggagcagaaatgtataggctcttagttctggaggctgggaactccaagatcaagcggccagcatttgattagagccttcttgctatgccataacatggcagaagtcatcacatggcagaaaggcaaacagtaggagagagagcaacaggagtcaaacttacaaccatgataatgataacagcattaatctattcatgagagccaggacctcatgactagccatcttttaaaagtcccttctcccaatactataaaaatggcaattaaatttcaacaagagttttggagaaaacaaacattcaaaccatagcatgattcaaacaaataaacagcaacaaaccgagaacaaatatataaatcctgattttaaatttaaaaatcaacaaaaggctaatgcataaaaataatcattgtaattccaaataaatacagattcaaatataaaataataacattaataataacatatttttaaaactgaatttaaaaataattaagaaaaataacacctaatgctgtaagggttttgttattcagtctctggaaaaaagtctaaaaaccttctggaaagcaatttggcttcacaaatataaaacctcaaataaatttatatattttgacttatcaataaaatctaccccatttctaggaaatgtattattaaaatatgataaaacgtttggataaagatgtgaagacactaatgtctggcacaacactatggaatgtttattttggatagatgcatagctacaataaaatattttgttctagtatgtaataaaaataaatttgaagtgggaaattttcatacatattgtatgtaaaaaagaaagaaaaaaaaaactatatgtgtgattgatctgaattgctcataatttcaaatgttatatattgatataacatttcatttttatcatgaagaaagatgcacatagatccactaaaatattaacagtctctagattttcagattctagatatttataaatcattttgatatacttattacatatcttatgaagactagagagtagagtacaccaactttgtgacatcatgtcccacccaaactagaactttttcaatacaagtgttgaccgaatttatgcaagtagaattcacattcagaacactcagactcacatattcagaaatatctatggcagccattgccaccagctctgaaatcttagtttcagagcagcatccagttttagagagctgagctgaaagacatttagaaaacatctattgcatcacatttgttctacagatttgaaaatatggatcactggagtttaatcaatttattctaaacacaaaatattgtaaccaatggtagaattacgatcataaataaagcagcataatttttcttggctgtttccagcgtgtaacctaccttactttaatttcaaagaagccatgaagactatgacatgagtgctaggctctgttatatttctaagctatgtgttcgttctttttgttttttcttaggagaatggcactgtattttgggcacagttcatcaaggaaaaacagttgtcttaagcaatggattttagtgacggctagttgattgttacctggctactatttatagtatgttcttggttttattatgtgattttatttaaaagttacatagaaaataagaatttaaagtagaagtcccagttttactatgtccatgatatacactcagaacattgatattctctttagaaatgaatatttaatctccacatccacttttgtcagaagtaagttatttaattgccaagcactttacaaattacttctcttcacgtattagttccctacaattcccgaactataaacacaggtataatactaacttgctttctgatattgcagataagaaattaagtagataatctgtcttagatattatctattagctaacattttcactgattattggggatatattagataacttaactttgttcctgaaattatttgagagaactttacctcaacaaaaattgaagatgggaatgagaatttaatgttctttaagaaaatattttgtgctcctgccaatttgtgagagttaaaatataggaaagatcacgtttcatacgaaaaatcacaattcactacttcctcttgatatgggatatatggacaaaaattactctttaggcatgtagaggtctagtgcaatggtaatgaaataagtgggatgatagagtgtgtctgagtctattggttttaaactactcctgggttactggtaactacatatttgtcactaagcctatttaatacagttccttaccttggggattgaactatacaacacatgagtgagaaatacagactgaaatgacaacaaagatgaaatgatggagataaaagtactttggaaatgagatgatagaattcactaagaattatggatcatttcaaattcataaacataaatatctactttaaaacattacaattcatggaaagcacttatgtcacttaaaagattgggcttcagaacggtgtcgcctcttaggttaaggtggcaagtgtaaaaagtcaccatagcatcacagtacttgaagacatttaaatggaagtattagttgataccatgagacttttaattttgacatactattgtctttgatgatattggatatatttcttccataaataaacaggttttgtttaaatggaaaatatgctgaggcaagtagaaccccttttttatatttcctcaatgagaaactgtcttagcagccaaagtaacagcgttcactattattgcctcaagggttgggcagattccaataggctgggaacacaggcactatttggggttgtatactcaagtttagacagaagcagtctggtcacatgaaacttaatcttttaaagtgttatttaaacacattctttatagtttaaattgtaccaaatttattctaggcacacacaacatttattcaatattcaatttacaaatagaacttatgtgatttcttagtatagttttttggttttatattttgagtaaattttaagaccttcaaacaagagaaaaagccatcagaaatagattactcagggtagggaggacatcaaagaatagaggttaatttaacaatttctagatttcttcttacagttttttaatgtcaagtattaaaatagcacgcattttttcaacatattctagcctcaactgattttagaaagtcaaactcatgtcaacatgtcattttatagacatagaatgggaaagaaaataatagtacagccagagtggcaggtatttcctgcaagaatatgaataattccaactttttcatgcagttttcacttctatttgagaatcagggcttattctgttattattttgtgtttgctatgtattttatatagtgttgtcagttaagcaagttaaataaatgcaactggtcaaactgtgaagactcagtaataagcatcaaaaataatttagtttccaagaaaaagcaaactcttctttgtcaactgagagacatgtctattgagaaagcgtttcattcaaacttgagaaaaagtttggtaattatggctaccatttactctgaaaacttattggaattggtatattcatataaaaatattgctaattttatttttcccaaattaatttttgcctttgagattcacttgaaattaaagtaacttgaaactaaactatgttctttttccttctaatttcactgtccctatatataacaatggcttttcttaagacattagagtagcattccttcgtaactgatgacttttacattaaactttcatgtaaaattatattcaaatttgctttcaagtctctttttaaaataactgtttttactattcaaaaaataaatcatagtgaaaggttaataaagtatatatactcatatcaatcttattagaaacacaatggaagttatatcaaatattttacaagtttctcaattcacattaacctagctctagaagtttcttctgttctcaattcaactggaagataattgtcttgactaggaaaaaatgctaataatgagactgtcaatatataaactataaaagttaatggaaataaaaaataatcttaaatgcataaaatactaatgaatacaatgttcacaatattagcattaaaagtggtcttattttcttaaaaacaggtttgtgttgtaaacaaaatacaaggaaatcttctattaaaaatatatgcttgagattcatggtagcttaaatttatccagggaaaatattttacaatatgtctcagtggtagtcagaataatcacctccaaagatatttatatcttaatcctcagaacttgtgaatgcgcatgaatgcacacagcaaaggagaattaaggttgcagatggaattaatgttctaatcagctgactttaaaatacagatattattctgaattatctggcaggtcccaatgtaatcacacgggtctttaaaagtggaagaggaaagcagggaagaagttagagtgatgcagtgtgaaaacttgatcctttattgcatgcaaaaaaaaaaaaaaaaaaagatgaaggaagagggccaggagccaagaaatggggacagcttctagaagatggaagaggcaagaaaacaaattgtttcttaggggcttcagagggaatgcagccttgccagtatcatgactagcccagtgagacccattttaatcttctgaggtacagaactataaaataaggaatttgtgtagttttaagccataaaattgtgtaatttgtaaaggtaaccatataaaattaatatagcttctatgaatacctctatcttaattatatagttacagttttaattttttttataatgcatatcccttgaaaagttgtaagcaatatagcatgtgcttaagaggcaaaaaggtaatgtgaaaattttttaaagtataatttattatatatttatgatagtaatttgcaataatgtattatatgtattataaatcagtgttaatgtaccagtctatataaatatctatatgattaaactattccttattcaatatcaacttgcccactgtaaatcacactagtatgctgttgattattttgcaaagtttcgttcatgatgttttcaggtggataattcatgcttacgtgtcatatcctcctgtactctataaaagaaataagagcagccacagcacatgtatcactctatggaacatattaataaagttctcaagatcaatgctgctgagtgcttttttgcaggagcagtttaatgttagtataaaatattgccccattaaagcacagaagacaataaaataaagcaaaatcagcataaataaaatttattaattatgtctcagtgattggaccttttcttttacgttaaagaaggtttacaatgacagcagcgtatactagaaatgatggagtccctatttatccctggtaatgcaccttcttagatcacagttggttagttgtcatcacttaatgtttataaagagctctaaaattgaaattactccctaagtgtcgagtagcctcatcattcctgaacaatcctaatgaagaaaagcatatgtgaccattttgcaagcctcttcagaggaaagtgaatatttaccattgaataaaacaaaacaggaaaacaaacagataaacataagagcaaaagaacaaagtcaaaacaagttgcagaccaatgtagaaagaaacaaaagtctgtgcttcttccgttcaggttcctcgggccagagacagcatgtaggtcatgctgtggttgatcacaagggccacagatgatattccctagtgtttgcaagaacttcctttaaagtactattaataatatagagaaaaatgagaaataagtttagcatgatcattagtatgcagtgtatgtgagtgatgcaaccatcatatacaagcattataactttcgtgggcctattttcttatgctctatctctctgtgtataaaacataaaatatataaatatgtttatattttatgtaaatttatatttatgtttaatttatatatttatatgttatataaagtattttcatgtataaatatatttcctataaaatatttatatattatattttatatgaaatatatgtaatattacctaggctatgttcactattttacattcatcgttattcattgttatactcattttttctttggtttctaagatacattaaaatttgaaaatataatgggcctataaaattttcatgacccctaagtgccgtacctactgtgtctgacgaataagttgtctctggtctttataaccatttgctatctaaaagtgtataccttcagatgtccccaattttatatttgtgataaattcatgttgataagaatatgggcatgctgattacctaaaattcaaaatatgaataggcccagtataaattgtttatgtatatgcattcaagcactagtgtgtttgttagagctttcaaatctgtttccctcttttaatccaaagtgttccaaaacatatttgaatataatgtgtattttctaaaaatattccataatctgcatgtatcacatcttaacccaacaagtaaacactggaaatgactactaatcagggcaagacatgcatgataacatgtaggtgtgggttattactaatacaaaaattctaggaactttcctatgtactctgtaggatgcgaatgagggactgtaaaagtggagaatgacaatctgtatgctaattctgaaacatttgcattgagaagaatggcctgggaaaattgagctaaatctattcccgccttagcaaaattcttcatgaatgtgaaatgctataggttagttaggtaaactagaagcttctacaatcttgtctacattccaagataatgcagtatgctaaatatttttctctagactgaaaatatttctttaaaatgatctgtaattttagcttcctacaaagtcagccttactttctctgaattagaatgattatgtgaggatctgttaaatttatatgtttagttttgacaaaataacacctacctgctaaagaaaattgtaaaaagcgataagaatagtgaatatgttaaatatcatttgacctaatgaatattggttttgttgtggcaaaagaacaaaaaatggaatgggtattttagaccacagtaacagccactcctacaacagataaattactattatttgattttcagcctttgattgtcttttttcccaaagaactcagaaaaatatgctcatatatcacctgtgtaaaataggaacaaattatgttctttcaactgtgaatgccaatcacacacagacatttgcaaatttacatgagatgaaaagcaatttcacggcaatcagctaaaccacaataaaaattacgcatgcatcacagcattgggagagagagaaaactgtgacttgccaaaagaaaatcagcttgtacattactctggccaaccagtgccaataccctgaacaaggagctatctctaggcaaatgacactgtagattgatatgctaacttacccttcaatacagcatgtatgtatctggggatgcagagctacaaagaaaggttctgaccctgtgaaaacaggtgatcaccatgctgccttgtgccatttacaactgctaactagaaataatttggtctattttcagtggttaacttaagggtaatgcattgtattcatttgtacttttttttttttcaaattttaaagacttccaaaatatctattgcttttgaaatctactcagtggccattcagctgtttaaattgaaatggccaatgtaaggaaagaaaaagattaaatatattcaactggccatgataaatacaatccaggtcctttggtgttagaagctcagtatgattaaactgtttttaatgattaggcttttgatttttacacataaagaattcttaatcatgattttttatcataaaaaacaaaaacactcaattagaaaaaatatggatagcatttcccaggatagggcacgttaacaactatttctttccctatagctttttctactctgtgtgtgtgtgtgtgtgtgtgtgtgtgtgtgtgtataatgtgtggtattctcttaaaatttgcctttctatacaagttcacataaaaaattttatgcaccaaattttatatctttttcaagaaaaattgtaacttcagcaaaacaaagattaaaaaatgttaataaaggactataattttttacaaaaaaggctaagttcatactgtactaaacatatctttatcagaagatgtaaacatactgaatttgatgcaaatgtgaattttagaaacccgagctcttactatttttagagtccttaataaatatctaacagtctactatggtttgaatgtagtttgtccccactaaaactaatgttgaaattaattgccattatattggtgttaagagatagggcctttatgagatgactaggtcattaaaatctcaagagagactgggttagctcttgcaataatgaatttgttctcataagagtgatttttggcttattgatccataatatttatatatatttggggtacataaaatattttctcacatgcttaggaagtgtaatgatcaagtgaaggtacttaggatgtccatcaccttatgtatcatttctgtgggttgggaacatgttaactccactcttcaagctattttaatatataaaatgcattgttaactatagtcaccccactatgctattgaatattagataaaaatcctttcatttgcaacaacatggatagaactggaggtcattaagtgaagttagtgaggtgcagaaagacaaacatttacgttctcactcatctgtgggagctaaggaattgatctcatgggggtaggaagtagaataaatccttaacaggttaatttcattattacaacaattcaatgaggtagttatatttttattctattttgcagatgagaaagctaaagtagataaattttaagtaaatgctcaggttcacagtgctagtaattaacctattcagcatctgtacctagaaagtctactgccagagtccacatttatcaccagtttactgtaatgcctcttcctttgtaaccctgaaaattacttatgagaaaacttggctagttttcacccatatacctatataagggacagacatcgatgcgccttttcaaaaaggtgaagtgggagtacagggccagagaaagataaatggaatcatggagtataagtgatgatgccatttttttttctactggaagtttgaagtaatcttggaaataagaacaagttctgtatataagctaggtgagagcttccccaaattcccatccattcatttattgttcaacaaatatttattgagtgcctacatcaggcactgtttcagaaatttagagcttcgtaaggaacaaaaatctctgcctctatctagtatatttactagttgggaagagagttaagtaaacaatataatacaaaagagataataacagtaaagaaaacaataacaattgccaccctgaggtaaaatttgggggatgctcagagcctgagtacaaaggtgtcaaccaaaccacccgaggaccaatgggatcagtgtctcaggacaccagtaagtggatccaattgaaatgcctgcaataataacatcgttttaacttcttggtaaaccaaggttttcaattaaaggttggtttggggaaaaaattgcctttccttatgaataattcaaatggatttcctttgaatttaccaaaattcttcatctgatgagataggattttttctcttttcgcccataaactttgctttatagattgcttagggctactgcctaaataaaaataaattcctgttgcagtatggttttaatatgttgaaatgtattctttaagttgaagatctctgtagttcatttgtcaatgcaacttttctgttcaataggagtttttaaaaaagaaaacaatcaaacaaacaagaaagaagtttacttccttttgctagtgtattccattactacagtttgatatttcaagtggctcatgaattagaaaaacggtctataaaatcaacttataactatctacctgaaagaaacaacagaatattcatagtcacattctttttatgttaaatttaagttttaaaaattaaaatactaatgtattatttataatatgtataaaatgtgatataataaattccagcaactaacttatacttttttgcctagccattccaccccttgtgttttcctccatttatgctggaagcaggcttcatgttcctttgcacaacagcaaagttgtgtcaggacctccagcagaaatcacgttcatttaaacaagtttctcactttgtgttaaggcctttgtccattgaagggcctgtatcccaagtgtgaggagggagaattccttgagaacagcgaagcaagcagaaggggtcctcccgaccctagagaaaagatccagacccagggaattgaggagaacaagtgacccgggtccaatctcctcaaaatagtttcggttgttgttacagtttaaaataccagggagaatctcatgtttgccagttgtttttttttttttagacctggattaccagtagaacactatattaaacctagttggtttatattctcaaagaagagaataggaatatagtctatgggtttctattttttcctactcatttaattttattacaaaggctgtatgttagttgatatgagggatagtgaaacaatttttaaaacttctaattgtaatcattcacatttcaatgtgatattgtgttaagtatgactttatgttagctataagtttgacctggacctttttgtcttatattaaggatttgtgctcctgctctaaaataattggaatggattttaaaatttcttgactttcatatacttttagaaattactacatatccttttgcttatttgacctattggcatgatgtattagtagagttgtttttacaattccatcatcaacttgtaagttattcttctggatatagcgtatcaatatatttcatataagaatgatgcatgtctattcataaaacatcagcctggatttttcattcttaatgctgtggttttacttttgtagttgcttgtgaatctctcttgataaggttaaatactgttttaacttaaaaacaatcaagttaacatacaatttcattgtcatattgcatacttccttttcccttctttaaaaagaactcacagtgatgttatagccatgtctgctgaatgtgttaaatggaaagtagattgagaaattttgaggtagttgaacatcagaacattattcttactagatgcattgaacagagagctaagtatattgctatcttctctagcacttggctgagagcaaccaagcaatttttcattttacttgtgagcacaccatgaacacaccacctccatgtatcactaaaccatgcaaaagcctctgttattcatgcccaagctggcatagagataaatttgaaagaatattagtgaaaaatgctgcttcataccaaacagtattctgtctctgtgtttaaaatgactttaaaaaaataaatcatgcaacaggaatgtctccaaacacagacttctggaataaaaattgccaatctcagagacctagctccaaggaatatcaaccagccagtcatccacctagcatgaaatggaaaggacattatttcaaccttcagtggataatgaatgccttgacacaacctgttttgaaagataattggatatgtaatttgctaaacatactatctacaaggcaataaaacaagttatcccatttatattttttgctatttttctttgtcagtttgccataattttgttcacccataaagctattatttcccaaacgagtgctactagatctagagatggtttctaagcaagtgaaattatctgaaatgtgactaactgaacttcactctttaataggattcacttaaggaatacattatacttttcatgtactcaagctcaaataacctttaccattcccatggttttttatatgttcttccagttaccacatattatttatagtatcatattaagaaaatataaattttcttacacatgcaattgaatatgccccgtccccctttgggattgtttgattcacttatttactcaacaaatcttcatcaaactcttaattttcactcattcaatcacctgcatagggcaatcattcaatcaacattcttgagcacttatcttgtaccaagcattattaagcccttgggactacagcagtgaagaaaacatacaaattcactgcttttatgagacttaaattctggtgtagagagacagaaaacacacacataaatgtatttgatgtgctgagaagtactataaagaaaactaaagcagtaagagcacagcgaatgaaggacttttagtgatggtggtattattgtcgtttgaatagactcattacaaattatctctctgtcaatgttacattggaggaagcacccaaaggaaacaagggagtaataattgcgaacgttttccattaagagggagtggtagggaatttataggtgtgctggaggatagcagaggccagcagcctcaccaaactggagtcaacaagagtggctgcaatggggtgccagcagtgagttagtcaaagaaagataacatcatcaggctctgtagaacactttttggaaggactttgaatttaattccatgtaaattgcattttaaacaaggcttttccaaaggtcattctgtagctttgtggagagtaacaacagtagatgcagttgtaggcactgttagaggtacatgagaggcagaatacaggacggtattgaagaaaatagactctcctttcatggagtttactctctgatgtgggggcatataataacgacgctaaaataaatatgtagaaaggatatacaggttagtgataaataccaggatggacataaaacggattggtgtgattagacaaaaggtggaagctattacttctttttgcttgattaaggatctaataaagacttatactcaatctgagaccagagtaactaaaaagagacagccatggaaagcccattaaaaaagggagttctggaaagaggaatagcatgtgaaatatcacttatgtgagagcagaaaggtggtcagtggttttgaagaggaagttcaatattatgcgaactggagaggtggaggcaagatcatgttgggccttatcagccacattgatgacattagatatatagtcatatgtcacttaacaagggggtatgttctgagaagtgcatcctttagtgatttcatcactgtgcaaacattatagagtgtacttccacaaactgagatggtagagtctgtaggttactgtactgaaaactatagttaagtgtttgtatatctaaacatacctaaacagaaaacatacagtaaaaattcagtatagaagattaaaaactgctatacctgtataaaggacttaacataaatggagcttgcaagactggaagttgctctgggtaagtcactgagtgagtggtgagtaaatgtgaaggcccaggacattattggttttataaacactacatttaggctacattaattttttttctttcttctataataaattcatcttagctaacagcaacatttttactttataaacttttatatatgttttacaatttttggactcttttgtaatgtcagcttaaaacacaagcacattgtacagctctccaaaaatatttaatttatttatataggcttttttctatttgtagtaattataactttttagtacgttttgttgataactaagacagaaacacacacattagcttagacctacacacaataaggatcatcaatatcactgtcttctaccgccacatcttgtcccactggaaggtgtgcaggggcagtaacatgtatggagttatcatctccttgatagcaaggctgccttctggaataccctcgaaagatctgcctgaggttgttttatggtgaactttttgttataaataactagaaagaatatactctaaagtaacaataaaatgtatagtatactaaatacataagccagtctcacagtagtttattatcattgggaagtattgtgtactttgcagaatggtatgtgttacaattttgtaagattggcagtgcagcagggatttttttttacacctgcatcaccacaaacacacaaataatgcattttcctaggacattaagattgatacaatttcactatgcaatacatgggaccaccactgtatatgtggcatatcattgactacagaaagaagtgagaagcccctggaaactttaatgttaagagagcaacataatctgacttatgtatttcgattgactactctttgaaaaatgtattttcatggaagtgagtagcaagaatgacattttggaaagctattaatccaaaagggggatttggttgttcagattaggtggtaaccttgaagatgaaaataaatgaacaaaattgggatatcttttggcagcagagacattaggactattttatggatttgattggggggtgctgaggcaagagacatcagagatgtctcctaagtatttggcttgagagaatgtgtgaatagggaaacatgttatgatgtagaatggcctagcgtagcacatgagcatggtgttaaggaagcattatttctccttggggtatggcaaattagagatacaaattagacatccagtagtcccgtcaagtaaacaattaggttgcttttctaatctgatttagtttaaaggagcatctgagatctaccccaatgagatgctttcatgttactgctgttaaaacaattttatcagaatcctcagtttttataaattatccttttagcatataatataaatatttgtgtaaccatggacttggatgatgcttgttttacttgagtgggcttccactgcaaagtcaaaacctttagccaaaacttcaaaacaggaggtgagtcaaattggccattctccaatgacctgtcagaagtttaagaaattctttgagaagaatgcaaagttttcctactcaattgttatgacatatttttgaggcttctaatatttcattcatatttaaccgacagcagcgaagtactcagtgtatttaaaaataaaacccaaactgaccgaggtctcagactttaaagcagcgtataatttatttagaaaccagacagtgccatgaaaccactagatgctatagagtgtctatcatagcaaatattatataagtgatatgtacatgagatgaaagatgtagataacattattctgttcaagaaagttaaattgacttaaaaatactgaatcatctgagttccatcttggagagatagtaggattttctaagaaaggagaaacaggagtggtaagctgaatagcagaaacaagagcataagcaaaacaaggaaatgaaaataaatagatatttgcattacacctagtcatcatttgaaaggcaccaaggatgcatggaggagagtgactggagatgaggttgaaacaggaaacgtcctagattgcgaaaacatgttggagcattctacagagtttacattgaggatagtataaatcatggatgagtataaacagattatattggggttttagagagaatactctgttatcttattttgaatatgatgaagtaaaggacaagatttcaagaagtgaatgaaatggctcaagacgataacagtgagatttaaaaagacaggaaagaattgtgagaaagatcaaaactagagttattacaacttcctaagtgaatgttttgagtgaaggaaagttaagtgtcaaagataattctgaagctctcagcctgtgtgactgagtgaattgtggtgttcctcaaatgaagatggaaattctatttgatgagggagtagtgataaggcaagaaaagttctgttttgaaaatccaggtggagatgactagtaactagatagaaatgcaatctgttgggcaggagatcaatatttaagccagagaattaagagtcattagcatattcaagaaagtggtaattgctggactccatgaagtccctatgaataggttaaattgagaaaagatctttcagcataaaactctgaggggtgggggctttccaaggagaggcagcagaagccagagtaaattaaaagaaagggacttgtcagagagacaaaagagaaaagaagagatgctaaactaagaggaaggtgatttttaaaaagaaagctaagaattgacacgaagtacagttattgtatataaatgtgtatataccatgacccatatttcttcattattgaacactttttactttcatttgagtattgtcatccctctgttctttaaattgctctaacatctttcatatttctcgaaattctaaatattaaaaaattgcttagccacaaaattttctcaagcttcctgttcatatctgcatttaagaaaaaattaaatagtaataaaatcaaataaactgaacaaatagaagaaaaattagggaatagaaacagaagaaaaactgtaattcattttgcctgaaaatgagaataaaaatgtattctaaagactgtttttcatgttttatgtaaaaatgacagtttttaaagttttctaggggctgtctcttttaagatattagaacatagtgatactttattttgaatagatgtattatggatgatacataaaaattagttataactatctattgacgatatattgtttactacaatagaataagaccacacctgagcctaaagaaagttctcagtttactataggtaaaatcttgctatgaaaggtgcacataaagattagaggctttctgtggtggaggggaaacactgctggctgcagaaaaaaatatctgacataacatttaaatttaaaagcacaaattattgacttagtatgttaacataaatgaataaatgtcttctaaatgctttgtcttttactaaattccagcattttattactaaaaggacacatatacaataagtagtaaatatgcctgatatattttaataatgtaactaatttcctttataaattagttatagttttaatactcttctttatgtgctctaagtggctccattggctaggttaatcattagaggatgactaaattgaaaaatctttctacaaataacgtggtgaataatgtcatcttccaccatcttatgctaatgtataactaattattatccattgctgccatttctgaattttacataatttgttcatttagtgtgagctatctaaaatatatatggatttcaaatatgtattttatgccatggataaagtttatctctcttattctgttttgtcctataactatttcaaagcaataacacctatatggtccagaacagatgtcattgcttgtggtctggaggtcatgaacattgctaagccacacaaaaaaatgattttgtgtgtgtgtgtgtgtggttgtgcacagtatctcatgcctgtaattccagcactttgagaagccgaggcaggtacatcatttgaggccaggagtttgaggccagcctgggcaacatggcgagaccccatttctacataaatacaaaaataagctgggcgtggtgacgcacacctgtagtcccagctactcagggggctgaggcatgagaatagcttaaacccaggaggcagaggttacagtgaaccaagattgcaccagtgcactccagcctgggtgacagagcgagactccatctaaaaaaaaaaaatgtattttacaaccatggcttacatgctgagacatatataatctctgatgaataatgtatcatgctaattttatttaaaatattaaaactcatattacaccactatcaaagtaataaaaaataaaggaaatcgggtattctgtatattgacacaatatattttgctatttattctgatggctgatatttaataatagaatgggtacaaaataacttggaaaattatacataatattacatatatataaattcagaaatgtcttgtctagctgtttgtgaaagctgtgaagcatatcttccatttccctgagtagtctgttggtggcctggacaagttcaccctcatcacagcttgacccctagcggctagaggacaaaccctttggcctggttccagttccccagaactctagcacacagtttgggatgtatgaagatgacatctgcggcctgatctccagcaggggaggagtccacactgtcaaaacatagagaaaggtatggtgatgaggaagctgggtacccctcccttctttagacctgactgaaaagcttattgcctgacagctgtggtttctgctgcaggaaatctcaccatcgagatgcctagaatagctttgtgatctgggcacaaatggttttgggtcagactaacttgtagggccagttgccagagtggatgccagagggagactcaccaataagagggtgtatgagttggctcttcctctgagccagctctgtggtgcaggagaggcacctccaaccctttctggagggtcgtccatgaggcctgagagcttccactagacacctgctaaggttggtacttgcacctgcctcagagagcctggctgccagctcaccagacccagtgccgcacagctttgccctctcaagccaccttagtggcagagcacaggatggaaaccctgagagtccaggcactgcccatcaccagaaatatcccagtactactcctgatcaacaaaggctatgtaaaaattccactgccaccaccacaattacctcttgcctggaagtatcatctactggctaggaggtcaaactgcatggcccatcacaactgctgaaaccagtttataccatttaactggcttttagccaaaattgtcacctacttgctggtagggtgagctgcacaacccaacataattcttgcttacagcagtgtgcagtgctagggaactagatatgcaacccaagccctgtacctcaccatctctgtaggagacagtgagcctgaccacatacacagcatattgctaccacaacccacaaaaaaactagcacttaagaaaacctacactactatactacactcaggctatctataaccaaggaatttatacagagccttggccccataaacgcaaagcaaaggactctacctgacatgtgcaacagtcacactctcaaggaggaagaaaaaagtcatgtaaatgaaagttaatttaaaaataataaatgacagcatctacatatgaaaagaaaccagtccaagaactccagtacaacaaaataacggatattatgacacatgttatggaccatcctggcttcctagcaatggatcataaccaaaatcaaaacattgaaatgaccaaattcaaacaaagaatttaagatatgcattgtaagtaatctcagtgagattcaagagaaggttaaaaaccaactcaaagaaagtggaataacaattcatgagataaaagacaaaatagatatattttttaaataactggaaataaaaaaaaactgaagaaaatttaaaacacagctgaaagctttaacagtagagtagaaaaaagcagaagaatttcagagcttgaataccagtctttcaaatcaatatggtcagaaaaaaacagtaacaaaaaggatttcagaaagcaaacaaaggctttgaaaaatatgggttatgtaaagcgaccaaatctacggcttataggcattaatgagagagaactagtaaaactatgaaaaacataattgagaaaataattgaggaaaatttccccaatcttgctagagatgtagacattcaaatacaataaatttagagaatacctggaatatattatacagaatgtacattaccaaggcatacagtcataagattatacaaagtcaacatgaaagaactaatcttaaaggaagctagagagaagtatcaaatcatctgaatgaagaaaatgccatcagactacagcagacttcctagaggaagccagagattgaggccctatttttagcctccttaaaaaaaaaaaaagccaagaattttatatcctgccaaattaagcatcataaacgaagaaaaaataaagtctttcccagtgaggaaacactaagggaatttcttccagattggacctataagaaatgctcaaaagagttctaaacatggaaataaaaggacaatactctccatcataaaagcatatataagaaagctcacacattacacaaagcaattacacaattgagactccaaggttactagctaacaaaactataacaggaataaaatgaaacctcacatatcaatattaacattccagttaaatacccttgaacttaaatattaataattctacttaaatattaaccatgtacataaatagcctaaacattctacattccagaataatatattctggaagaacatatttatatattctggaagaacgtatttatatattctggaagaacgtatttatatattctggaagaacgtatttatatattctggaagaatgtatttatatattctttatatattctagaagaatatatttatatattctagaagaatatatttatatattctagaagaatatatttatatattctagaagaatatatttatatattctagaagaatatatttatatattctagaagaatatatttatatattctagaagaatatatttatatattctttatatattctagaagaatatatatatatatctatctccaactgtcggctgcctatgagagaacctatagggggtctaatggctagacacatatatactcaaagtaaaggggtagtaaaagatatagcacacaaatggaaaacaaaagtctgaatgactagccattcttatattaaacagacttcaaagaaacaacagttaaaaacattaacaaagaatggcattatataatgataaaggtttcaatacaacaagaatatttaactattctaaatatatacatgcatccaataccagagcacccaggtttataaaacaatttctacttaacctaagaaaagagattaatagcaatacaatattaattgggaacttcaacacctcactgacaacactaaacagctaatcgaagtacaaagtaaacaaaccctgacttaaactatactctaaactatgtggtcctaatagacatttacagaacattccactgaacaaccagagggaatacatttttctcatctacacatggaacatttgaccatatgcttggtcataaagcatctctataaattcaaaaaatcaaaatcacatgaagtattttctcagattagagcagaataaaagtaaaaatcattaccaagaagaactctcaaaaccacataagtacatataaacaaaacaatttgctcctgaatgactttcaggtaaacaataaaattaaggaagaaatccaaaagttttgaaacaaagaaaaatggaaacacaacataccaaaacctctgtgatatagcaaaagctgtgataacactaaagctaattgtgttaagtccctacatcaaaaagagaagaatctcaatttaaaatcctaatgtcacatctcaaggaactagaaaagcaagaggaaacaaagtcaaagctcgcagaagaaaagaaataacagatatcagaagagaattaaatgattctgagacttaaaaatgatacaaaagatcaacaaaatgaaaagttgtttattggaaaggataaacaaaatcaatagactgctagatagtttaaccaaaaaaagacagaagactcagataagcacaatcataaatgataaaggtgacatcacatctgatacatgccacagaaatagaaaagatcaccaaagattagtgtgaacatcagctgtatgtgcacaaactagaaaacttaaaggatgtaaataattcctggaaacatacaacctccgaaaattgaaccaagcagaaatgtaaatcctgaacagaccaataatgagtaataaaattgaatcaattaaaaaaaaaattataaaaataagcccaggaccaacagattcagagctgatttttaccagatgcacaaacaagagctgctaccaatcttactgcaactattccaaaaatttgggaagggattcctccctaactcattctctgaaacaagtatcactgtaatactaaaatcatgcaatgacaacaccaaaaataactacagaccattatctctgacgaacatggatgtaaaaatcctcaacaaaatgcaagtaaactgaatctgacatcaaaaagatgattcatcatagtcaagtgggttttattccagggatataagggcaattcaacatttgcaaatcaatgaatgtgatccaccacatacaccaaattaaaaacgaaaaccatttgattgtcttaatagattcagaaaaagtatttgataaaatccaacatttcttcaagatgaaaaccctcaacaaactagcaattgaaggaaaatacatcaaaataataagagccatatgtgacaaacccacaggtaacaatctgctcaatggggaaaagttgaaagcattccccctaagaactggaccaagaaaaggatgttccctctcaaaaatactattcaacatagtagttgaattcgtagctagagcaatcaggcaaggaaaataaataaaaggcatccaaattagagaacaggaagtcaaattatctctattcactgatggcatggttttataactagaaccccctaataactccaaagtagtactagagttgatacataaaggcagtaaagtttcaagattcaaaatcaatgtacaaaagtcagtagcatttccatacactaatgacattcgagctgagaaccatataaaaaactcaatcctgtttaaaatagccacatgcacaaacaaaaaatacctaggaatacacttaaagaattaagtggaagatctctacaagaagaactaaaagacactgatgaaaaaaaaaaattgtagatgacacaacaaattaaaagacatctcatgttcatggattggaagaattgatattgttaaaagtaccatagtgcccaaagcagtctacagattgaatgcaattcctatcaagtagcaatgtcattcttcacaggattagagaaagcaattgtaaaattcatatgaaaccacacaagagcctaaatagcaaaaacaatcctaaactaaaagaacaaagccggagacatcacattacctgacgataacacatactacaagggtatacgaaccaaaagatcaagtactgatataaaaataaacacatagatcagtagaaaagtgtagacaacctaaaagtaaagccacatacctacagcaaactgatctttgacaaagtcaacaaaaataaacaatagggaaaggactccccatttaaaaaatggtgatggaaaaattggctagtctacgtataacaatgaaactggactatcactaacagtatatacaaattaactcaagatgtattaaagatctgaatgtaaggcctgaaactatagaagtcctagaagaaaacctaggaaaaccacattggcctaagcaaagactttatgactactaccctaaaagcaaatgcaacataaacaaaaatagataactgggaattaaactgaaaagcttctacctaacaaaagaaataattaataaagtatatagaccacctgcagaatgggagaaagtatttgcaaattatgtcaaaccaacaatcccattaaaaagtggacaaaggaaatgaaaagacatgtctcaaaagaagacatacaagtacctatcaaacatatgaaaaatgctcaacatcacgaatcatcagagaaatgcaaattaaaccaaattgagaaatcttataccagtcagaatgggtattattaaaatgtgcataaacaacagattttgacaaggatgtggagagaagaagggaacacttataaacagttgagggaaagtaaattaatataacttctatggaaaatagtgtggggatgtatcaaagaactaaaactacaactaccatttgatccagcaatattacttcaggtcatctacacaaaggaaaagaaatcattatctcaaaaagatacctgcacttgtctgtttattgcagagctgttcaccagagcaaagtcacggaatcaagctatgtgtccatcaatggttgattggataaagaaaatgttatatatctaaaccatgaatactattcagccataaaaggaatgaagtcatttcctttgctgcaacatggatagagctggaggccattatcctaaatgaataacttacaaacagaaaaatcagtaccacaccttctcacttatgagtgggagctaaacaatgggaacataaagatggaaataatagacaccagtgatgcccaaagtggatatggttggaggggattgatgcttaaaaaattacctactgggtaatgtccaatattggatgatgaatatactaaaagcccaaacctcacccttatgcaatacattcaagtcacaaacctactcacgtgcatcctgaataaaataatattgtaagatatattactcataattcctcaaaaataggacttaaacataaaacataagcccaacaggttgaaaatacttgcaaatacaataataatctacaactaatttgatgttattccagtgccttactgaatggcatcagggcttctgaaagtaagccctatttttgtttcctgaagcactttaaggtaagattgtcttttaatatgcaaaataataaaaataattttgatagttttcacaaaatggttgtgaggaataaatcaggtagtaaaatgtaatagcagcaaagcccagtgtgtggggaagtttttttttttaatttttacttcctatgtatatttattactggactctcagtaaactgaactaatcatagtacttgaaaaaactccaagctttctgctatattaaaagaaaaaatatgtgagaatgaaacaattatttgctccacaaatcaggatttattaataccatttttatcccccacttaatgatcccccacttaatatagagtaatataaacacaacaaggaatgtttattttcatatccttgagccctcagcttgattttctggcccaatttaatgttttatgcatttgttaatctgaaaatattatttaatatgtattatgtgtcaggcactgttataggcactggaaagagtttctaagatgatggaacatacatgtttgtggggatgacatagaacccaaaacatataacatatactttcaggtggaggaagtgcaatgcgttacaagaaagcctgctaagctttctgagggttactggagggagcattgtacatactatggtcagggatcaccaatctaaggagctaacaatttcagagacctaagtaatgttgaaggaagtagccatgtggagatatgggagaagtgcattacagacaaagggaacaacacatataaaagccccaggtgggaaataggttgactttaagagagtaagaaagtctgtattgcatccagcacaatgaacagagaggaacagttaggagaagagaaataagagcagtgggaagtaatgaaaacatgtagagcattttaactttgtacagagactgtagttgagagttgacaaaatattaaattaatagtgaaatggatcaaattaatgacagctgagaagaaaaggaaaacagtgatatatgttaccaaacatgaaatgtccaaaacatgaagacataaacacaggcataggattgaattctaaaattttaaagtgctttagaattgacaaattacatgcgaatgcgtaatatgctaagtctcatgagtttcacaggcataatgtttcagtcttgactcttgtgaaacagtgtttgttggagttgattacatgggaactttcccattggaatcctatttgtctctttttccttagggggtttaaataatgacagaatagaggaaagtctgaatcatggcagaattatcttcccacttacatatgaaggcataatatctggtaaaattgattttggccaatgatgacgtttaataatttcatttaagataaaaaggataattttcaaacaattaaaacaaagactgcagttactatgctcactggaaaatagcctcatattattaaatcaattggcatgatctcagttgtggaaagcttggaaggggacagcagcgttgtaagtacatggcaaagaaaataaataatagtgtattatagaggaaaaccacatgaaaggaatcatgaataaaaagataatgggggtaaatttaaatgtaactgacaattgcaaaaatagaaaatcacttgtagcatgaagaacgtagataattttataatatatttaatgagattttaaatttctcagtgttaagttttagacaaagttttaaaataaatattttataattcttgattataatggcctcttgactagcaagtccctgcatgcagcctttcctgatgttttaatttacctataaagtcgtacaaacacacacacacacacacacacacacgaagcaaacgaacatggttactgaaaagtgagagataaatatactagtcagtgtctaactggaaaaacacaaactattcctaggtaattttaagaggaaatgtaaaatggggaagtgtttacacgagtattagcgatattaaatcctgaattaaccaaatataaaaacttcaagaaaacctattactcttacagatgggagaataggagaagtattggagttacaggaaccttgaagttcagagaagtaccacaaattgaatattcatatctcctaggaaagggcttgtgttggtgctgctgatacctttaagcatctctattattttcatattctaacaggaagtcacttggtaaaagaatctgaaaaatgtagtttgtagaatcccaaccaaaactgctatcacagagaaaaatatagaagactagctttctatctgagacataacatgcaaaccatctattggcatactgttagaaaaaattttgatggaacaggactgttaagagactgtaggtcttactttataaataaaaacaagacaaaagctttatatatatattctctgactcttctctaactctgaggtataagatatagtcatccaaagtactgactttctaactctgattttcaaccaaatattcttgcatctatccatacccatttagagagagaaatttccagaaatcagaggagcagacaggtagagtatgacttgtccttgtgaattgtgttctggtaaacagagtagagagaaaggaatatctgtaggaggggcagaaaaaaaagcccctatagctatccaaacttaggattattatttttgtgtgtgtactccaaggtacacacaccaaaactagaatgagaggactattaattcactctgtcttccatatgagaataggctcgaatatcactcagaggaaacccaaagtaggttaaaatttcatccatatatgaagtcttttgggtgaggtaaaggcataatagatcttagcatctaaattatggacaaataagtacaaaattgaacaccactgtgattatggaaaacaccattgtgtttactgtgaagcaaggaaaacaaaacatagacatagagattcagaaaattatttatgccagaaaaaaaaaatttaaaagtcaccaaatagtgtgaaacaaatacataagaaaggctggaaataaagttttgtaataatgccattaaaatggatggagatgggaattttatcaagtatgtggacaatttgagtactatacaagaatacaaacaaaatgatgagagataaactgacaattggaaaagaaagaatatggtggtctaacataagaatgaaaggtattttccaggaagaaattaagaattgaaacagaggaagtaatcagataaaattttttctttaagaagaaaatagaagatatctgggatctatacagctgaatctaatattttaattacagctaaagaaagcttgatactttttggcccactgttttcttaatatattcaatgaactttctcatatgttagccactagttatgtgttactatttaaacataaattttaattgatctaaattaaatacaatttaaaaataaatttgtcagtctgagtagtcacatttcaagggcttaatagccagagttgccagtggctactgaattatataatacagatatagaacacattgattactacagaaagacctactagacagtgctgttctaagaaattatttttagaaaataaggagagatgctcttgaaaatttatgtataagaagagttatcttaagaggacatgttaaaaaattcattaatattgtactactcaaataagttatattcataaaaattataaagcatttaaacctataatttagaaaataaatttatcacactagacaacattcttatgataatatgtaaaaatatattaataattaattgagatgctttcaattttggacaagtaaatggggcttatattttatgtaattttaatatataaaatcgatcgatgttcgttacatttaagtggcaggattattcaactgtttttctttatttttttttcctttgatgtagaggaattatttatagtgaggcatgttattttatagtcagaaacacttcttttaaacaaaattagcatatatttgcatgtgatgctgataaactgaacaaaatatgtgacattacttaaaatagaattttgagatggagagggtgctgctcatggaaaagtggttctgacagaatcgatgaactgtcatccgtgtgcgcacctgcggcaactctgctggaggcttttagctgaatcccagcggtgaccttcaaagttgtttttaggtatttgcattaaaattttgagaaaaacgttcctttgtttttacaatacagacatgccttgttttattattctttgcttaattgtgccttgcagatgctgagtttttgaacaaatggaatgtttgtggaaaccctgcactgagcatgtattggcttttccaacagcatatgctcacttcatgtctctgtgtgacggctgggcaattctcacaatatttcaaacttttcattattattttatctgttatgatgctctgtgttcagcgatctcttatgttactaatggaattgtctcaaattgccacaaactacaaccacataagtcagataacttaattgctaaatgttgtgtatgtcattactgttccaccaaccacccattcatctgtttctctgcctctcctcaggcctattctatgagacacaacaatagtaaaattaggttaagtaataatcctacatggcctttaagtgttcaagtgaaaggaagagtagtgcacctctcaggttaaatcaaaagctagaaataattaagcatggtgaggaagggatactgaaagctggccgggcgtggtggctcacgcctgtaaccccagcactttgggaggccgaggcaggcagatgacgaggtcaggagacagagaccatcctggctaacatggtgaaatcccgtccgtactaaaatataaaaaattagctgggcatggtggcgggtgcctgtagtcccagctactcgggagtctgaggcaggagaatggtgtggacccgggaggtggagcttgcagtgagccgagattgcgccactgcactccagcctgggcgacagagcaagactccgtctcaaaaaaaaaaaaaaaaaaaaaaaaaaaaaagcaagcaagctgatataggctgaaaaagttaggcctcttgtaccaagcagccaagttgtgaatttaaagaaaaatttggtgaaagaaattaaaagtgttacttcagtgatacaaggaatgataagatagtgaaacacccttattactgatatggagaaagtttttaacagtctgtataaaatattaaaacagtcacaacattcccttattaaaaagcctaacccagggcaaggccctaagtgtcttcaattcagggaaggcgggagagaggtgaggaagctacagaagaaaagttcgaaggtagcagaagttggatcttaaggtttaaggaaagaacccatccccattaatagaaaagtgcaaggtgaagttgcaagtgctgagtagaagttgtgacaagctatccaggaaaactacctgagatcactgctgagggtaactacactaaacaacaaatgttcaacgtagacaaaaaagccttatattggaaaaagacatcatctaagattttcacagctatggaggagacatcatagactaaattcaaagcttcaaatcacaggctgactcttgttagaggccaatgcagctgatgactaaattgaagccaatttgaagccaattcagaataccgttctgaaaaccctgggggccttgaagaaatatgttatttctactctgcttgtgcactataaatggaacaagtcctggatgatggcacgtctggttacaggatggtttactcaatattttaagcccactgttgagaactgctggtgagaaaaaaagactcctttcaaaatattactgttaatatacaaagtacctgcttacccaagagatctgatgaagaggtgaaaggagattaatattgttttcatccctgctaacataacattcattctgcagtccatagaaaaaggagtaattataactttcaatattattaagaaatacattttataaggctatagataccatagatagtgattccacttatggatcttggcatattgaaacattctggaaaggattcaccattctagatgccattaagaatgtgtggttcatgggaggaggtcaaattatcaatattaacaggagtttaaaagaggttaatttcaatcattatgaatcattttaaggtgttcaggcttcggtggaagaaggaaatacaaatacggtagaaataacaagagaactagaattagaagaagggcctaaagatgcgattgaactgctgcaatctcatgataaaacttgtatagataaggagttctttatgaaggagcaaataaaatggtttcttaagatggaatgtacttcttgtgaaggtgctgtgaacattgttgaaataacaacaaattatttaaaatcttacaaaaacttagttcatgaaaccatggcaggcttaaagggaattgccttaaattttgaaagaagctccactgtgggtaaaacgctgtcaaacagcaacacatgccacagagaaatcttgtgtaaaaggaactgtgcaccgatgtggtaaatttcattgttgtgttatgttaagatttggcacagtctctttagcattcagcaaccaccatcctgatagccagcagccatcaacattgagacaagaccctccacaagctaaaagactatgacttgctgaaggttcagatgattgttagcatattttaacaatgaagaatttttcagttaagctatacatactgtttttgtagatataatattactgtggacttaacagaatatagtatactttaaacataactttatatgcactagagaacaaaaatattttattgcagtggtctagaaccaaacctgtaatttcaatgtaagtcttcacagtgttcttttgtcagcatggtacacaaagatgtacttacatataaagtgttctaatttttcatataaattgtaaataaatgtggcaaatgttcacagttcttaaattaaggacaaaagcaaatattatataattaagttcatcttttgttcatgtttatatatttatattttatatatgcatagtaatttctttttgaggtttgtcttaaatgagtaaaaagtgtttacatgagtgaagtgtgggttctgtacacgtctatatgactaatgttcaaattgtatgaatacccatacatatataagttatttatagtgtgaatatatgcattgtatcatgaaatatgaataagtttataatccatgctataaaatgatacaaattgtattactactttatagcattaatgtacacaaatatatttaatttaccaaaaatataaggtaaaagtaaataatatttttgtgaattttgaaacattgtggtgtgagaagcactagtttgctattgtggttaaggcacatttttatattagaatatattgagtttaaaaatagtacagaatgtttaacatattagcagtaatttctaggaaaaacctttatgaagtttagtataaatagaatataaaaaataattttaaaatgatgtgatcagtcatcaaaagcatctgatatataaacaataaaaacacaatcttaaactgttataatttacttggcttgcaaatattttataatataatatgtatacatatattatacatcaaaatttatttttgatgatatgcttttagtaacttattcctatgacaaatttggcaagtaaaaatcaaaattattatctaattccattaacatgcaaaacatatcacaaaattagtgaaaacctaatttgaataagcccacatttaaatgagaattgctaggtcatactaatcaattaatcaacctctcaatctagaatgtattgaacaaatgagcctcagcaatactgcttaatacttatggtccattaagcaagaccaggtgaatgaggcaatcaaaatattttaatagtgtatccgatcaggagatagtagaatactaaatgatctggtggttatttttaacaatatgttgtgctcttgagaagtaaatgaatcttggaggattgtcagctggaatccaaactcaatgtatcattttaaacagtcacttaatttcttgattgttttaacctgaataaatttaagactgtagcaattttagacaattatccaaatctaatgtctatggtcatttcattccatgaagatgaagtattatgtatagcaatgcttttttcaaagaaaaatgaattatacattagaaattatatgatcacttataataaggtattaaacaatgagaaatttactgtaaagatggcctagcattctaaaaaatgccaataaatatttgtcaaacactcttctagttgctcatttttagggatgatcaaaacagacctgaaaccagatgatgagacgggctggagcaaaggaagggagctcctttaattagggtaatcacagaaggcatttttgaggaagtaatagttctgttgacatataggaaataagcaggaatgcaatgaaaagagccatatgaaaagccttttagtctgaaagaataagaaatgcaaacgatctttatgagcatggagctagggatgtcaaagtgtaaaaataaaccagaagctggaaagataggccaaatacagaaaatatagagttttctgggatgtggtcagaagtttagatgtcatgctaaggacactgacatgccagtaggttaaaaatattatctgatttaaatatacactaaaaatattctgacttgctgtgtggagattgaagagtagaagcaagagtagaagcactgagaccaactatgaaaggttttacattgtctccattgagagatcttggtaacctttactgaggatgtcacagctgaattagataatagtggataagttcagtttatatttttaaatagaataaactagatctgggggctatgtgtgtggtagttgagtaagagaaaggaattaaacaagtatcttaatattttcctttagtaattaggtaaattgaaaatactaagagaagataaatgaacattagatagtatgggggatagttataaagcagaaagtgttttatttctgacttttgtatttaattcatctcttaaacataccctgatagggatacataagaccaacttctaaataagtcaattacaggaaaaaaaatttagttattggcatgcagatggtatgaagcatatttgatgctaacattttttctttacctccctggttttgtgatacctcactgaggtaagaatgtgttttttgaatgtatgattttggttttggatatgtgagtttcttcagcaaaacaaaaacaaaacatgagtagagatgacaatgtaccagttgtaagctgaggctttattagacatcaaatattttcactcattgggattttgccatttgtcatgagaagagcatactctgggtacctgttgatcctgaaatgaaaaacacatgaatcagacttcaacctagtcccaggcctaagtctttactctagccactcaagatttgtgagaaagacaaatcgttacagttctaaatcaccaaacttcagatgtctcaccagaaatactgttaaatatgtgtcatataaacaatgaattctaaataaaatcatctagcctagaatggagaaaaaaattaaagaggaataaggagtagggcaatctatcttttgtggtcgggtagagaagagaaaagggtagaaaaatcttgcaaaataccaaggatccaaaatgaaaacaaagcaagtgaacagtgatagaaatcaagataacttttttttccaaaaagtaaaataagacaacttcagaatgctaatgagaggtggagaaaaatgaagacagagaagttatttctttattatgatctcagcaagccttaatttacatagaagatatatcttccaaattttgcatgatttgaagcacataaaatattttagggggctcataatcttcaagtaggtttatatggcatttaaatcaagaaacagtaaagctgtaatcatttctggagatgtttagacatataagcacacatacatatatttggatggtaggcatttgccaatacaggaaacatggttcatgctgccagatttgacaaagattaaaacaatggttccaaataaaccggaatgttgattttcagtagaggaaaaatagagaaaattggtgattggtaaaaccatacagaatagttcacaacctaaattatcttggtgattaaaatatagtagagtgtttgccaagtctgcttgtaaagatgctggagtattagcagctgaaaagaaaagataacattttcttctactgagtttagagaaactttttttcagactaagaaatgtagctttcaagtattaagaaatataccatgagatttacaatatttttttccttcatttgtgaagcactagacaaatctttgtttacatctgtttctgaattccagtgaaatgaaatagcacagaagtcaaaaacaataattgtattagtctgctctcatgctgctgataaagacatgcaagactgggtaatttataaagaaaaataggtttaatggactcacagttccatatggttggggaattctcacaatcatggtgggaggcaaaaggtacatcttacatggcggcaggcaagagagaatgagaaccaagagaaagaggaaatcccttaaaaaaccatcagatctcatgaggcttattcactaccatgagaacagtatggggaaaactgcccccatgattcaattatcttgcactgggtccctcccacaacacatgggaattatgggagctacaattcaagatgagatttgagggggaggcataaaggcaaaccatatcaataattgtatctttcttcctctcatctataagcctccatattgatgtgatataatcctatagccttgggaaaacctctctgcaaaactatttttttaaactttttataggctcagatttttgcatttttatccttattgtttacatcaaaaagactacttgcgatttttaatgactgtgattttatttttaaaagtatcaccaaatccagaaaaagaaatattggaaaaaaaaattcactcttcattaggtacatttttaccatgtacctaccatgcactagacactctgctaggtagtgagggtaacactgtgatgataaatgataatatggcttgaacccagtgggtggtaattgaaacatgagggcatgtttttctcatgatagtgaataagcctcatgagatttgatagtttataaagaaaaattccttgcacatgctctcctgcctgtcaccatgtaagatgtccctttgctcttccttcgtcttccaccatgattgtgaggtctccccagcatgcggaactgtgagtccattaagcctcttttctttataaattactcagtcttgagtatgtctttattagcaggatgagaatgaactaatatagtaaattggcaccagtagagtggggtgctgctgtaaagatacccaaaaatatggaagtgactttggaactgggtaacatgcagaggttggaacagtttggagggttcagaggaagacagaaagatgtgggaagagttggaacttctcagagacttgtggaatggttttgaccaaaatgctgacagtgatatggacaataaagtacaggttgaggtgctttgagatggagatgaggaacctgttggaaactggaataaaggtgactcttgctatattttagcaaagacactggtgacgttttaaccctaccctagagatttgtagaactttgaacttgagagagatgatttagggtatctggcagaagaaacttctaagcagcaaagtgttcaagaagtgacttgggtactgtaaaatcattcaattttatgtattcacaaagatatggtttggaattggaacttatatttaaaaggcaagtagagcataaaagttcataaactttgcagcccaatgatgcaatggaaaagaataacccattttctgaggagaaactcaagttggttgcagaaatttgcctaagtaatgaggagccaaatgttaatcaccaagacaatggggaaaatgccttcagggcatgtcagaggtcttcatagcagcccctcccatcacatgcccagaggcctaggaggaaaaaatggttttgtgttccaggcctagggccatgctgctttgcgcagtcttgggacttgatgccctatgtcccaggtgtggctaaaagggggcaacatagagctcaggccattgcttcagagggtgcaagctgcaagccttagaggcttacacatggttttgggcctgcaggtgcataaaagtcaagaattgagatttgcatagatttcaaaggatgtatggaaacacctggatatctgggcagaagtttgctgcaggggcagggccctcatggagaacctctgctaggtcagtgtggaagggaaatgtggagttggagcccccacacagagtgcccactggggcactgcctagtggagatgtgagaaaagggccactgtcctctagacccaagaatggtagatccactgacagcttgcaccatgcacctagaaaagacaagacacaaaatgccagcccatgaaagcagcttggaggggggctgtaccctgcaaagccacagaggcagagctgcctgaggccatcggaacccacctcttgcatcagggtgacctagatggaagaaatggagtcaaaggagatcattacgaagctttaagttttggctgccctgctggatttcagacttgcatgagacctgtagcccttccttttggccaatttctcccatttgaaatgggtatatttacctaatgcctgtacccccattatacctaggaagtaactaacttgcttttgatttttcagcattataggtggaagggacttgccttgtctcagatgagactttggacttggacttttgggttaaggctaaaatgaattaagactttggggaactgttagaagacatgattgattttgaaacttgagtgcatgagattttgcaggggccagaggcagactgatatggtttggctatgtcctgacccaaatctcaccttgaaatgtaataatccccatgtgtcttgggaggtacagagtgggaggcaattgaatcatgggggtgggattttccgctgtccttgtgatagtgaataagtctcatgagaactgatggttttataaaggggagtcccctgcacatgctctcttgcctgccatcatgtaagacatcccttcgcttttccttcatcttctgccatgattgtgaggcctcccagcatgtggaactgtgagtccattaaacctctttcctttataaattactcagtctcagtatgtctttattagtagcatgagaccagattaatacaaaagaacacagaatttggcctcatttaaccaaagtaaaacagaatcaaacggaaatataaccatgaaagttttacaaggatgcatatatagtgctaaggaatatgatatgcataattggcctactttgtgaagtcacaggatctttgctcaggaatcaacaatgattgagttacagagaaaaatctgaattagatacatgggatagcagagaaaagtggatttgtcaggaacgagaagatatcacagtaagaagaaacatggtggcaccagcttaaagaactaaaaacggtcagtttgtctggataacaaaacataacagaaaacacgtgaaataaggatgaagaagaagtaagagtcagggtacacagcaactcacaacagaacagctaaacggaagtgattaagagtacagacctaaggacgacatcaacaatgatggtaagaattccaaaattcagtccctctacaaaagcaatgataaatttaacaaaacctgtcagaatcaactgttttaaagctctggacctctaatcaaaacctcacaataaataggggaatgtatgatgatgaaagaaactgccgaccagcctgaccaacatggcaaaatcccatctctactaaacacaaaaaattagctgggcgtggtggtaggcgtctgtaatcccaactactcaggaggcttaagcaggagaatcacttgaacccaggtggcggagtttgcagtgagccgagatcatgccattgcactccagcctgggcaacagaatgagactccatctccaataacaacaacaagaacaagaacaacaacaacagaaactgccaaatattaacaagagaacatatgacattttaacttaccttctatcatcttccagtctctaacttagtgctatttgtggagataagtggtctatattcctagtgtgtctagcttgtgccagaggaggcaaaaatgactgttttcaaagacatatgatgtgtgttgatatgtttggtgggttgctgagggattggatctgaagtttgcctttattgagaatattgcctagaagtattctcagtctaagaacagcaccttatatcacatttggcaaaagcatttatagcaaagtacactaccacagtagtctaggacaatggataccatccaggtcaagtagcagacagatgaaaaagcctcggaaagaagagactggggaaggaaattggcaggctgcttttcagggtccctccactgtggtaccagttggtccaccacatataagactgtactcaacctgggcagctttcctgtcttggagtaccagctcacaatggatactaggctctgatctcccttgctgcatatctgtaagtaatacattcacttaaggtaacttgtacacgagtgtcctgtctcactagactcagacaagttggtaaccagtgcacaatgaagttgcttgacaagatgacttgagtaacactacaaaccagacctaacagacatgcacaggatagtccatccaacaacagcaaaataccaacaacaaaatacaaattcttattaagttcacatggaacatcctctatgtattaggccacagcagtctcaaaatattaaaaaaattgaagtcatacaaactatctttagggatcacaatgaaataagtatagataaaaggaacaaaaaagtagagttcataaatatgtgaaaattaaatgacacactcttaaccaatcagtcaaagcagcaatcacaaagtaaattctaaataaaaaaatatgttgagacaaatgaaaaagatatacagtatgccaaaacttacagactgcggtaaaggagtacttggaagaaatttctatcaataagtacctacattataaaagaagaaatatctcaaatcaacaacctaatgttacaccttaaggaatcagaaaaatagcaaactaaacatgaaactgaaaggaagaaaataataaagattagagtggagataaatgaaatcaagaaatgaaatacgatagagagaatcaacaaaactaaaagttggttctttgaattgacaaacctttagctagattgactaaaaaaaacagcaggagagaatactcaaatcactaaaattagaaatgaaattgcagatggggacattactgctattttaacagaaataaaaggataaaaggatttataagaatactaaggaatacttagttctatgccaataatttatataaccaaaacaaactggacaaattcttgaaaaaatacaaactaccaaaaatgagtcaggaagaaatgcaaaatctgtccggacttaccataggtaaagtgattgaattcgtagtcaaaacctccccaaaaagaaaacacaagacgagatggccacactgacaaattctatgaacatttaaagaaagtttttcagataatatcagaaattttcagataatatcaatttttctcaaatagaagatgaaagaatactttctagctcattctgtgaggaaagtgttacccttaataccaaagtcaaacaaaaggaacaaaaattatacaccaatatatcttatggatatagttagaaaacttttcaatatatgtataatatatagaaaaatacagagaattgaaatataataatcaacaaaactaagtctaaaaacttttacaagaaaactaaaaactaattataatgtattgaaaatatttgaatctataatataatatataattataattatatagtatagcaaatataaagcagcatattaaaaatggtaaaaacattgtataccctcaccaagggggatgtatcccagaaatgcaaggagtttcaacatagaaaaccaatccacataggctgggcacggtggctcacgcctgtaatcccagcactttgggaggtcgaggcgggcagatcatgaggtcagaagttagagaccagcctggccaacatggtgaaaccccatctctgctaaaaattcaaaaattggccaggcatggtggtgggcatctgtaatcccagctactcgggaggctgaggcaggagaattgcttgaacctgggaggtggaggttgcagtgagccaagattgtgccattgcactccagcctgggtaactagagcaaaaaactccatcaaaaaagaaaaaaaaaaaaaaggaaaagaaaaccaatccacgtaactttaattgaaagagaccaaaaaactacatgatcaactcaattgatgaagaaaaaaataagatttgcaaaaatccaatgcacttttgtaataaaaacactcaagaaactacgaatacaagggaacttctttaacatgataaagagcatttgtgaaaacccacaaatatattatattcaataacaaaagatggaaagttttacctttaatatcaggaactagacagagaaatctgtttttaccactacactggaagtttaagacagaaaactatgcaagaaaaacaaagatatctctattagaaataaaaattaaatctatttatatttaaagacttcatgatgttatatataggaaattcttaagaatagtaaaaaaatctattagcattaatatgcaaattcaacatggttgtagaatacatatcaacacactaaaatcaattgtgtacgtatataccagccataaacaaatttttaaaaattaaaatctcaattccattgcaagaacatataaaacatttaaatatttagaaataaacttaatcaatgaataaactaaccaagaaggtgtaaggctcttacactctaaactgcagaatattactgaaaaaaaattaaaaaactaaataaatgaaaatacatcctgtgctcataatggactcattaactcaacaaaaagacaagcaaccaatttaaaaatggacaagggacttgaacggacatttctctaaagaaaatagtaaacaaatacataaaaatatacccaatatcaattgtcaatacggaaatccaaatcaaagccacagtgagatccacttcatcctgagtagaacaacaacaaccataaaaacctgagaaaaaacaagtatcattgaggctgtggaaacattatgaccttcatatattgtttatagaagtatgaaatagcgagaccgctgtggaaaagaatgttagttcctaaataagttaaaaatagaattactgtatgacccaagaattttattccttggtataaactcaaaagagttaatagtagttgttcaaatcaatacttttatacaaatttagtagtgctcttcacagtagtcaaaaggtagaaacgcagtcatccaaatatccatcggatgataaatagacaaaatgtggcataacaaacaatggaatattattcagttataaaagcaaaataagtggcctagtgcagtggctcacgcctgtaatcccagcactttgggaggccgaggcctgtggatcacctgagatcgggagtgagagaccagcctgatcaaaatagagaatcccatctctactaaatatacaaaattagctgggtgtggtggtgcatgtctgtaatcccagctactcgggaggctgaggggaaaaacaacaacaacaaccaaaaaaaaaaaaaaacaagaagtactgatacatgttgcaacatgaaagaatttcgaatgtgaatatgacatattttctgaattattccacaatatatgacatgtccagagtatgcaaattcagagatggaaagaagtttaatgattacaaggggctgagaagtaacagttaattgggtatgagttttctttgtgaggtgataaaacagaagacaccagtttatgtctattaggagggctattatttaaaaatacacatataagaacatgaaataattagaattatctgcactgcttgtggaagtataaaacgataaagccactgtagaaaatgatatggcagttcctcagaatattaagacataaaattgatgtatgatcatattgatatatgatcaagcaattctacttctaggtataaataaacgaattgaaagcaggaactcaaacaggtatcttaacactaatgtttataggagcattattaataatagacaaaagcttaaatatctgaaatatccatacattgatgaatgaataaacaaaatgtggtatagccataaaatggaatattattcaatcttaaaaaatgaaattatgatacatgatacagcataaatgaacttagacaacattatgctaattgaaataagccagacaaaaaaaggacagatattgtttgattctacttatataatgtataaattgaaattcatagagacagaaaatagaagagtggttaccagaggctgtgggaagggggaaataggcgactattgtttagtgggtagggagtttcagtttgggatgattaaaaagttctagtaaggaataaggatgatggtcacataacaacgtgaatatatttaatactactgaattatatgttttaaaatgggttaaaatgttaagtttgatgttacatatattttaacacaattttcaaaaatagatgcatccataaaaagtctatagctagcgcagtctatgtggaaacaaggatatccactttctccatttccatgcaacatcgtactggaggtttttaaatggtgaaataagacaaggaaaatacagaaaaagcactcagattgaaaaggaaaaaataaaagtattgactaatgacataattgtctatgtggaatatcctactaaatctattaaaaatactgaaactattacatgtgttccacatggttataatatttcagtaacattaaatatatagtaaatctgacaaaaatatgcaagacctacacatttaaaacttcaaaagactgttgacagaaattaaagaatatctaaataaatagatatattgtggtcatggatcattaataatacttttcctcttttacactattggcttttctctaacaatttgatcctaacagcttttaatcatggtgaaaaccctaccatttgaatcaatactttcagatattaattctccacaaattgatctacagattaagtatagtcccagtgaaaatcctagcaggtattttatagaaataggcaagatggttttataaatcatgtgaaaatgctacgaaaaaaatagtaatacaattggagttctaacactctctgacttcgagacttgttataatgctgtagtaatcacaagagtggtggtattggtaagagagaaagacacacttgttaatgacacagaatacagaatctacaaataatctagttacatggtcaattaattttgacaacagtgtaaaggcgattcagtgggaaagagcattttatcaaatgatgctgggagaatcagattgttgtttcaaaaaaagaaagagccagtcttaatccataccttgcaagatatacaaaaattaagacaaaatggattatagacctaaaagtaaccataaggaaagaagattcttgagagtagacaaaattgagcaaagaaactggtagaagaaaaaccaagacaacacaatttcactgaagccaaataaacagaattgacttttaaaaagaaaagaatgcttcattggataatgctgaaatgttttaaaagattaagattagaaagtgtccagtgtatttagcaagatatggaccatttgaacaactagtgttgcggctagataaacaaaaaagaaaaagaaaaaaaggaagcaggttttagacagtaatttttagaaaacaactttttcgttgagcaagagatttatagggagacagcatagcaaggatgttgtttttgtttgtgttatataacagtagagaactgagcatggaacaaaaaagagcttttggtcctaaagctcttaggaccaaattggtggagaaaagtcaattgtatagaaaataacatgtactattaataaacgaagttacagaaaaaaaaaagtggcagaatccggagccctttcgggaaattagacagaaagaaggttctctaatgtaagagaagacaagagtgcagatgggtgtggttttagattgaaagaagagagagaagttcatggatagtgagtttatactctttctaagactggagctgggtggcaagttgcagaaatcagaggagggtgaagaaaagtgaaaaaacataatgttgaagaaagtgacaatgagtgaaactgagaagtctcaagtgtgatatctggacagtttgctgtgtccattttagatatgagatgttgcatttactgcaagacaattctcctttattgtgaggtaatacagttttgtgtaattgcccagttgaagaagcagaataaagtgcacatgggtcttgccagagatctatgacacatacataaataatccacgggtcttaggggaatgtttctaaaataatcaaccatttaagtaataaggggaaatgaaaagaaaacaatggctgacagactgttagaaagtataggggtcaatgaactatgaaaagtgaatatttatacaataaccacttgagtaataaagggtagaatccatcacagacagcttgcagtttaaacaactgttcttctaataacacaatagaagtaatctaaagataaattaagtgatcaaatccttaacagaaggagtcacatttcttgccattttttactttcatgtgattttctcctagattacactgtgttttgttccataactggacagattttaaaatccaataaagaaaaaaataaaaataattggcgaatagcagagcatccagaatgattggtccaggtttagcaaccatctatgaggtcaatgtgttaatacaattacccatgtataatacaattattcatgcatacaattagttttccccccagaagattatttttatacaatgccatacattttaatacctctttttaactttaatatgagttgctaatcctcgtcccttaaaaatgttttcagagagaaaaatttactgtcttggttaaatgcaattatcaacaatgcaaaatttattttcatgtcttttttttcctagagagtctgtatttgaacaatgggcctatctcacatgtggagggcctcccctcatttttcacatactcctgagttacaacgttgacaattatttttctttgagtcatatcttttttcagagagtaaggcctgaaatttgtctggaatatccctcttttatatgagtagaaattttaaaatttgcagtagtaatatgcatgtcaaagctatcattgttttgggaaaaaaatatttcattgtgttacatggcatgctcttaattgtacaggtgaagtgatgttttacttttactggcagtatttaagaaaaacaaaaagtgaatatatatttcatactaggcttaataactgggtgatacaataatctgtacaacaaacctccatgatactagtttacctatgtaacaaacctgcacttgtaccccaaaattaaaagtatatatatatgtacttttatatatatatatgtgtatatatatatacttttatatatatgtatttatatatatatacttttatatatatacttttatatatatacttttatatatatattttatatatatataaagaaaatatatatatattttcttttcagacatatatatctgaatttctgttgctttttaagcaataatatcctgcatatgattatttttggcttatttctctgtgtattagatcagaaaaaataaaatatataaaaatcacacaattgtgtatgaatatatgcatgtatttatttgaatgaaatccattcattaaaacagttaaattctaaaattgttctatgtcgctcaaattccctctctgtggtgttttattaaaagagaggattggggagagactctttacctaattatgaaataatacattgtgttggcagagaaaatcatcatgatggctcaaagccaataaagtctgtatcacagatttcagtttttttcaccttgaccataaatacacaaatggatgaacagcaaaggataaatgtgctatcaaggtttgagaaagttataggtacaggcaagtttttcttctggagtgttgcttaataattaaatttaataatgaaacattgatagatatcctcttagtgaaaatacatcatctcctttgaaagactccagtcatgggatatatttataattccttaaatccttagttaccgagaaatatgcaactatgcagtcatatgatttaaaaacaaaaggcactctaaatcaggagaaagcaagtagtggtatgaatagttcccaagtcttgtggttgaaaaagatataaaggcttctcctgagattaagctggaaaactcacatagcaattagtgaatccaatctatatgccagtgtaggcaatgccactattgtgtgcaagaccatatctaagtgtttatatttctttttaaaatgttctatatttatctataaaatacactatgtaagtaaaaaagcaggtctgtagaagatatgatacattatattatatacagtttcttcagccttctcttttctgaagttccaagagacatattcctaatcagtccaagttgcatatgtctatgtttatgtctctgtatttgtgcaccattgcatggtggagctaccagaactgtgggtgcagatataatgtccaaaattaaaatataaatccttactacatgactacagagaagaaaaaagtaatatttgatttcccatcaaatcacgcatgtggtactttcggagaacaaatattgcctaaaaccactgtgatctactgtattaatggactcctcaaaagtgactactttcttataattaatctttcaattattttccaaaattcttaaagtccaaatttcttaacatgctctataataataaggataaaatctttttttatgcctcagtctcatgcttaaacgtttgagtagttttagatttgctgaaaagttacaaagattgcaccgagttcccatatacccctcacccagtttctcctcttattaacagcttaagatctggcatttgtcacaattaatgaaaatagtgatttattaactgaagtccatacttgatttagcttctgtttttacctaatgcctgttttcattcccatatagaatacattatactatttccaaattaggtcatattctaaggtactggaagttagaacttcaacatatgaatttgggtggggagtgataatttgacccataataaccctcaaggttctaggcaatcactaatcaacttataaactgcctattctagacttttcatataaatggaatattatagatactgtgactttttcacttagcatgttttcaagatccatcaatattgtcacatgtgtcagtactattagtctgctcctgtgaatttttcatttcagttcattaaagaatttcctttgtatttcttatatctgtatcttattgatattctccatttgatatgaaattgtcatcatgccatcctttatttaatcttagtgtcctttaattctttgagcatgtttttaagagctgctttgaagtcttttttggctaaatttaccatgtaggccccatcaaagacagtttttcttgtttgctttttcactgtgtatgggtcatattttcttgtttctttgcatgtgtcatatatttctgttgcaagtgggatattttcggtaatatgttgtagcacctatgaatacattacccacccctccatctggcagtggttattattgctgccgtttgcttggtcatttgtttgcatagtgatttgactgaattaactctgtgagggatattttccttgcagtgttttccctgatcatattttccccttatttttaatctttgagtctaatatctagaggttgtcccaggaagaatatagctatttattgttgaaacattttgcataagctctccttagccagttggagttttacccttttactgttggatatgtgtgtgtggcttggaggctgcaatcattatttagggagtttatgtcagtctcacattcaacagactgccagcttggaggttccttctcttattgtactttaaagggtgcagccttgttgggcatgtacagtcttccagaaagctgaggataagtgttattttatctttacgtttagcttctctagtagctacctccatgtcagaataattaactgttcagtcactgttttgctagaagttgtgtttaagctccttgtgtctatgaggtttctaccctgtgttgatgggtctgcatgtagcttggagaatgttttcattttcatgccttgacctgctcagattgctcctgagtgagggcaacccagcacatgcacacagccttccagaagccctgagttgactgtgatctccaaagggacatcctgggctgtctctcttcctgattctatcacatttccggctgctctgttgttctgtgtatattatgggtctactagcctcttcttagtcactgcccaccaagatcttcattatttattaatagtgtccttaggcatggaattctatgctttttgtaccaagtaaacccagtcatctcagacaaatctgcagagctctttgtcatacggccagcctctcctgtgggcagaacctcctgccacagcatcagagctgggtggagggaaccattttttctcaaagtggtactccggctctaagagtaagcagtggatggaagtggtgttattatttcctggtctttctggtttgttctttctatcaaggaactcctacattaccagggacctgggccacaggcaatcaaagtctcagatttctttgcttgctatccctgaggaggaacttcttctctaccagtgagggctatgtagatatcattagtttctatatattgtgaagtgatgtagcctttggagctctaattgaagatcaccatcatttctacagcattaaaacacatttccaatttgaatcagattaattgatttgtgattttatttaacatctcctttcttaccaatcactacagttgatactggaaatgccaagatgaataagacacacagaatgcaaagtatttataatccaatgtaacagatagatattaaaaagaaacacaaactatactatttatattgtcagttagcaggcataaatatgtacaaagtgtttgtataatatggagatgcctctgtgagatatgttgatgccaaagagaaacaatctcattaattgaatttccaggatttaaagatactacatagctagtgacgtttgatcttttaaaatttctgcaggaatttactaataaattgggagtagattgggtaaaaatgcctgcaagtaagaatatagaataaagtcacagaggaatttggagcatgatgtgttaaaataactaaaggagttcagtatggctaaagccatattaggggtgggtgaagaatattttaaggttcattaaagttttatctttgcagcattaaattgtcacagaaaccaagatgcattggctagcattgcaagaaaatattcagtatatgagcctaagctagatgttctgccttaaaatattggtggagaattttgtagttgtgctattacagaggatgtcaagatttcattcttcaacatggaaaatagtataactgatttactttgttcaagtttctcttaaatatgcagagaggttgtcatccttaatagtactgtgactgagccacatttaatctactggaagtaaattgaaataaatggaatatgtatgacactatgaagagttggatgtatacatgtgcaatgaaaatatgtggataaactgcataagacacaataaggaaaaaagctataacaaaagtagttggtatgaaggtttggcaatttttattctatagttatttcacatatcatatttctcctttatatagttcataatgccaagaggtacaagctgacagctacagtaggaaattgaagcatgaattaggtgatgtagattgtaattccagctctttatgacaatttttgccactctgaacaagtcgctaatcttcagagtttgagcttcaatattttaagatggcaaaattatgtgattctggtaatttacattctagattatttagcaaaattttccttgatttttgaattatgtgtgcacctcttaagtaacaaagcaaaatatatacattgtagtactttgtaataatcattattatgagtagcattaatttgttagtttggattatatcagcattgcttacatatgattaatgactctttaaagggaaaaaaaatcttgaggatcttaatattaccagaatttctattatgttacttaaaatgtacaaaaattttggcatatatttcttaggcttacatatgtgattctgctaatttacatgttagattatttaggaaaaatttccttgatttttgaattatgtgcacctcttatgtaataaagtaaaatatttatagtaatttgtaataaatattattagtagcattaatttgttagtttggattatatcagcatttcttacatatgattaattactctttaaagggaaaaatatcttgaggatcctaatattaccggaatttccattatgttacttaaaatgtacaaaacttcaggcattaggtcatattctaaggtactggaatacatttcttaggcttacatactcaattacaccataacctaaaattacaaagtaaatataaaacccgtaaaatgggtctggcacggtggctcatgcctgtaatcccagaacttctggaggccaaggcaggtggatcacgaggtcaggagttcaagactagcctgcccaatatggtgaaaccccgtctctagtgaaaatacaaaaaattagccgggcatggtggtgcacgcttgttttcctagccactagggaggccgaggcagaatctcctgaacctgggaggtggaggttgcagtgagccgagattgcaccactgtactccagcttgggcaacagagtgagactctgtctcaaataaaaaaaaaataaataacagtatcattttggcagatgatggtttgtggctaccaaatatatgcttataacacctttatggtactgacttcagtggtacagtttcttttacatttaataggtagaaactttcatgtactatgactataaagcaaagattttactgttttcctcaaagctaattactgtgaaactttcgtcacagcaacttaggaccacttttcatctttgcctgatgcaagctaagcatttgtagattaaatctctctttatcttttctttggccaatacaatgaatgtggtttctgcttatgtgagtgttcaaaaacataaattaaaatgaatatactgaaaatgattaagttgggtataaggtcgtagatgtgctgaagaccaattttgtttatgctctttttctttcacttgaatatattaacacgtttttacatttatattaaatacaaaatgaaaatctaaaatataagcacataatagagaactgggtaaacctgggtaatacatctacattttccaggagtaagcatatgcctttacgcgaataaacgaaagccaaataaatttgtataaaaattagctctgcactttgctcactataactgtttttgcatatacccagatactattcaaacatatacaagtcaggggcctcttataaagtctatcatcatgaacacttaggacactacttgaactacaaagtataaggaatgttttagaaatatcattacattttagaacattctctagagacttgaatagtataggtttgtatcattataactgaatgcagatttccagtagaccttccacactgatctcagatatctaaaaggagagggatttgtgccatttaggcaaaaggggattaaagaagtgacagtaggaaaaactgaaaataaagaaatactccagcctgggtgacagagtaagaccctgtctcaatcaatcaatcaatcaaggattgtggtagtgctataaaccacatttgtataattgcatgggcaaacagttatgcttttggtgtctgttcctcatttacgattctgataaataatggtatgtccatctaaggttattatgagatttaaatgagttcataagcaggatctgctgtttaggacccattgctaacattgaaatactgttatacaaattcttcattttttgaactagtaattatagatggaatgatgtatgggtatgcaagaaattgatatcatacagtgtatttggtaaaagaatgaacatttaactgattacagtgaatcatggcccattttggcaaaagaaaaatggtaaaaattaagacagtaaaaattactgatttgtgtttcaaatgatcacaaaatggtcatgtaaaaccataaagtacagttctctttcaattaccaagatttgttcatagtaatggctttaggtatatgtatatagatggaaacatttttcttttttaccaaagtttgatttcagaactttaaagtctaacaatgtgaatactatattatacaaaaagtagtttgctatacttttattcattttctattaattcctgttatattttttactctcaaatactattatgtaaagataattgccaaacaaggtatataatccttttaaaaatataatatatatataatatatgtaatattcaagataggcacaccaatacatgaatcaataatactagaatcactttttatccattttcaattaatatttcactgtcacttgtcagaagaaataatccaaagcatcatcatgattatattgaaaagttatctcattttgatctctgaagcgctgggtttgaatcctaggtttgatttttagtaattttgtgatcatacccaaattattagacctctttaatcatagtgttctatttctgaaatagaagttaatgccttttctattctttgtgtgtgagagagggagagacagaactaaaaataaagtgtacgaaagcacttttaaaaaataatgatccaccataatgttgttattgctattatgactaacatgataatcataatttatggttacattcttgaactcctctcaaaagaaaattaaaattcagagcaaaacctttccatatattgctggttttaaatcttattcaatggcaaaaggtaggaatagccaaatatttttatgtcctgttccacaaaatttcatttaaaagtattagaaataccaataaataaaacacccaaattttggtaacataactgaagatgaacaaatgctacaatgacaagtcagttacatgattaatataaaattacaatcatattaatatgcttaaaaaagttattggaagaatgataggatgacaaacagctgccatattcttctcattatagttcaaaaaataagagctgagaatatcataggcttactaaaattgagcttggctaaaatattttgtcaggtaatctccattttattgcccttaatctccattacatttctggtttaaaaaatgtgtaaaaattagtctgcagaatgaaaaactcatagacacaggccaaaacaagacatatcctgtcttcacagggtgatgctcattgtctcctaatcatttatttgaaatgagagcgtaaaaataacaattaccacaatttttaaattaataaagcatttctatatattattttgacataaatgaatcaataaattatagacaagaatcacccttcacatgtgaccaataaggtttacaaaaatatcttggtacaaattataatctggatatttttgttaactaaaggctagtttaatatataaaaattatctgaaagtataaactttgctaaatacataatgtaaattttcatatatttattctattcaattggctaatgcccactctaggattttaaaaattcttttaaaatttttgcctttaatatttttttcacctactattaagatgactccagataaacaagcagatataagcagaaatgtaacagaacctcattaaatgaacaaatttgaaaatcttcagaattttgtgggtttagaagctgggtgcaacaagagttgatattaaagaaaatggtttttgaaattaagatatacatatttatttgtgaaaggacaaataatattaaatgcatggctatgtttacctcagttgtataatacaaaatactaataccatacatgtaattctaatgggtaactttctaaacctcaaattactaccctgatgaatgttttactttgtactataagcagaaaaaaaatctgttaagaaactaacattaaacacctgtacagaaaacatatctgattttaaaaatccatgtatttgtagcatatatattttgattttttttttttttgagacagagtctcactctgttgcccaggctggagtacagtggtgccatctcagctcactgcaacctctgcctcctgggttcacaccattctcctgcctcagcctcccaagtagctgggactacaggcgcccaccaccacacccagctaattttttgtatttttagtagagacggggtttcaccatgttagtcaggatggtcttgatctcctgaccttgtgatccacccgtcttggcctcccaaagtgctgggattacagacatgagccaccatgcccggctgatttttttaaatttcaagttttattttaggttcagggggtacacttgcaggtttgttacatgggcatattgcttgatggtgacatttcaggtatgaatgatcctgtcacccaggtactgaacatcgtacctaatggtagttttttcagcacttgcccacctccttccctcccaaccctctctagtagctccctgtctctattgttcccatctttatgtccatgtgtactcaatgtttagcttccatgtataagtgagaacatgtggtatttgattttgtgttttgctgttaattaccttaagacagtggcctccagctacatccatgtcactgcaaaggatgtgattttgttcttttttatggctgcatagtattctgtggtatatatcaccacatttttttatccagtctaccattaatgggtatctaggttgattctatgtatttgttgttgtgaatagtgctgcaatgaacatacaattgcatgtgtctttttagtagaacaatttattttcctttggatatatatccagtaatgggtttggtggtttgaatggtatttctgttcgaagttctttgagaaatctctgaactgctttccatagtggctgaataaagttacattcccatcagcagtgtataagcattcccctttcttggcaacacaattttataacagatttttcctctgaaatatctacttgaaattcctgacagtgttttcctaaaacattttaacataaataaatgcataaatatttttctaattatttcattttaaatacaaatacttactaatttcactttacatggtagaaaatgactggttttgttaaatattttgaaattagacttacataaaaatggaagatcttatatatagttatttttcactgattcagtcttcttcctttcacattgttaaaataatatgttaaaagtaaaatcacgaaatagatatactcataaaacttacttgaatttaagtgaccattttatttatgaaagtcctctttgctagttttctcttttcttgtctgttacatataatgattgagttacagttacacgcatagcaacattttccattgtgcccctgtgttaagtataggcttttattctgtttctattctgcactaaagagtcagtagcaaacaagtttataaacatttcagagctggatgcataatcaaaactcataatccactccaacacccacttttttaaaatcaagacccacctaattttcttttccctctggtctaatttttacaaaaatttcattttgtaattatttataataatttatatctgcaatttctgctttgataaaactggtatgtcaggagcctccatccatgatatattgtatctttgcttatcagttaaaggagtccagaaaataactctccccttcctatgtaccatatttatggtttcacacttgatttttcctacaaagttggagggtatttcttaaagttctatatgtgattatctaaccttgcttggacagagaaagagtaaatcaggtgttagcttgtactttagggattgtcttaggcagaatattgactccttctgcttccctaacacttattaacgagtcaatttagctattcctaatgtgtgcatgcgtgtgtgtatttcagaacaatgtattatatatacaatttatatttgtcaattaaaaaatgagaatattaaaaatagtgaattagagaaaatattgtgcaaattccagcaaaattcctacagataagtttttaaatgaacatttaatttgattacctgtataatgactccattacactattaaaaaatagctttatgtgtaaaatttctatgtattttttaaacagctatattgagatataattcacgaactatacactttaccatttaaagtttgcaattcagtgattttagtatatttagaaatttgtgcaaccatcatcacaaatctaattttagaattttttttttaaccaggaaaagaatctattagcattcagttcccatctccccatctgctctaggtgatcaataatgtattttgtgtctatgcatttgccttttctgtatatttcttataaatggtaatgaccaatatgttgtctttgtgactgtcttgtttttagcataattttttaaggttagtccatttagtggcatgcgtcagtatgtcattcctttgtatcgccatctaatctttcattgtacagatgtaacatatttcatttatccattcctcagttgatagacatttggattatttccatttttaaatttttattaatgctactgtaacatttttggacaacttttctgtagatacatattttcaattttcttcagaacatggaagaattggaattgatgggtcatatgataaatttatatttaacattttgaggacttgccaaaatagtttccaaaattgctggatgattttacattttcactagcaacatattagggttcccatttctctacaacttaatggaaaattattgtctatatttttattatatttgatctagtggttgtaaagtggtagcgttttcaagtttagacttgtatttttttttaaatgactaatgatgtcaagtatatttttgtgtgcttacaggccactgctgtcttctttgaagaggtaactacttaaatgctttgctcatattttaatgtgtttatttctgtattgttattgaattgtaagtgttctttataaattctggctaaaagtaccttaccagatacatgattaacaagtgttttcttacattgtatataacaatatgatttgcaacaaaaaataaactgatttgcaacaaaaaataaacttaattttgtcaggcatattttgatgtgcattcatttattcattcacttgtttttttgtgtgtttatcatatcatttgtacttttgattttacaggtatacctcaaagatattgtgggttctatttcagatcatcacaataaaacaaatgtcacaataaagttagccattaagattttggttttctagtacatatacaagatatggctacactatactgtcaactatcacagcagcagagatcagagttactggtggcctgcccctctcagaatgaaactgtagtcctagaataggagttggggggtgaaggaacttctttgctttggagcttctgagcttttgtgacgctttgttgggtgggaatgagggaggaattaagggaacaatcaagactcaaataccacagactcttgtctctgattaccataaggttctaataggtgtttctcccttttttgtatgccatttaagacaatgtcaaagactttatttttttctttttttataaataactttcagcagttaaatttatgttcctctggtgagaggacatgctgagcaactcttaccaccattttggaaatcttttctagcccaatcaacatagcgagacccccatttctacagaaaaataagaaaaaaaatagccatgtgtggtggcacgggcctgtaatcctagctactctgtaggctgaggcaggagcatcacttgagtccaagagttcgaggctgctgtgagctatgattgtgccactgaactctagcctaggtgactaagaatctgtttcaaagtaatttgtttttaaagtttgtatttttttccattttgctagttgtattccaaataaaatagtttttgaaccaataaagataagttcactctttatcattgtcatagtcctcttctctccatcccttcatctgagctgggcctattgaacgctcactctgataaatggcaatggttagagttgaaatataagagggctgaggcctctccctaaggggcttggagattttccagttaggcttgtttttgtctttttaaggacacatgaacagattatacaactttttttgtgaatagtatttattagaagaggtcattggtacgatatttcttttagtcgtttcacgcaaattattttatcttattttccctaataaagtttaattgctgatacaatttgtccatgaagattggctaggggtaactaaaattcactttacctacaaattaaattagcacataagttattctttaaaacctactagaaatgtctccctaaataatgtatttgttcctattgttctcttattcaaaagaatcatgctgttctaaaataattatacttataccctaatttctaccttaattatccgaactatttatttatttatttatttattatttgagaccaagtctcgctctgtcgcccagactggagtgcagtggcgcgatctctgctgactgcaagctctgcctcccgggttcatgccattctcctgcctcagcctccggagtggctgggactacaggcgcccgccagccctcccgggtaattttttgtatttttttttttttttagtagagacggggtttcaccgtgttagctaggatggtctctatctcctgacctgctgatccgcccgcctcggccttccaaagtgctgggattacaggcttgagccaccgcgcctggcccgaacttatttctaccatggcatctatctttcaccaaagttatactgaaataccatccaaaaatgtgtttatttttatttctatatttatgatctttagacacactaatgtctaattcgaaagatttggcttattgtagttccactattttagcacaaagttaatttaaatatttgaaacaaataggacataaaatggtgaaaattgtactgctgctcacattattaaatgttttaactattagaatattcttttgctgtcattttgaacagtactagaattcaatacaagtttatcagatatttagaatcatcccagcatattacatatggtgttgctaaaatgtggacttaaacctattgcagcagctcagagcatgctcacaaaccaatatgtaaataaagaaaacgtaactagcaaatggaattctctgattctgttcagtttgagaaggaaatatgcaatgggagggatacatcaagtacactgattttctctacagattacctatttttccaaaaatgtaatcagtttttatttatctatgcttcaaaaaatagcactaagatggataattgcaatccaggattcaggcaaattaaaactgtatttcattcataattattaagttacatgtaagtcccatacatgtaattgtataacacaaagatcatacaatagctctgacttcaaaaaaaggctgccacctcagcttattattctcatatcaaggcctttatattgatgttctttctcagttcttgtgcgtttccctgaactaggttttcaggataacaaaatctgttgtttttcttctaaattacatttttactagtgttcagtttaatctaattgcaccttctccttaaaaaaagtaaaaaaaaaaattgaggtactagcaggatgtttagatatttatagcttgttttatttgaaaaatcttggataaacaacaacttttttgttgtttctggtgtttgttttgtgttatcatctcagtgacactgaggcctctttttctggccatggggggaagatctctcaaagagctaaataatatagaatctatttaacaatataatttagtttatttttaatttctgaaaaatctactttggggaatactgcccttgacataactggaacctgccccaccaaccttgttgtctttctattttccttatattcctattatttctccctagtacagtagacaggaagggcaatcaaatgcaaaatagcaatgtgaaagatacacaaaatgatttttctcattcaatcttattttggttgttcctaaatggtactatgtaatagcaataattatcacatggtgtgtttactatgtgtcagtgtgtgtactaagcactatgaatagattattgcactgattcctatactcaccttatgttgtaattactatcattctcagtttgcagttgatgaaactgacatacagagagtataggtgacttttctgcctatattgtgaatatgaaaatgtatagggacaagtacacatacatcaagaagactgaatgcaaataaaagtttgttgaataacacaaggaaaggctgttaatttgtaacattatttaattattcatgtcttatggtatgccagaggacaaaatcaaattaagagaactttatttgggtttagatttcaatttaattttctatccattattacaagtatatccacaaggattcaatgtgcctaacagaagcttggtggtcactgggaaaagagccccccatagtaatatttttttcctgtctttttcctgcctttaatatatcctcccatttgctcatattgccttttctaaatacatctgaaacacggtatgttttactgtagtcttctggtattcagattggaaatacacacacacatgtatgcgtgctcgctcgcactctctttcatacgttcttcaatcaaaaacttttaaaacaacaaagaatggctaagcagataatccatttgcaggccatctttaaaagctattatttcagttcttgctttttcattcactgtgtccttgtgacaaacatattttcaagtacattcctaaagtaacaaacataaggctaaatgaaaagcctagaataaactcagaaatgaagagaataaaaaagatctctatttctggtattgttctctcaatgccaggtctcatggaagaacaatataaggtgataaagtaaaaaataaacaaatagttcatagggtgattttatgttttaaaatatgtatttcaaagcagattcattattgttttaactaaggcctgagtaaactggagacaggggcaaatgaataagctgtatcggtccatgataatcatctttcttatcactctctcttgctcactcgggtccaaccatatagtccctttcaggttcatgaatacaacatatgctcacttgactcaaggattgtttatgtgtctttccttccagatatcaattttctcattatctcacttccttcagatcacttctcaatgtcaatttatttgagaagtttcctctgataactttctatcagataggacccattcctatacctaatcttttaccctgctgtattttctcagtaacatctttttattcctaatatataaatattcattgttttgcctactatttgttgctctagcagagtgaaaccctaacaggcattgttttatcttctgttacacctccaatacagagaacattgcctagtatatgacaagaactcataattatttgaagagagaataaagtaaataggggagaaaacatattctctttcaatgatctcactatgcattctaacctaattaccagacaccttggcaaatttgtaaaccacagaagaaaatagaaggattagaatgcattacatttctttatgtttcctgtctcactttggctagaatcactccaaattatttttgtccatagcctatacacaattatttctttaaaattgggtgttcagtcactaatattgttctatattggaaagaaaataattcaaaatagtatcagaataaaatttgaccaaggttatctttaggctttacaattaaatagtttgtgactctctttattttgcttattttggaaaaaaatgggcctttataaaacctgtataatacattaaagaccatacatttgtgattttagattgcttataatttcccctacaatttactctataaaaaagattatttaaaagaaagaaaagcaaaagatactcagattgttgttggttttttttcctcctcagctggttttggctgctcaattttaacactccccagagagctctcagacatttatgtgatttaatggcctactattattaagtcagaaatattttattttacattgagattgccataaccattgcattaacatttgagtaataggcaataacactgagaatgtatcaatgtatcatttagtgaattaatctgtattcccttcctaggacttgcttattgatgatgcaggataaatgtaatagtaacaataagtcatcaaacattctggcagacctgtcaggaagaggagatgggggtgcatggaagtgagcttgttgagagacagttcaatgcagaagaaatgacatatgtcatattttccccacagtgaaatgatagagtacatggggatagcttagtgatcagcaatgtgtgcaagttttgtttgcctagagcctgtggttgtgtttctggttaccctatgtagcaaaataataatgagttaattgaaatagcaatcaaattctgtaggaaataaatcatctagaataaaagaaaaaatgaaaaaattagaaatcacatttaactgtaaataatatctcctagctgtctatcagtccacaaattagggtgacgtatattcaaggcagaaaaaaaaatagatttgttgtgcatgtacaggaagaaaatattagaacttccatttatatgcatatttatctaaacataagaaaacatggactcattttcattaaagtgtgtaatattcagattgatatgtatgtgttcatggtatgctgtgtacaagttatcctgaagaagaataggaggtcctataataggcaagtttgccaatggctgccagactcctttgtggagctcagactgttaatttcagtatactgtgatgttgagcatatccaattaagttgatttaagaatattttctgggtttagtaaaatgtgtcctataaaactgacaagtgaaaaaaaaaaaacaaaactcaaaccaacatgaacaaactgtggaataaaatgagagtaataagaacaaagtataaaagaaaatagcatcactgatatttttcagagtataactatctaaaccatattatgaagaatagtagtctaatatgatgaacaccaacccccaaaagctcaaaatcacaacaatttaaaatattaatatttacctggtttcattaatgataaatcagaacttacacactgtgttttaagatgtgaatggctgtataaagccgtgaaaataaataagacattccaaaattaagcatcttgacaatgaagagaaccaaaatttttgagaaacatctcaggtcatgcaactcccagtccagtatttcatgcaaggtcaccaaacaaccctaaagagttagaattttattggaaaaattctcacttaaatagcaaaaggcctaaatccacaaacaattacataaatatccttttttttttttgctatggtaaaagtggtttaaacactatcaagaaaagaaaaacagaattagaagtctcttgtctgcgaacacaaaaataatgtataaaaattgttggaaatttacaaagcaagcattaaaacacatttattgtgtgaaacacttttttctttgaatttaaagtacatatgctgcttctgtcataatatagagaaaaccattgaatgaaagatgcagtggagaagataaattataaaagattgcccacaggagaaataatgtacaacttaaaagcacttacttcattaatgataagcaaggtaaacaaggtactgcagcaaaaaaggttaataactggaagcatcactggcaatacgtggtttcaatacttgtgttgttggtgaagagacccgctataccagaagattgtgcagaaatccgtgtaagagaggttcaagcattgggcccggatttaacaaacgtaatggaagaggtcaagtttcagagatattagagaagcaaggctcaaaaaatgtgctggcagatagtatgtggaatatgtggaaaatattgaaattgaagatgatacttagattaaaattttgtcaagtgcaactgaatggatgatgataccatagttgctttcggttaagagcatcaaatcaaacatactaaaactatgctctattatatgcatgatgaagtctggagagtgttctggaaaatccagcaaagtttaaataaatattctttcatagtctatacatttttctatttaagttcatttggctaaaaaaaaataagtctaggttatacctattaagtgtctacccttattagctgaggggaagagacactatcagttggtattctcctatatttatgaggcagctcctgtaaaacaaaccactgatcttttatggatcttcttggggttactagtgagcagagtagattttgttcaccaaaaattctcagaagaaatctaacagtaccttaataaagctgacttccaaggtcaccactaaattaaagctaaaaattaactctgttctatttttatcccaacttacttccaaccatattcagaacctggcctcaaaaaacattctcaaggagataaaatgacattataaaaatattctcataatgaaaaacttcaacaatacagatgaccaaatttgaatataaacccatgtatattatcaaaataagagatagatattttaagtccaagagatatatccttttgcaagttaaagaaccaaaacagtaacatccaaaaaaaaaattaatctaccgtaagttagaatttgcttctctgtggaaagacttaattctacaataatgctagtcctcataccttaatgtaaaatttagtgcaattcaaattataatcccaatgagtttattctttttaaaaggagattggctaatatgattttaagtgatatgaaaaaaatatccggaaaatagataagaaaaatataaataacaacagaaaaaaaaaaaaaaaacaggagagcactggccttaacacatatctaaacaagcaaaaatttgtatgaatagacaaatgtacacttttatagcattgagaatccagatataggtagtgtcaagtggaaataattaggaatatttaataaataaagacaaaatttatcttccaacaaaaaaattaaaaatgaatgcataaacaaatagcatcaattttataaaataaaattaattacaaaatttatgaaaagtaaactacactagaaaatactgatgtttgatcaacgtatgtaaaataaactataaaatagtggtatatttttgagcaatttattacaaactataaaaattttaattatagagaaaaaattattttcaatatttttgaagatgttataagttcctaggatttccaaacaaaaaaaaacaacaaaaatgaaatctatttatttgtgggaaatatataatcaagatagagacactgttgtcaagataacaatataccaactctgattccagggaagatggaataatgacattccactctactatttctcactgaatatagctatagaaagcctgcagctgctgtatgaggactgactcaagcaaacagtagcaggtaaaatgggtagaagacccaaatgccagtgaatttaccattttttcccctcaaatatccatagtctgaacgcaacgcttcagaactggccacagatggagttagagagtgatgggagaactctggttctgactcaaagagtgggaaaggagactcccaatgcctaaagagaataccagattccttccccatcccagcctccctgtgccacatccctttttttgttgtttttgtttttctctctttttctttgtaccagccttaagcaattccgtcatgctggtggtgatagccgatggtgacaaaagcttatagtagtcaaaattatgagggaggggaactttcctttctgtttgctacagtcatttttccagggggtaggggcgactcctattgtttttgttttatattgccttttcttttgcttcttgcatcagatggggatgcagtcatggaagtgaagagcagagtattaaaccccaacttcctggcaagaggtctaagtggaaagggaactggagtgcacaggggagatggcagagggaggagctaagcaaagtgaccccatcacatttttaataaactcctaaatcacccctgtgttgcacagatgtggatctgattttattcagcataccaaagacaaagaaaatatagtaatagaccaccaaccacatcacagattgaccattgatggcaaacacttaggataaatacaaatacaaacagaacaaaggtttgaaaacagaatggacattggagacaaggctcagggaagacattggaatttgtgacctgaaactaaacaaatcaactgcttgctaaaataaaatgcatatatcctcaataggatttaaataagatccagcgtctcatatttattatttaaaatgcctagggtataatctaaaattattcaacatatgaagaaccagaaaaatatcaactgatatgggaaaagccaatcaatagatgcccatgtttaaatgtcgaatttatctgacaaacactttaaagtagctatttttaaatgcccttgtaaataattgagaacactactgaagtcaatggaaaaatacaaagtctcagcaaatagataaaatatataaagaagaattgaatgaaaattttacaattgaaaattgaaataactgaagtgaaagttttcattgggtgggttcaattcagaatgaagatgacagaaaagaaaagtcagtgaacttgacagcagatcaatgaagattatccatctaaatagagaattggtgaaaaaagtgaagagagcctcagacctgttagacaataaaatttctagcatttgagacatccctgtaccaagaaaagagatgaaagaatgcagtactgaaacaaacaaaacaaaaaccttgaagaaattgtggctgaatatgaccccactgtgctaaaacacataaatccatagattcaataaatacagtgaaatctatacattcaaaacaaaacccttcagacacatcagaaggaagctgctgaaagctaaagacaaaaaggataatatagcttgagacatttatactgtagctcttgctgttggactcccacataatatatctaggctctaatctattccaatctgccagaaaggctttgaaataattttcttattcttcttcattaattccagatgaattatcctggtgtttgttttaaaagaatgttgtgttgtagcttctgcctttttgttaaattgaaatatgtgaaaataaaattaaacgcccactgaggtcatcatactctacttatccaaggtgattttcctttaactgttttatgacctagcagaaaaatattaacatactgtaatttttatatatttgaattatttgtaaatgcagtgttctgatgtaatgcataagactgagatattttataagtcatatacatattattgtgaatgacatccatcattgaaattattctaaaaacaatattttaatgaaattactctaaaagcaatttgcattgattcagaaaggtcttcaaaatagaagtcactgtagaccatagctatatttgagctagattcataaaaatacaagcaatagaaagttaaagttaatagagtgctacttcaaaacagtatacatggatataagagtacacattgtaaatggaaacttttttctttttattacgtagtgacttagtcaaactctaatatcctatctttttctgatttttcaggcatttcccccaatacaatataaattctactgtatcagactcaattcttagtaaagcttaatctcattgaaaatattaagaggatttaaaataaatcttaaggtaggaagcttaaaagtgctttatatctataaagtcatatctataaagtcacctaagaacttcaaagtttctaagaaggcttgctaaaagaagtctttaaaacatatgccgagataacatagcatttattttgatacacagatttacttttatctcttagaactttttcaaatcacctgagcagttgagtattgctcttttataactaatcccttcccgcacccacacaccctgatgtatatacagaccagtgcacacatagaaaacaactggcttgtgtattgatttaatgatgagatattttgggggataaaacaggtatggttaaacacatctactaagaccactaatattccgactctatttcattttgaataaagtgaagaagatcctagttaaagtgtaagaacaagtaggaaattcaatttacacaggatggagtggaagaggtaattgtacttgaatggaatagaatgttaattatgaaaagaaaaattactgcattttgaatgataaataactttctaaatttcagtacaataaaaaattgatagacacagaactgcaaatgttagattccaaagttattgtggaaagattaatttggttacacatcttttaaaacaagaccatagtaaaatgtggaattcagtatagattttcatattctaaggagcttcccaatttattactgttcaaaatagtggaaagttatgtagggctgttaataagtggatgtttggtgccttgcggaataatgtttcttctaatatttattttcatatgaaatcaaagacactggtaatttaaaatgatacacaaaaggaaacagcacatttttacagcataaagtaacattttgataaaagtattaatatggctccattttcacttttgaaaaataaacatgaatttacacatttttaaataaaccatgctcataatgttcaaacatatcacttgaattagttcaagcaaaataactgccattgaaatccttatacaaataccagtgatatttttcacagaaagagaaaaaataatcctaaaattttatggaagcacaaaagacccagaatagccaaagccatcctgagcaaaaagaacaaaactggagatatctcattacctgacttcaaattatgctatagagctattgtaaccaaaatagcatggtaccggcataaaaacaaacatagaccaatggaatagaatagagaacacagaattaaatccatacatctataataaactcattttcaacaaagatgccaaaaatatacactggggaaagaacagtatcttcaataagtggtgctaggaaaattggacatccattttcagaagaatgaaactagatccccatctctcaccataatcaaaaagtaaataaaaataaattaataacttaagtcataaagctactaaaataaaacattggggaaacactccaggacattgtctgggcaaagatttattgagtattatcccataagcccaggcaaccaaagcaaaatgtaaaagtgggataatatcaagctaaaagcttctgtacagcaaaggaaacaatcaactaagtgaagaaacaatacacagaatggaaaaaagtatttgcaaactacccatctgacaaggaattaatatccagaatatataaggagctcaaataacaggaaaaaatcaaataatcaaattaaaaattaggcagatgatctgaacagacatttctaaaaacaagacatataaatggccaacaggtgtataaaaaatgttcaacatcatcagagaaatgtaaatcaaaaccacaatgagatattatctcacctcagttaaaattgcttttatccaaaagacaggcaataacaaatgctgatgaggatgtgaggaaagggtaacccacaagcactctcaggaggaatatgaattagtacagccactgtggataacaatctgcaagttcctcaagaaagtaaaaataaatctaccatatgatccagcaatcctgtgctggataaatattaaaaggaaaaaaatcaatatatcagagtgatatctgcattcccgtgctgcttgcagcactaatgacaataaccaagatttggaagcaacctgcatgtccatcaacagatgagtggatagagaaaaggtggcacatatacacactgaagtactattcagtcataaaaaagaatgcggtcctatcattggcaacaacatgaatgaaactagaggtcataatgttaaatgaaataagccaggaacagaaagacaaacttctttttttttttcttttttttttttaattaaagttttagggtacatgtgcacattgtgcaggttagttacatatgtatacatgtgccatgctggtgtgctgcacccactaactcgtcatctagcattaggtatatctcccaatgctatccctcccgcctcccccctccccaccacagtccccagagtgtgatattccccttcctgtgtccatgcgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggccgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatttaagtctctaatccatcttgaattgatttttgtataaggtgtaaggaagggatccagtttcagctttctacatatggctagccagttttcccagcaccatttattaaatagggaatcctttccccattgcttgtttttctcaagtttgtcaaagatcagatagttgtaggtaagcggcgttatttctgagggctctgttctgttccattgatctatatctctgttttggtaccagtaccatgctgttttggttactgtagccttgtagtatagtttgaagtcaggtagtgtgatacctccagctttgttcttttggcttaggactgacttggcgaagacaaacttcacatgttctcacttactgtatgaggtaaaaatgaaaacaattgaattcatggagatagtgagtagaatgatggttactagaggctggaaagggttgcagggaaggagaaaagtaaagatggttaatgagttcaaaaatatagttaaaatgaaaaagatctagtattgatagcatgatcaggtgactgtagtcaacaagaaattattgtacattttataaaaactaaaaaagtggaattggaatgtacctaacacaaagaaatgataaatgttttagacaacagatactccctttactctgttgtgactattgcaaattgtatacctatgtcaaaacattacgtgtaccctgtaaatatatacatctaatatatacccataaaaatttaaataaagttttaaataacttttaggttaaaaatgcgaagatattaacatggatatcattttccagttagtgacagaaaaaaaattgttggaatttaaaagtggggggaaaaatccactgacaatagacaaagcaagggaagaagagttgaattagaggagaaagcagcactttccattcaaagtaatttgatccaaaatttccacaatttccctgtgatataggtaatcttctgagaaaatctgcattgtatattgtgggatacaggattcctgtgaagttttgattattgacgtatttaacatttgtatattctatcgtgcatggtagtttaatctcaaaagagaaaaactgtttccctttaaaagttgatgtagtatatgtcacaagctgtggggaagggggagagctatgtaatccaaccaacaaataatttcaaaggttaggaaaatgtctttcttgcattggttaaaaactaataaaactcctatcagacattatgagagcaagattgtctggttctagtacctacagagaaattttgcggtggaatataaatgaatccaaacaggtatgccactgcaggagatacaatggaatgtatactcagagtttctcaaaacacaaatctaccatatgtttaaggctgaaagttaaagtaaaattttctggtttttgaccatttgaaattaactaaaattggtaaagcatttgtgaaatgacataattgtgaaatctcccataaaagtattttttaaattttggggaaaaagaaaaattgatacaagtaggaaaaccctgcatgtggaaatgcaagctggaggggagtacagaagaaaaaataaataaacttttgttacttctgaatatctgataatttccagatctacgcaagatgattaagaatgattacagaaatttaaatattttcataaagatttaaaatgacaaatcctagatggtagacattactgaggtcttgtgtctcttcctttatacatatacctattgaagtaagttgagactttggtcaatgaaaagtgaaaggaactggtgttggtcatttcaggatagaagcattaaagagtcattgctccacccatgtcctcttcttccctcctggtggtaacaaatgaagttgcaataaactgaaacagctggaaatacagagtgagtcattaggtagggaaaaaaactgcttcagagattcctgcagttttgcagcaaattttctgtaacccagaaccaaatgtcttcggtgttaatcttctaagattttgtctttgtgcaccacagtataacatatcctatcctgagagagacattgaataaatttaaaaaaaatggttgatgtgtttttatacttgaatgcaaatttagatagtaaaattgccacttaagaattacaacattaaatagatgaaatgttgtatttcagatgaaaaatttatctgtttagaaaattatacacaaagccaagattattggtttgttttgtttgtttgtttttcaaaatcttctttggctccataggactgatcagtaaaaatgataaatcttcacatggaatttaagacctaactcgacatatctttcaatttctatctgatactagtgggaatgtactcctaattttcatgtgcttgaaaattcaaccaaaagtacagaataatgaaaaatgactaagacccaggatacatagtgacactccagttctgcctggagtagaaactgtctttggacagctcatgcaatctctctcaatttctcatctgtaaagtgaagtggttggagagtagaatctctttaatttacgcaatatattagtccattttcatactgctataaagaacggcctgagaccgggtaatttgtaaagtaaagaggtttaattgactcacagttcagcatggctgaggaggcctcaggaaacttaaaatcttggtggaaggcgaaggggaagcaagcaagcttcttctcaaggcagccaaaaggagacgtgcctagtgaagggggaagagccccttataaaaccatcacatctcgtgagaactcactcactatcagaacagcatgggggaaactgtctttatgatgcaattacctccacctggtctctcccttgacatgtgggaattataagaattataattcaagatgagatttgtgtggggagacaaagcttaaccatatcactcaatttcaaagacctgcctgcagatgcctgctctactttaccacacaaaggcttttatttctgttgtttcatttctctgacctatctttttcttattattatttcctagaaacatcttattgtttctatggtttatcaatgtttcaagtacccaccacaatgccactttttccataaagcttttcttctctcattaaaattgtctttgtttgaattatattacattatcactgcctcttgtagtgtttattttttaatccatcaattattttcatattttgcctattcaatatattataaatttataaactgtgaaatacacgtttaagattgaaatacacatttaagattacttatatgtcacacaatatccaatatggcccttttatgttgtatgtgctctaaatacacttttaagaacaatgggtaaaaaagcacaaaaaaacacgaggacaaaaataataaaagagaaaactgaaacatggcttgtagagaattattttcctataagaacttattagaaagagatcactacctttattctatcaagatgaattatttgttctttgactctattaatccattttccaaatattacacttctatttactattttcttgtctaaaacctaaaagcttttacttaatctaggtctcagagttactaagtactatcatcattgtttggagcgactttacttgggggaactttgcacttcactgatctttaaagagtggagaataagaacatttcagaatgcattacgaacattttaagagcagagaatgttatctatgtcactcaggttctgttggattatctcacacaatactgattgtcacagtgtggaatcaagaaaaaagtttaatcaatggttattttttaaactgcattttgaaaggacatatataatatgtatatttatacatatatatttacattcacatgaatatatatatacacacacaaacatatatatgtctgatataatttttacatctcatccaaatatatacaaagtgagcagaaaataaggaaaaatccatatctgtctggtgtgcatgtgtttaccactcctctgttgttaagcagcaaatatcaagaaaactcttaagttgcttgtgtttaataaaagactgacatgttccaagcaatagtaaactcaattatggtttgcataatgattaacaaagtgttattctcacacactgatttatttggtattcacttaataatataaaacagataaagcaactatgtatagataaaaaataagaagattgtcatttgtctatgatcaaattgttaaaaattttaaggtcatggcttgagcctaagttttcttattctaaatctatactgctttgtttcttcaatcataagtggtatgtcaaaatttttccacttggaaaattttaactgtattttttctttaatcctttcaatagttaactttatttgctcattaaatagagttgttttaccagcatacaaaaatgtttactgttttctgtctatgaaacagtctatagctgttctgaaagcaccacgatattatttgaagaatttgcttttccaattgaacaaggtctactaacattatatttatggacacgttcctcttaggccagtggatcaaactattcaatcaaatcttccctccttagaatataattcttatcagagatcaaaagagaaaagtacactgatcatgttgagatttatcctgtatcccatccctaaatctctgcacctgatttagttctaaatagctcccaggtgctttttcctagctagccttctgttaattctgagaactcattatatctttccagtaacatacctttgattcaattagccagtgatatttgtgttacttcttactaaagaatcttggtactattggtcataatcaatttaatcataaatatttttctcaatacattacatgtcatacaggactaagcacatacttaatcaaatgtgatgattggaagacaaaagacttaatgtataattgaataagaaatgtattactcaatataatgaatcgtctactgagaataacattcagtgacctgcccagcccagaaacacgttaactcattcacttagaaaatgacattttgttactcgagagctagaatgcatgagatgtaattatcactgggtaactacaagagtgatttttgcattcccataagtctcagggttaaatttctgtacttcatcatatatatgatggaagatataatttctttaatgatataatatgatatgaaatgatatatattatgatatgatacaataagaacaacaataacacatttatgtattagtttttcaaccatgggcaaaacaccagacacccaatttatttaaagtacacattgtgtgtttgagatgcactagttaggttcatttaaagctcatgtaggtatctctatatttaaagaatacctttaaaagattttaaggggacacccatattaagaggataattggtggactctattcagtaactgtccatcatatagatcatcttgcttataatcataaagccattggatccgtcattgatattatatttttccaagtccattgtataactcgggtctgttatgaagtagaaatggttattaatgtaaacaatcaaaacatataaaaaggagataacttagttttggatgacagcgaattgtaaacaatgcaagaagcaggttacagtgacaaacgcctataatcccagccctttgggaggctgaggtaggtgaatcacatgaacccaggagttccagaccagcctgaggaacatggcaaaaccccacctctataaaaaacacaaaaattagctggtcatggtggggtgcacttgtagtcccagctactcagaaggctgaagtgggatgatcacctgagcccaggaggttgaggctgcagtgagctatgatcgtgccaatgtactccagccggggtgacagagcgagaccctttctcaaaaataaacagacaatgtaagaaatcagaagttaaatatggagagtgttgatcatataagtgtaaaatacctgaaatcctcaccaaaattcagtaaagtaatatgataaagtgttattaccctttacataaagaaatagctcttccaaaattccagaaaattaataaaaactaaaaattaaaagtcagttttaaaacaggctgatgaatttgtattataattaatgtttgaggaatcaaaagtaatttattattttcatgaatattggaacaataaaaatatgttttctataagggtagcaagtagctgatttacaaataaggcatagaacttcaacctaaaaagcaaaaacaaggcaaagctgtgtgtgtgtgtgtgtgtgtgtgtgtgtgtgtgtgtaatttaaaattaaataaaaaacaattgtggtagcttgcgcttgtcagttacttgataggcagaggcaggacggtcacttgagcccaggagttcaaaactttaaggtgctataattgcacctggaaatagtcactgaactccagcgtgggcaacacagtaagaccctgtctctcaataaaaaacaaggaagtagaaaaaaacacagaaaagaagtcaagagaataggaaaaaagccagtcatgatggttaatagtggaggaagacagtactgagaaaaaagtagaggagttaggcaaattagacatttaaattttctttctttcttttgaaataatatctctgcagtaaattatttggaatgttctatttaaaaaaattaatcaacctgcatttctggtaaccaatgatatgtctttccagttgttatacctagcaaggcactttttgaaccaatttaaagttatttaccagcgaacaaaggaaagtgttaccaaaaattctaacattcaaatatttatttctcctttgtaggaaaagtgtactaataagtgctaattaacatttcttctgttaaatacccaagttattctttgttttcaaaattgtaactacatttcattgcaaattgttttcattacttttaaacatgcagagaatgagactggatttttaaaaatagccagaattttgatgcacgtaagacattcacttaaaacaccaaaagtttagaaaataagtacacctcagaatagaagtacttctttgtctctccttaaataatcaaaattgtattgcaaatttgggtactttcggccattttattttgagaagactgtttagttgttgttagtgaaatcaaaagaaaaatagaaaataaataaaagtgatttaataaaaaggtatgctttgctggtttcctttaggttactggttgtttatttttctcttgtctcacatataatgaatctctttcactgtttaaaggtatcatattgataacaatgaaagactatttactgaacttattgatgtaattttgctcataattactaaatataaaaaaattaaaatattctcacaacattctaaagtaaaaatatttggaatgatttttacttacattatcatagatatatctgtgtagatatatcttattctatttattttatctaaaataatttattttgatattatttataaacaatattctattgcattagtatacaatgcaatacagattgcattgatttttaccctctagaaaagttcagaaagattttaaaacataagtagcctactccatataaaatttaagtacacatgggcaacaacagaaattggagactattagttgcagggcagagggagagaggcaagggttgaaaaactaattattgggtgctaagcttaatacctgggtaatgagatcttttgtacccaaacttcagtatcatgccctataccctaggtaacaaacctacacacgtaccctcaggatccaaaataaaagttggaaaaagaaatctctaaagaaagtaatttgtttttcctttgttatcgcatagaaccttatctgtagttcttttaccttatttggtcttgaattattatttgtatttatggattgtgtcactattaggggataaggtatttaaagcagggactatggtttgctattctgtgacttttctacaactctgaacgtgattcctaagagaagtgagtagatgtttgctgactggacctggaacatgtgaatatgtctattattatattttcttaatatggtatgcttaatgtagtgagctaaacaaaataacaatgtgtatagagtattgtttaaaataccccacttccaattgtttaaagtgcaaaagaaattatatgtttgaaagttaggtggaataaatgaagattaaatgatatagaactactcagaaaacaggatgactttgtggggaagtgaattttgaccctgcttttgaagaatatatcaaatgtaacttacagagtaaggatatgtgggaagaacataggctgtggatttcagaaaatgctcttattttttagctatgcaaacttaagccatttaacctaggattctattttctaatctgtaaaatgaaggtaacagcactcaccttaacttactgggtgttttgaggtttaaatgaaatacagaatttgataatattttgtagtttctaattttgagtacacatctaaaattttttcatctatttctttaggccatcagagaataaaaaaattaacatttaagaaaaaaatatgtttgccttgtaagtaagaaatacagtattatccttccatatctcattcttgattttactatatccaagttgataatatagagagaatttttatattttattttgcagtgtaccagataatccttcagataattggtataactgttcaatcaacttaagattatgatattctttactattcattctagttattgcaacacctgtagaacctatatttactttcctgtcagtcagctaggggaccatacagactttaaggactggttagagaatgataatattgatagaatagaaattgattctgaaacagtgaaagaggtttgactcttacatataagactataaatctatgaaggcggaactccatatacttttttcaccattattttctttcactttgatgcatggcacctaaaagctactttacaaagatttgttgcatgcatgcatgaatgaatgaatgaatgaatggatgaatgaatgaaatttaaaaataaaattttaaatccacaaaaatgctttatgtaaattgatcgtggtgcataagccttttgatgtgctgcaggattcggtttgccagtattttattgaggatttttgcatcaatgttcatcagggatattggcctgaaattttatttttttgttgtatctctgccaggttttttacaatactgtgttaaaatattaaaaactagttcattagtatcatgagctcaaagcaagaaagaacatataaaaaattttcagtgttaatttctacttaagctactctacaatatctgtttaataaaaaaaactgaaaattttaaattaacatttatagttgttataaatacacatcttaatgtgtgtgcatatatatatatatatatatacatcttgagacatatatatacacaaacattgatatatatatatatatgcacacacacacataccttgacatatatatatatagagagagagagagagagagatcacacatgtaaaaaatttgaattaagccctatttttggttcacaagtcttgcttcttccagaatttttctgtacatgtctctcaagcagacaagtacctcggcttttcagaagcatgtgtgatcctgaagagatttgaaaatacggactcctggtgctttatgcaaggctataaaaaagctccaattttcaattatgattgggtaaaatatttctcagttatataatatttttcttgatattaattctgcaattttcttttcagattttctagactgtaataacgttccactgatatataataattctatagttgggaaaatgactaatcgcatgaaaaagaaagggtactgtgagaccatcacttgacaaaaaaatcgatcatagtctgcctcaacttgagaggcacagtctttataagatatttaattcgtcatagtacattgcctgcaggagtgttacacagaagtccaaccagtgttttccatggggtttcaccctagatctgatgaatcataatttatcggatgaagcacaataacatatgtttatatgttctttttaatacctctcttatattttacttatgtatgtatttttctgtccttaggtttaggggatacgtgtacagatgttaccctcagcagtgtataagcgagaacacaggttcgtaacaattccgattggtaactatcatgcaaccagctaaattccaggtaaacatatgagaatcaaaataccaaaactttaaaattcaaacaaacaaacaaacaaacaagcaaatggaaatctgtttcctgcaaagtatgaaatattttaaatttttctatccaatttcttcaaaaaaccaagatggatctcttcttaaacctatacctcttcaaaaattggccatattgaaattaaccttagaaaatgtgtgtctcactatctctcccctctaaacacacacacacccacacacacacacacaaaagcatataaagaaaacatacttgtgtcttattatgcacaggataattgctaatgtaataggcaattatattcagaaatgatttgcatattcacaatgtaaaaatgctgttatgctgtggatatgcaatgaataattaatcagttacacttgaaacaatacctatgaaacacacactggtgtttagcaataatcatgaaagaatcattgcaaatatgtatgtgaaatagattacaaatctatcattaaaattgattcagcaatttaagatatttgatttccacctaccaaattattaaagagataaactttactaggtaacccatggttttggttgtagatcatatgataaaaaggataaattatagatttgaaaagatcatgaatattatgtatttcaatatcatacttagttttataagtaatataagtaaacaatagttatgatgtttagatataatttacatcctccctttttccctactccataaaatatatttgagaaaacatacaatcaaacattaatgcaaataaagtcattgataaaaatagagatcacaagagcaattccctgaagatagggagaataatagaaatggttatgaaagcattgcaaccaagttagaacagttactgagcttggaaagaaacatttaactttgaactttttagcaactatatcgaaattggaaatgtaagggattgtatcattctcattctctagaaagaagaacatcatcgttttatctggaaagaaaaactgctagaactaaacgcaagaggaattgttttttgtaacataacgtggtatttcaacataagtttttttttaaaaaaaagatgctaagatctcttgatataattttattttacatttctaatatcctactaatggttagctttaatgattgtaaaactttcaaaaatgcagtcaaatcagtaaattttattataattttcttttcaaaatttataattgataccttaatttctcatattacaaatatttaaagaataaaaaaatgaaggcaaatattatctccaatctaagcctaataatagtcattattcagccttgtcatcaccctgatcattttttcttgactctaggctctgtttgtcagtatcagctcttaaaatgacaaccaaatcctgctcaataattcaaatatagtttctagtcaatctttgtccttcatgtctttgaacatattccctatatttcataatcacccacattgtgtgtcccacttcccaaagcataagttcaaacaaacaaagaaacaaacaagcatgtctagattatcttggagtttaggtatatgtgtgtgactcagattctagatatcacagtgagagaactggatttaaaagggagcaacctgtggaggcaattgtataagggggatgtcatctccagacaagtgtcatgtgtaggtatttcctgaaacaagcagtaaagaacttgtgacatccagccctgagtcttataagacttggtagttctgagtttctgctacagcagctgctgtgatatgtgggttagatgtgattcctatctgtaaagctacagaatctgagttatggcactcatggagactgtcttaattcagcctgctataacaaagtaccatatactaggtggcctatacacaacagaaattatttctcacagttctagacactggaaaattgagatgagggtgccaggatggtggggatctggtgagggtcctcttcctcttccaagtttcagactgctcacttctcgtgcatcttcacatggcagaccgagggcaagctagtctctgacctcttcttacaagtacaatgctaatcatgagggtggagtcttcatgacctaattacctcccagagaccctacctccaaatatccttacattgtgggttagagggaaagaaatattcaattcataactttctattcttccccccaaattcatgtcattctcacatgcaaaatatattcaacttaacagccccaaaagttaacttacactagcatcacctctaaagtttaaaatgcaaagtcttacctaaatatcatctaaattagatataggtgcaacttgaaagccaattcatcctgaggcaaaattcctctccagctgtgaatttttgaaaccaaacaaattgtgtgcatccaagctacaatagtaggacaggcataagataaacattctcattccaaaagggagaaataggaaagaaggaaggggtgatgggtctcaagcaagttcaaaacctagcaaggaaactccaggtgatcttaaggctcaaggataattctctttggctagatgctcttccttctgattccactggggtaggtgtcctgccttccagaattattggatcaggagttacatctttattgctttgggtggccctaccctcacagtttggggcagcccctctgctcatggttttgagtgaaggccatttgtactgttgaaagcaacgtgaagtccccaacaccaacacaaaatacatcctaactgttctcgcttaacacactttctcattttttttgtgatatggataggctgagaattttctcaatatttaatttctagttctttttttcttaataatttggtcttcaagtcatttatctcatcacacattttactatgaaaagtcagaaagaagcaagcacttcttcaacattttgctgagaagtttcttcaattaaatattaattttattgattgcaacccctaccttccacaaaacaactagaacataaataaaattcagcaaagttctttgctagtttataacacagatcacttctgctccattgtccaataacatgtttctcgttttcacctgagaccataatggcagccataatgcagtgttctatatatgatttatgtattatttaagaaaacagaaactttctctacctctcttctctttctgagccctcaccagaattgtctttaaaagtctcttcacaagagtcttagcttcttctagcatatacttctttcagcttctatccattatccagttctaaaattgctttcacatttttaggtacttatcataacaacatcccaccgtctcgataccaaaatctgttttaggattctccagagaaacagaatcaatagattatatatatatatatatatatatatgaagatttattataagaaattggctcacaggaagctggaagttgagaaattccacaatctgctgtctgccaattggagacccagaaaagttggtggcataatttgaagttctgagacccagagagtcaatgatggttccagtctgggtatgaaggcatgagaaccagaagcactcatggcaaaagatcgatgtctcagctcacacagtagggaagagggcaaattcaactttcctccaactttttattctattcaagctctcaacaaattggatggtgcccaaccacactggggagggccacatgctttactcagcccaccaattcaaatgctaatctcttccagaaacatccttaaagacatacccagaaataatgtttaaccagctatctgggaatccagtggcccagtcaagtttttaattttttttattattttttatttttttagttggagtcttgctctgtcactcaggctgtagtacagtggtatgatctcggctcactacatcctatgccccctgggttcaagaaattctcctgcctcaatctccctcatagctgggattacaggagtgcactaccacatccagctaattttttgtatttttagtagagactgcatttcaccacgttggccaggctagtcttgaactcctgacgtcaagcgatccacctgcctcagcctcccaaagtgctggaattgcaggcgtgagccactgcacccagcaccagtcaaaacataaaattcaccatcacagagaccatgagctctaccttcagccagttgaaggagaaaatcctgaatttgattttcagcattcttagtcctatgtctacaggaggtaaagttctcagcatacatacagctttcagattgtgtacatgcgcttaaactggtaattcaaattcctgagctcatccttttcttttcccagtctgtctagcaacattaggaaaaatcagccaattactttatatttctaaatttgagacaaatattcaaaagtatcatatactcagtcactgagatctttgcttcttataagtggttggttaggagtacccaatggtgactatttatttatctctattgccagatcattccatgggcaatcagtgctctttgaactgctgaaaatagtgtcattatgagaggagagtgttcccttgactttgacccccttgaccttgaccttgtcccttcatgagcaggaaccgaaggggctcatttcattcagcctgcagtccatggatggctaagagttaacagctcactaaagagtgacttagggccaagattccaggtttgagggtagagtttagccaggagcccagccattctgcatcaatcagaatctaaatctaatcatgttccagagtcaattccaaaaaccccagaaccatttctgaacaaactcatctttaaaaatctcttccttttgaaccattctcagtatcaaaatctgtattagttatggaaacagaactattaggatatacattaatccattcatgtattataattattacatatatataaatgtcattcttaacacagtaatgaatacattaatgttatattgaacaaatttaaaactcattctcacggataagtagaatcagcattcaaaatatcttgacattaaaaagtataacatatctaaaaataactttatgcataaatatattggcatgagcggccttaatctcccacagatgaataagattaagattaggatgatagggcctaccataagcatgtgtgcgatcaagtttaatttataaattagtcacagtgctcttgcattttggggcctttattaagtaatgtaaacgttacttgaacataaacactgcaataaccgtaacagtcaatttaataatcaggatggctaattgaataatatgtgatacactggataaaaaaagattcatgtcataagagggagggagaaagatgatgtgagatttcatcatgctactcctaatggcacataatttaaaatatctgaatggtttatttctggaattttccatttaatattttggacagtagtcaactactttgactatacagttaccacaggtaactgaaaccatggaaagtgaaactacagataagtggggactactggactgttagtctttccaccagcattccacaagtgactccacagccttttaccagtgtaactctgcattaagggaagggaaacaatcatgagatagaaacttaaaaataaatatgcattcattcactctaaggaaagtaacaggcaaggcaagggttacaaagaaaagaacaaactttactctacctagcaagctcacttcaaggacaattataaggtaacactctccggaaaggcaaggccaaagaaatgggctccagacacccccaatccagagcaagtttgaaggggaaaaaaagagaaagacaaattatttccctggtttcttaagcatgattatgttttacaaatgtctgtatttagccagttcttgttttccttgcaatgcagctacaaggtcaccagctatgcaaggccacaagttatgttatgctatacgttacgtgacatatcaccgtatgattaactgcttttgttttgcttctgtaggtctgcttataaaaaccccactctgtctttgttcaaggttcagctttttgtatgcgaatccactgagccagtgcgtacctaaaataaacaatcctcctgttctccatattggtctctcctgtcctcagtttcccgcaacaatcagaccttttaaggactactggacactgtccctgaacccatactaacttcaggagacataaaacatcactggtgtctaccagttagaactggggcttatggaggtcaggtgagcagtggagtttttacacaggttcaaatcacaaggggcccagtgagtccccagacacaccctgtggttacttccccagttctggaatgcacaataggaatatacatactcagcagctgacttgtggagtgaagattgttatggtagaacaggacaagtggaagccactagaactatctctaaccaggaaaactgtaaaccaaaagcaatatagtatttataaaaagattgcagaggttagttctatcatgaagaattgaaaaatgcaggggtggtgatttccatcttatctcaattcaactcctctatttgatctgtgcagaagacagatggatcttggagaatgacagtggattatcaaaatcttaaccaggtggtaatcccaattgcagctgctgtacaagatgtagctttattgcttgagcaaattagcacatctccttgtccctagtatacagctattgatctagcaaactgttttcttcattcttattcataaggaccaccagaagtagtttgttttcagctggcactaccagaagtatactttttctgttttacctcagggttataaaaattcttcaggccattgtcataatttggttcacagggatctttattacctttactttctataagatatcatgctggttcattacactgataacattatgttaattagaccaagtgagcaagaagtagcaactactctggaccaattggtaagacatttacatatcagagggtataaatccaacagaaaatcaggggacttctaactcagtaacatttctaggggtccataggtcctgtcaagatatcatttctgagttgaaggataagttgctgcatctggttcctcctacagccaaaaaaaaaggagagagagagagagagagagagagacaatacctagtggcctctttagattttagagctaaaatattctttatttgggtattcccatttacctagtgatctgaaaagctgctagtttgagtgggacccataataagggagggttttaggggaggtccagattgctgtgcaagctactctgtcccttgggttgtatgatccagtagatccaatggtgctcaaaacggcagtgacaggcattctgtttggagcctttgataggttcctataggtaaatcatagtacaggcccttaggaacaaaatcttgccatccgctgtggctaactatgctccttttgagaaacagctgttggtatgttactggaccttagtcggaactgaattttcacatgggtgataattcaaccatgtgacctgagtttcccataatgaattagatgttattaacccaccaagtcacaacattgtaccttacatagcagcacttcatcatcaaatggaaattttatgtatgtgattgggcttgagaaggccctgaaggcacaagtaagttacataaagtggcccaaatgcccatggttgccacttctgccacactgtcttctctctttgagcctgcatctatggcttcataaggagttccctaggatgacatgaaaaggaaagaagacttaggccaggttgttccctgcgcttggaagaagaaatggccaaaagggcaatcatatatggattcatgggctgtttctgtagccaatggtttgactggatgatctcagacttgaaaaggatataaattggaaatttgggaaagaagtttgtagatagacctggctccaaatatggcaccattccccagggtgatcagccagctagctacctggtggcagattggttacttgaaacattgtcatcacagaaggggcatcattttgtttttaataaaatagaaaattactctggatatgatttgccttctgtgcatgcactgcttctgtcaaaactactatccatgcacttaccaaataccttatcaccatcatggtattccacataacactgcttctaataaaaaaacaaaacaaacaaacaaacaaacaaacaagaaaacctcatttcatggcaaatgaagtgatgcattgggcccatgctcatagatttccctggtcttaccatgtttcccactattctgagatgactggtttgataaaacagtagaagagttttctgaaagctcagttatagtgccagtgaggtgataatatctcacaagagggaacaaggttctttagaaggctgtatatgctctaaatcagtgtccatagatgagttatttctcccattgccagaactcatggtccaggataggaagagtagaaatagaagtagcaccattattcctagtgacccactaaaaaattattgctttttgtttctgaaaccttatgctctgctaacctagagatcttagttacaaagagggaagtgcttccacccagaaaagaaaaaaaaaaagattcctgacacttagttaagactgccactgggtcacttagaactcctcatgcctcaggatcaacaggcaaagaagagttactacactgcctgtagttattgactctgactactagagtagattggtctactgttttacaacagaggtaaggaaggctatatctggaataaagatcattgaaagcctttcttggtattacaatgctctttgatgaaggtcaaaggaaaacagaaaacaactgaatccagtcaagactactaatggctaagtttcttcaagaataaacatctaggtcacccaagatcagctgaggtagttaatgaagccaaaagaaatacagattgggtagtagaagaagcagggatttatcctaggtcacagccagctgtgaccatgtgactagttacagaaaaagataactgtaattgacatgagcatttccttcttattttggtataaatatgtgcatgtttgtataaaatattttttattgtctctcttatttcctggtcatgtaacataagacatataacaaagtattgaagtattgttaattttacatcatgacaacaaactacatgtttatgttcccccaaaattcacatgttgaaatcattgctcctagtgtgacgccattagaaaatgaggccactgggaggtaactattagacataagaaggtggagtcctcacgaatgggattggtgcccttacaaaagggaccccagggctgggtgcagtggctcatgcctgtaattccagcactttgggaggccaaggtgggtagatcacgaggtcaggagatcaagaccttcctggccaacatgatgaaacaccatctctactaaaaatacaaaaattagctgggcatgttggcacaaacctgtagtcccagctactcaggaggctgaggcaaaagaatcgcttgaacccgggagccagaggttgcagtgagctgagatcatgccactgcactccagcctggccacagagtgagattccgtcaaaaaaaaaaaaagttaattaattaaaaaaaaaagcgccccggaaaactttttttcctcttctgctatgtgaggatacaaggagtcagcagtctgcattccgggaaagaacccttacctgaactcaatcatgctggcaccctcattttgaacatctatccttaagaacagtgaaaaataaatttctgctttataagccacccagtctgtggtactttgtcatatgaaaccaaactgacttatccatcatagtaattaagttatgggatatgaagaaaagcaaatgtcactcaatgactttacctcctttttagagcaggtggtgatacattttccactgtacacaagatagatgtatcaagttaggagattcagacctagctattgtcttcatttggagattgagtatgaaagagatgcatatgggtggttaagttaacacgggatggacttacaatgtttatttgtcaattttactgggccacatggtactcagatatttgcttaaacattgtgggtgtttctataacacctggataaggagggattccttctgtctgactaccttttagctgggacaccaggttgttttcttttcttttccttttcttttcttttcttttcttttctttttttctgccttccgtcttaaactgaaagattggctcctgggtctagagcctgttggcctgtggactggaattatagctttggctgtcttggatctcaggcctttggactgggagtgttatggcattggctcttctggtgtagactgcagatctggctgcttgttaacctgcataatcatgtgggtcaattccttataataaatctctttccatatatattctatatatatatttatagaaatttatatatattctatagaaatctatatatatatagaatctatatattctatatatagaatatatattatatatattttatagaaatgtattttatatatatatatctcctattggttctgtttctctggagaaccctaatacagcagctcatatctatatattacattattcaaaaattattttttctaataatgccattcttttgctgcaatctttttggatattgactctactttttatttctgaggatcaatttcaaggttattcagtgtggcataaatgtattcaccccagttactgatagggttttgtttttaatttgaattaaacacaaggcccaagtcagaggagtttactttgtcatgctcactattgtatataatttatcatttgttgctgactcttctagtcaattcataattgtttctattgtgccagatgacatgagattgtacaacagttctgtgaaatatactacatttactaccactcagccattgagttttattcaaatagtatctgagtctcagatgtcatgattaactcttggtcagtcatggctctaagagggtcctatgaggtgttacataatatgatacctgtggcccagcccggtggctcctgcttgtaatcccagcactttgggaggccaaggtgggcagatcacctgaggtcaggagtttgagaacaggctggccaccatggctaaactccatctctactaaaaatacaaaaatattagttggatgtggtggcatcctgtagtcctagctaatcaggaggctgaggtgagaggatcgcttgaacccaggtagtggaggttgacaatgagccaagatcacgccactgcacttcaccctgggcgacagagtgaggctctggctctataaaaaaaaataataataacaaataacaaatatggtacctgtttacctcaagatgtctgtgcttagggctctctcttcctgcaactttctttctccctgactttctcatagttatttcccttattttttctagatctctgcttaaatgtcatttccttagagttctccctttgctatcaatctaaaatagctttctactcaccatatcatcttctcctattgcctcactttattttcctttgtagcaagtgataacattaggcaacataccacactttccctaacttatatttttcagtcttctccagtaaaattttagcttcccaaaagaagacaggctttttctttgttcatctgtgttttcttcttttttttccctagccattcccccaaaatagttgcatgtctgacaagcagtaagtataacaactgataatattctgttgggtgaatatatgaatgactaaatgagtgaataaataaacttttattttaagtactcatcaagcatcctttaaataattctggcatcatgttaaaatcaacataaatccttcccatttttttaaatgtagacttacataaacctttcttatgtgacatcttgattgtttacatcttgctaaagattttgtaaaaagacaacgtgttcattcttttcccaacatgatttcaattctataattttgacattcaccagcccagaaaatacaggagttcctcagattatttaattttcctaggagacaatctctgaataatgaatacctcaggaaaggaggctttcctagagcattttcagtatcacttggaaatagacccaggatagcaaccacttatttttttgtggtatcctcttataaagtcacttaataaagtactggataaaagaagtagatttatattatttctgctcttctcagaggagctttattttagacttaactgacttcccctacctactaaacagcatctctaaaataatgttactaatttccagtttgttagccactcttccaatccacaaacaatgactcattagtcaacagaacatcccttcactcagcccctccctccattctgccatcgacgccacctccagcactgtacaactactgagtgttctcactaggaaatgcgtttattctcaaaaacaaatgtctgtatcagacatgttgggtgaattataactttagtttttatgtagtaagtatattttcaagatataatagctaattagaggcacttggaaattattaatagtgaagttacctatttgagcaccctgacgtttcacatagaatgctagtttcaagctatactaagaaattaatgctgtataatttatatcataaatatctgtagctgtaattttttcttatgaatttaggtttaataaatatttgtaagttacttttacatgatttcatttttttaattcggtctgtgggggatataattttcacatacttgtaatgtaaaattacaatttccagtgctattttatgatattaattcatctgatacatagaaataataacacctggctgggcgcagtggctcacgcctgtaatcccagcactttgggaggccaaggtgggcggatcgcctgaggtcaggagttcgagacaagcctgaccagcaaagtgaaaccccgtctgtactaaaaaaaaaaatatatatatatatatataaatcagctgagtgtggtggtgtgtgcctgtaatcctagctacttgggaagctgagacaggagaatcgcttgaacccaggagatggaggttgcaatgagccaagatcatgccattgcactccagcctgggcaacagagtgagatgccatctcaaaaaaaaaaaaaaaagaaaagaaaagaaataataacacctaactattgaggtaagttttttttgtcatatatatgtatatgtacatatacatcattaataaagtgatacttggaaaatctggaatattatctataccacctctcattaagcaacattattaagttaacaatcacttatattttgttttctattttgagtatattaatttgatattcaactactcttattagaagtagtatttgtaagtaaaactagcaaaattaaagataaatgttaatattcaacagaatatttcagatgtattttcactataattaacactaaaataatttccttttataactcacaatgtatgtagttcttattgtgggataattagtctctgtctagtcactgaaaattactttgaaatacagttttaaacattggaaatagtgtcctgagcttgtgtgttatgttattttcttgtatttcagaaagatcactctcagtataactctgtgaatgcttgcagctgcacacttttgaaagatcacataaatgtacatttgaacgtgtaatcattcttgcatatgtcagtactttacttgaaatctcaactaagaaaggataaagccttgatagtcacatatagcatgagagagaaaaaccatatatttctactaggcctcatatcagaaagagaataggtatggattgaatactaatgacattggggacttcttttgaaagctcataacagatgaaccaggttctgtaagttcttctgaaggaaaactccatttctagataaatatgtctcctagtttttacctatagttttgtatttctaattttatttagtatttgggtaatttaaacatatttaaacagtacatctatgttaaaattttttatccattcatctgttgatgcataataggttgattccatatatttgctattgtgaatagtactgaaatgaatgcttaatatgtggaatcttaaacgattcaagtcatagcaacagagtagagtgactgttacagaggatggaggatttgagtgggggtggggggtgatgattaatgaatacaaaatttcagacaggagggaaaaaaatatatatatagttctatggcacagcatggtgaatataggttaataatagagtattaaatacatttcaaaattactaggagagtacatttcaaatgttctcatcacaaacatattaaatatttaaggtgatggatctgttaactagtttgatttaattactccacattctatttataaatcaaaacattgctttgtacatcatacatttataaaaagtaccgatttacaattcaacaaatttctaacaatatactgaataacaaaatgaactaaaattaaataaaaacataacattggctcttaaaatgtctgaaagtagaaaaaatagtaatagttttaaaagtaaaacaaaaataagttgttaacacgtgagcaaatttttaagtatgttattgtgtgcaatgctgattttcaaattttactacatgattatagaacagaaaactttaacttggaaaatatagccaatttttcataagcactgtaaacattccatactttctggggccgaatgagataatacatttttactgtcaataattgatgtcacagatattaacaaaatagctcactaataatggctttccataaagacatgtgcacattttaactttatattctaggtacaatgcttttgttagtattacttcattgctctataactataatgtttttattaataaatacagtagcatttgtatactgttgattattggtcttatttgtacaattaaatggctcagtctgcagagtttcttaaattgtttcatttctcaaaaagtttcatgtaatttagcatattttctccaaatgccattcattttacaggtaggcaaaattaaatatatatacatccacatgctaaaatttgtcattttagtgactgcttatatgttattagacatgtctatcatcttgcaaaatgcataatttaaaaaatttgatatttgttaatatactacattttcaactacccaaagcaatactaatttttcttttttcccacaaaattaaaacaatatgactcaatattatttgttagttaatatttttcctatcagaactccatagctagtgttctacttgatctttttggcactgaactttaaaaagaacaagtctcattctgtaataattttatttttattttaaaaaatatttcagctcatgatgttaaaccagatacattgatatttattttataattccaaatgataatatcagttgtttatatggattagaaattagttttatatcttacttttgattattatttgttagcatttagtagcaacatttatcaatatggtggcagttcattgtcgtgactatttgttaataacatcttttattttttctattttttttacatttaaaatattctaaattcctttctcatattatagacttgacatttgtaacactaatcccattctttactgattttaatggagattattttactatgccaatagtaaaatagagttactctgttaactctacttttctccaattttattcaagtggctattcatttttacggtggtctcatttcataacctttttttcacagtatctatgcctttttaagaaaacatttgtgtcaagctagctttctcatctctagcagatctcataaagaattatacttttcagtgtcaatattagtttctattttggtttatgttgcaaatttttatgggctgtatttgagctttgtatattaagtgaattaatttgtatgagcagaaatctgaacaatctaaataattgcttacaaaatagtaggttatttttattttaatcttcttgccatttctgtggccactattaaaatcttacgtgatctaaactcgattgactgaatgttatatacgttttccatcaaagcgatgcaccagtactcctggaagagttgaaagattctggagcgattgctttctcacctgccaagaattgaaatggcacatttcctgtgtggctgtgggctccagttagcctctgttctgttgctaggttcatgttgtacactgcgcaatgccctagccacaaactttggggaagctaatggctaccagataacagaaaatctatcttctcaaaaagaagtctggccaaattttgtgctttttattttgctaaaaataacttatgtgaatatcctgcttctgccattttgtttttaataatacattttgcctgtctcagttgccatatgaaaaaagctactactttttttttgcaggtgatttttaaaaagtcagaagctgttaagtataccataagaaaaaatatcattttaaaaactatttttaccatgtatgcttataactattaaaattgaaaagttaatatctattatagtgaatattatctaatgctatataatgagaacccacctatgcttctctgaaaatatcctggcttacagatctatccagcttgaacttaactaacataactccaatcatcattcatttttggtgtataaataaaaaaggaaccacatagctaaatggttttaaatgtataattaatcactatggcctcattatacttgataccttatgccaaggtaaatacaagtatggaagaataaacaggttgttaacagatgaatggatggatgaatccataatacataactttgttgaagcgtatttaaaaatacctaacttattgaaagattgtttgaagcaataagcttagatcatcctataacttataacatctgattaatttgcatgtttacatagtgttcatgtaacaagaggtattctatttgtaatgaaataaaaacactaaaatatctttaaaagcaaacaaatctattttccttctttcttaaacatgtgcatatttattgtaagtgtttgatgttttctggctatgtttttctattaaaggtcttccctgaaaaaaaagaaaaaagaatgacatgtaatggaagctttcaaagtgattgttgatacgtggtatcttttacaaaattgagaaatatatgttaaaatttaaaacatcaaataaaccctttgaggattgtgtttaaatttgtgttattttctgctacattttgtggcctaattatgtgaaattttactctgcaattgtattttgcagctattttactatgaataatttgcatttttttctattttccatggaatttaaattaaagacaatcaacttttcatttatgagagcagggcagtatcacctttacattgtagcaaaaataacaaaagatagagaaatcacttagttttctgagaaatgcaaaaaatgtatctttcctctcttgcatttttggatgctgttttataatgctttttacatttagtcagcatttttgaaaattgtatagattagaaatcttttaagaagtgccctaacagcaagaaaagccatgctatcttctattcataaaaaagatcattttggaaaggtactttccttcagcagcttttggaggctgtttatataatgtagctgcaaaataacattttcagataaattttaaaaactacaaaaatataaattgtatagtgtcaacaaatatgactgtattaaatgatagaaaatgtcctaagtgtacaaatcgagaaatattactgtcatatcacattgaattataaatgcagagctaacctggtatctgttagaaagagaatggaatttgacaactatatcatttaacttataatggtataaaaaatcaggagaaaaagttccccaggtattgtaggaacttacacaacttttatcagtattctggagggtgaccaaattggtagttcactgattattttggccttcacccatcgtgaggttgcctaggttaacaccaaaatttttctgggttagcaaagctactaggtcacaggagggaaattctaaccaatcacttccatactatgccttaaaaaatctaaacacagaaattatgttagaatttgcagccagaaaattaattctcattgaaaatgtgtcattttcatacttagacctgttcattttaatctctattctcatttactctcatttagttatttctcagttgcttgataattaaaataattatacagtatgcatatatcacacttccaaattaagctggccttttatacattatctcaatctctgccaaatgtagacttgtctttctctcacttctttcttgtttacagttaccttgcatttcatggagtgttggaagactcagtttcatcccattcatctttcaaggatcagctcaaatattacattttctaataacacaggcaaaagtcattgactatccatcaagacagattcttgattaaatttttaaaaatacatttctacatgtgttgaattaaaaatcaggacctgtaacccacagaaatatacatatatcttcaaaatttaacatgtgatgtctttaatgttgataaaactatattatccatgtacataagttatagaaatgaataccaaaaattctacccaaagaataacagtaattctttctttgagagtactaaaaatgttctgaataaaaagggaagaaaaacaagctatcaaaataaagtctcagtgatatgccacttagttatgctgtgtaaattcacattaaaattaaaaacccacactttaaaattatctgtggtcttgggctgcttgatatttgatttaaaagcagttaattgaagagtagtaattttaaaagtagtgaatggggttttagttttgtatttgttcatttgtatgggtgctgtattgttgattgatttcttaatgggattcttttaacttcaatgggaatgtgtaagaaaattaaattacgtaaagccgggagcagcttataaaagtcttgggctcagtagtgttatcaccttatattaatatattggatttcccgcaggaagctcaagatcctttcagtatttatcctaatagtaaagtagggcaggtatacagaggggaaatagaatgtctatacaccaataatgggaaaattgaaaaaaaataagatatttcatatttagatgaaacagaatcagaaaccaggtctcctttagctactttggtacagaatgaatggtgctcacacctataattttactaccatttactatggaccactccacagtgtagaaatgggctcagcataaatgctaaacatatcattacaaatacttcatgttatgatgaatatatttggtcatttcccttggggtcacttcccaagatggttattttataacactttaatataaatgcttaacctttaaaaatgtagttcttttggagaaaatcccagatgtgcatacaattagaaccaacatcaaatattttgtgttgccagatcactaattaaattcctgcacataaccttttccttcctgaaatgcaacatttagtaaattattttataattatgcaaacaatgttttgtatagcttttgcattttaatgagtttgggagaaaccaatttagaattaaatcagattctgaaaaaaaacgaaacaaaacgtgttgtactaaagagctgccatctaattataataacacacactactttccatgagtctgtaattcctttgccatttaaaaagtcacaaattttctgcttaatttttgtttttttgcctttttatgggaagatgtttaaatatttaaattcacaaaggactcataagaatcttccaaagtgaagaaaaactgttctgtctcccataaccttttcttttatattacctttcaaaaaagtttctagagctcctatattctatttggttagattagccttcggtacactcaaagtccagggatcaaagtaggcaaaaatataatgcccaactttatttccctgatttcatcaataatttcatcagacattgtatagaacagtattctactaataggactaaatatgcattagttgttaaataaaatgaaaattatgtagcagaataattatcttgaaatattggactttttaaattcgttaaatatctttagccctctttctatttcctgtttttcagaatgtaaggagtataaatggacctgtaggaaatgacaaacttatgtctgagggacaaacatattgacaaacatattatgtctgagggaatcctataaataaagaactggagtgaatagctgaagttctgacaaaaaatatgggaaatatttggtattatagctgtctgagtcttccactgaattctttgtaccatggtgtgctttaaaaaaatataggaatggacaaagaggagtcaaagttattataggactaagaatacgagatagatacaaacaaacacatatgtatatatgtgttcatagatacaagcacacacatgtgtatttggtacagttctttcattttacttaattaaaattgacctcctaccatcaaacatcttttaagtataaaggtgaaagaaagaggtaattagagaatggagaattcaacacacgagagctgcttaaaaagttaccatacatatggcaaaagacactagttggaatttcacaaatgtaggagataaataagggcaataaaatagtacaatgtgagtaaatctaatattggatgtataaaatgataacaatgtctcctgctattttaaagatatatggaataatacatatgcacatatatgtgaaggggattaaatgtggttaaatatttatgacttttaccttgtctggaacgtgtaacaagtaccaatttctattaaaatatggtaagctaattaaaagtattgcaatccctaggttaagcacttaaagagtagtaaaggtaagtgttaatatcaataaaggggaaattggacagacaaaataatcaattgaaaagaatacataaaaaggaaaaatataacatagaatggatgaaacaaataaaaaacaaatagtgttggcatatatttaaaccttaatataaactaactacataaaatgaaagtaggtgaagtctccaaataaaagataaaggcaaaagtagtatcccataaatagatttaaataagaaaatatgtttattttatacaaatatggattaaaataagaaacttttaagtatatgctaaataatatagctcaaaatttaaaaggtaaaattttagaactacttgaaacttattaaaaccaactggcatgaggacctctaactcatttatattgggtttgtgtgtatgtatatacatttatgtttattataaatagatgtaaatgttatatagtcaaatttccaacatttagctacactttaaaaccacatgggagtatggtatatagattgaaacactgagttttttcttgaggactactcccaaatatgtggatatgttatatttgaggtggcatcaaaatactgctttcggaaaaatgtattcagataattcttacccccagcctgatatatataccacagaaaaagacattttgaagtatatgcgtaaggtaaatttcttccaaatatccaagcactattcaaaaattatcacatgctaagccaagcataacagatgagtcataggaatccaacattcctaactccttcctaaattcacacattactaacaaatcatagcagtatttctgccaaactttaggaatttttctcagcacacttcctttcagtcctcttggtaggtgctagaaattctctacaattggaagaacaataagaaataattttacatttctgtatttttcaaaaaaattaagagcaaaaatataccaaaaagcaatgattagtaatcatgttctttattaatgatacattaacactgaaaattagtaccaaaagagtaaaaagtattgccaagtaaatttagaagtcttttctttcaaatgccatatttactcataaatggaaatgaaaatcaagtctgaaatctatttagaaaatagtacaaataagaaactttaatttaatatttttagaatacaggcaaagcaatacccaaagtatttgtagctccaaacttgttattattaaacaacagacagaataaaaaattgactaagggttaacaaaacatcaaaaattaaagaacacaaagaacaaagcattgtaaagtttagtaaagatggagaaaggactctgtcattaaacatataaagtattaaacaaaaatcagagaaaaccttgagaataaatctatgaaaataagttcttgaaaataacaatgatatgcagaaaagtctaactattataagagaaaatacaaaagatgaaaaaaattgattttgattttatgactatatttttttctcatgttttattagtttttgattggaacagctagaattttgcatatcattgaattgttattctatgacaattatacttttaaatgtgaatattataagtaactccagtaatatacattagcaaattcttagcaaatcctaaggaatttttaaaatgtttgcaaccattatgatttatctcactttatttaaaacattttagagtttagagtcagaaatactttccatatctttgtataaagtcagcacaagattgtaaggccataaacaaaacttctaataaacgcatctaaaagaccaaaattgttagtgcatcagtgtgtgcaatttgcaaaatctttaaaaattatgaaagtaaaatgtcagtttattaaacagctgttgtgctaaattattacttccccttctatttctatttaatgtgttttaattagaaatgatatcatcttatttatcatctccttaatatcaagccatcaccatgtttaatgatagtgaaatctaaagtcctttgaaattcaggaagaaaaaaaatgggtgtttactctcaccattaatattgtactttgtcttagaaatttgatcaaatggtattaaacaacaacataatattagttaagtaaataataaaaagaaaataaaaactacctttatttgcagatgtaattctctctagaaataataagaaaagttgtatctttaaattataaagcactacagcaactaagtaagatacacttctcaggaaaacatggttaaagagcctgtaaaaatttcacattgtaagcactcaatctttttttgctgctgcaagaagtgaaaatcaaaatgagatataatctgatatgttaagagtggaggaaagtcaaaaccataatgattaataattggcatagtgaatgtgtaaaccaaatggtcctcctgcacactgttggttgaagtgtaaatgaggacagagaatttggttgtaccaaatcaacaaccactcacatgttttttttgatttagcaattttcttcaagttaggtacatgcagttacataaatacttcgaagccataaaaagtgaggttgtatatttatcttattgatatacactgatggtcaacattcatgtgttattttaaaaaaaggaggttataaacatatgtacatgaaatccactgttaacctttcataagggaggttgttctttccatgacatgaatgggtaggaagttgacaaaaactaaaggaaaatgctccaggaggtcatctctgggaatttagggatgaatactccttgagacagatcagctctgtggagactcatctttggagtctactaaaagagttatgttgcttcaaagatgaggctcattttcatgaagaactaaattctcagtacatcgaaagagtaggatcctgcttctacctacatcagagaacttaagccactagctgagtggtttaagagccagtatgtcagaatatagtgcagagtgatgaaattgagcttgacgtgatcctacaatatgtcttgaaagccctgagcagatacaaaaggttaatggaatttttatgaagagagggatgtacatgcagctccatgagagacagaatatactgggataagtgataccaacaaaaaaacatagtgaatttaaggcacaaccccggtgactaaaaacaaaatattttctgaaggaagactacaatatcatggcgaattttggggaaaaccataaatacaagcaacgggcttatataatatctcctactttctcctcttaggcataaattacaaaagaaaatatatacaaaataaaagcaattacataagatataaaatcaatgttatttgtgcattggtgtttttaaaagatcagaacacaaaataggctacactataaatttgttttctgtaaaactatccatgaggtcttaacagaattggtgattataagggctaggttaattaaatgtctattcaaagtatagagactggaatgtcgaaggaagcaatcaagggtaaaaatcttactaactgggtcagttttgaacacccaacatgaagtagttcaattctaatgtggacgagatagtcttgggcagtgtgatcactccagtgagtgttctagaagtacgaaggcacctagaagtttctctctttgtatataactcctttgtatataaagtaccccctttaggtacttgtagactgctttggggaaaatgaaattataacctgaaggaatatagtacaacagtgaaaataaggcatcaataactggcactgtacagtgggagctaggttccagctgaaatgcaaacgtggttgaaacatactagtacacttctacagaaataaaaattagcagacaaggaaaggaaaggggcctatggaaaagaaattaatcctggaatttaaacagttttgtgttgccaaggtaacttagacctaaaaatagaataaagttgtctggttggcattttggagaacagagtcataaagatttgcaagtcaaatttataatatataagattgtatcagaaaaggagtttgctttaggatagcagcctcatggaaattagatgaaaactaacaagtctatcaataaggcttatctcagtctcatctcaaacaggaaacggctgggcttgatattgtctaagaacttgaatcctattggttaaaggagaacttcctagacttctctggtaatcaagacaatcataagaaaagtaagatgagaagatggttactcaaatcaagaaggacgataaacttgcatggtcttattttgaccatgtaaaaattttagacaatactagtgctgaaagtgtcaaaaggatgagggaagaatattaactaaaaaaaaaaaatcaattttgagttcattactaaaatattatagatataaataacactggaattgcaaaaaggttataacctgaaaaaacacattctttgaaattatttccagagttaaaaatatttggagagtttcagaaaattgattggaatcagttttaaatcctgtaggattcactcaagcatatggccttaccaaatgaatgtatcagcttcttcaagaactccagagattagtggttttctgcagagaagattggactagctgctttcctcatgctgtgtttcatggtagttcacactcagaagtgaattttacatcttaggatccatacaactcctcttcattaacataatttactgggtttagaacagttttcttaaagtggttcacagatcagcagtgtaaggatcaccccagacatgctggacgctagagctaccaactgagaaactcctaacgtggggccaataactggtgttgtaacaagacctccaggtgattctactaacataacgtttgtgatcctctgggctggagatacagagactgacatttaatctggaaatttgaccgtaaggctaatacttccaaaaatgtgatggggatcagggaaataaaaggtgattatacttgatataaaaagccatggttacgttgtttttaaaatgttaacaaatgccttcagaaagcacatgagtttggagacggagggagagaaagcaaatggaggggggaaaagagacagcaaggagaaatcaaatggaaagggagaaagggaaggaggaggatcatatgatggggagagaaaccaggtggaaacggagaaatcagatgggaagaattcaagatgaagggagatacaactaacagaaggaaccagatagaggaagagaagggggctggagagaaagaggggcatctactttaaactgcccccaaaagattccactttttgtgggattaactctgcatccctgggaaagtttaggcagatcagttcctttacttctcactgtgtgaagagtttagaagtaggactgaactgaggaaagccagaggattttttataattcagtggaaagaaaaagacacaatagaaaatacaggccttgcttataatatgggcctgtgaagcttgtgttgggtttaatttgaaaagtgaaagaaacataatagtgtttaaccccacctggagaagtaggccataccaattttatattatattccagtaataagtattatgtatatatgtggtaaaactatatagtttatacacaatatatatttaatgatcatataacgtacaaccaatatagagttgatataaaaataatagatgattcattgatcatgtttgcaaatacacatatgtatttagccatgcaaaaggattatggcaaattacatattctgttagtaatggcattatgcagagttaaattcattctttattttatgtaaaattactgcttaactatatatttactgatatttggaagattgttaaagaaatgatatatatctattttctaagacagacacctatattttaacaatgctagcacatttatgcaattttatttttacttagaatatgtttgaatgtgaagtaatatgaccaactttttagcaagcttaccagaatttttgcgctcaaatttatttttgccttaaaaaagctaatctggatggctatacatttattccaatgatatcaccatttccatttttggaatttatctttaaattgcttccaaaaccttcaacatattactttaaataccaagcagggaaaatatttttcatgttacgatgaaaatccaaataacttttcgaattgggtctgcttaataaaatggaaaatccaactggacaaaacttaaataattttgttttataagtgataatgtaattgtttttctgtatggccactgttctgattttataaggtaatgataataagtttgaaattactataaataattatatcaatgtaagaccaatcataaaaatgtcaggtaattaaatttgaatgcttaatttctgatatttaaccttaaaagctgccttattactacactgaatcttgttctctatgactgtacagagaatatagtatgtttgtgacttcactttttcttaaatgttattaacgtcacggcatcaaactgacctagacaatactgaaaccaaattttattcttaaactagaaaaaattgtcactccatgtgcttatgcagccaaacaaaaggttgaaatgcagtactaagctgtttaggcaaaattatttggagcttatggctgcctgtttttcccttcagacctttgacatataccatcatattcccaatgcttcagcctgaccttattagtcttatttgcatgagcaaggctgtgtagtcagattaaattgcccaaagaagcaatcctattattcaagtgaatgcatttttttttttactttgccaaataagaaatgagacaacaataccaatcaatagacacatttgagatatatttgagatatatcaaataaatatattaacaacattatttactagaaaatttaatttatcaggaaaaaaaaaacttgcctttaaatcctgggacacacttgcggaagaaatatccccttaaatgtgtactagttgttccatttttgcaggacgcagatttgcagtcttcagtatctatctcacagatgttcctttcatatctttgcagaccgctacagttacaattgtgcgaaagggccaggcagaggccatgcactgatatactgtggttccctaagcaatagtcaacattgacaacacacaatctgccaatgtaactaagagaacagctgcatctgaaacacagagaaatgaaaaacccaattagtcatatactttattttgatatatttaagtatttaaatcacacatttatttaaaaacacagaaataaatatttaatgaagatagttgtggggtgcatttaaaaaatattttcataaagtgtccattcttggcaaaattacttttgattactgtgcagaattatgagtgaaaataactttggtgctgaatatatctagtctcaaaaacatattctgccacttaattgctatgttagctgggataacatcatgaactctgcctatgctaatgtgtgtgtctgtgtgtgtattcatatattattaggttggtgcaaaagtaattgtggtttttttcattgaaagtaatggaaaaaaatcacaattacttttgtcacaactatatatatatacatatatataagattattcaaactcagtttgtcactcaatgcaattatttaagatgtagctgtaaggcaatgccaggtattcttatattattctttaaatctataatattttgaattttaaaatatctgtactcttgaatacatgaacataattcatgcattcattattttagttttttagatacatttttaatgaatttgcaaatttcgacgagattttcccatagtaatttcaatttatccaatatatttttctagtagttttttacatagttttcttgtaagtgaagacaattgtgaaatagtctgcaatttatgtaaatgtattttaaatatattttaggtttaatgttgagaactatgttggctatcaacaaaagtggggatatttttctggagttagagagacaaagatttttcactttttccttcctttcaaatacagacgtgcacagaaacacacacacatctgttcaaggcctaatttatttgatcattatacattgaacaacttttcttgggttcctctatatctaggcatagttataagttattaatataaattcttagatcattttaatataataatacattatataatatatccatatgcatttctttgaatattttatatacatacataattgaaaaagaaagcaaaagatgaaaaaaaattaaagtatcatgattttcaagaattctttaccaagcattcaaagggcacttaacattagcatataaatatgtcaatgggctgagaaaagcaatgtcaaatcactttgcttgttattattaataaaaattaacctactgaacctaagtcattacacttataactgtatatgacggtaagcgtttggagccagcaaaaatgttaaaggtgaattagttcaagcctttcttcttgtagttgtaaagaacttagccatttaatgcaatttgtcaaggatcactgagattattaacggtaggaagtgtagtggatgctttgatgtgttcaaatcactggtcttggagagaaaactttggttttaattcttttcaaacatgtattaaataaatatatttgtgcctgttttctcatctgcaaaattctcagctgcacatctatttcacagaagagtattgaatgcattttttactgggcaagtaactgttacctactatatcaaacacccttccaacaaagttacctgaaataaaatcatagaatacagttacttcccttcaatacctttcctcttctccctccacatacagaaaaagaaaaaaaaacctaggtaaattcaaaacaactgccacatggcaaaaaattgttggcctgtgctaggccttgtttaaccgtatctttgtaaattgttaatagtgctctttcacttttaacagtgttctgattggggtggtagattacacggggccctatgtataatgccaagattattacatagttctgtgcctctactatgcaagctttagtcataatgctgtttgttattccatgaaaatgaaaagaaaattgtagaaagttccttcctaaatgaacaggatatcctgtacaagaatacgaaggcatatctttataattcttcctgagctaatctctagtttattaaatctcaataaaggcatcaagaggtagactctaaattatatatgggaagcttacggcattgagaatatttttgaaaattaagagtaatatggaagtactagctcagatactataacaaacaaaaactgtactaattgaaagagagtttgccagttaactattaggatcttgctgaagtctctaatctgaactgtgtggagatagtgacaccttttattaagaggaagatttaataggagaaaatttggggtagaaactaggaatctgcatttggccatagcaaatttgaaatggtaattgacctatttttatatttcattatatttcatgtatttttatattgaccacttgatgtttgttttattgagctttaatgtcctcaagagaatactttttcttgtgtactcgtctttttaaaatttgacgagttgtggttagagcaacaacctacttgttcccaatttttgaatttttcaaattttatttttgacacaacttaggcacattcccttattgtttagcattaccatttctatatcaacctacctacaatacaaacctacctacacatacatatttatatatatatatatttaaattctcaaaaatgattatatcttagtaatatataatgctctgaaattttatctttccatttaatgatatgtctgagataccaatccaaattagcacattttgttttcaaaggttgcaaatattctattatatgaatgtaccataatatttcaccctcagaaggcactgtagttactatgcgttttaatttgttgtgttaatatttatacagaaatggaagtccttgtacaaatatatcagtggattctatagagaggatccataggataaatcccttgcaaaattggccctaatcaaaaggaaatcaagtgtttaattttaatagttcttatcaaagccctctctataaaggttgatgttcagaatgccgggcttcccaaacactggagagttctgcatatcataaaatgttttagtatttgccagtctgattaaaaaatctgtcctattttgctatgatttgtatgtgtttaattcatgaattgcactttttttgcaaagttactggtcatttacctttttgttttcctaataacaacctatttttggtaatttttctacaataaataacatatttttaacactaattttataattagcacaaaagaaaatcagatatcaacacttccttttcctttgcaccacatccttcccctgaccccccccaaaaaacaacttggcagtctattgctttctaatggccattgtttgaaagctcattgggatgttcttaggaaagtgtcgcttctgatgcattggaagtagtccaaaatttctgaaatgccaggcgttttggttttaaatttatttccaagttttaatattctggtttattttaatttatattttcatcaaatactatgtaaatattcctataataatgcaaatatttcttatagaataactatagtgtcttctgagggtcaaatattacagtgcgtttccatttctaactcatcctgccacctatataagatgtttaactatttttgtgttttcatttatctcaatatttccaaataaaatattttacatttattacttaataaaaaagcacatttaaacattattcattgatgtcatcctatggaagagaagtatttacatttcttacactgctccttaccccaaaacacacacacacagacacacagataaacacaccaagcccttatatcattctcccaatataaaattaggttaattttgtaataaattaacattcattttatataattatgtgtttagtgatatcatttgtagctgaaagaggtcatatgcatttacttttacagaacatttttgttttcctggcagtttttaatcactatatttttagttttgtttacttattctaagcatccagtcatcattacttccccatgtccctcaatatgcaaaatacattggatattctctcagcctcagtctttttgtccttagaaatgcctcttctgaatgggtagatccacaggctcacttcatagtgttttctgggatgactcttcaccttcatcctgggaggctttaccgcctgtcttctggtttggatcctcagtttcctaaattcctcatcttttccttacttgacttcctattttaagcgaagtatattatttttaggttagacctcttagaactaaaaatgttcacatattgtagatctgaaaactatttttttctacctttttcttattactttgagggcagtagtcttaagttttggagtttttttcaaaagtttaacatgcatctcttctttgtatttcctctgaattttctccccaccttccaactgactttggtctctggctgtgaagttagagaatttcctaacttacatggttatgcttggctctccacttatattgaaaaataaatcaccaaaaaatatggtttgaaattccatgtattcattgtgagtggttttctagtgactttattgcactgtgatcaaagagacctggctgatttgtttaagaactctctaattctctcagagtctgtattcttttacctacatccactcagtgacagtcaggggaagtggcctgaccacccacatttttagagcagaatagggaaaaataccttgttacctttgttttgggagtagatttttacttaatttctcctctgtagtattgcaccacatccctgggctctgtgtattgctcaagaatggaacaggctgttcgcacagataaaagagagaattcaggagtttaactgtgtgctcataaagctttcaaccaattctttgattttcagctttaccatggtcccaccctcaggaatgactgatgagtacaatgcctgtctttcgagtattcggcttatttagtggcttcccctctgctaccaacttagtttggtggttctagtctttcctgatgctttgcattttaaataatttttgttaggatgttagacactgtaaatattttattgaaagtctagattttgggctgggcgtggtaactcatgcctgtaatcccagcactttgggaggccgaggcgggcagatcacgaggtcaggagatcgagaccatcctggctaacacggtgaaaccccgtctctaccaaagatataagaaattagatcttaggcatcgcgtcatagaggaactacaccttccagaaccctcgcgccctgcgtcgtgctggcacttttaccggccgggccttagagcgcagcctgtagccgggcgccatctttgacgctggcagtcttggttttctgctagtgctgctgctgctgggaggacgacggacggcagcggccaagcgagaagaaagacgtggcagcaagcgggagtcggggatagtgtcatcggttcgggtcccactactttggagcttgtctcaaactccacatacagaaagccaccgaccttattccggtatcctacacccattccccaccctcattacactcccacccctggccctcagcgtgggagtcaagagcaacagggacacttccgtactccttgtaggattggtgaaaccgtaatgacgaacacccctaaactcccataattggtgcggattcctgtggggaaggcctatactgttgacatcttccaggccatctcaaggttctggaccttgagaaggaggctgtggaactagagatagtgatgctttttaggatttggggatattccctgcccaaaaaattcctggaaaattgactagtattaagtgtgaagaaatcttgaagaccagaaattggatcttactgaaaaactgattttttttgtttttcagattatattgttcagctatggaagatggattttttttcatgatcctttgactctcaagttcatctttaaatgaactcttttttttgttttgtttttgaggagataactaaccctagctgtctccagtctgacaaaggttatttgaatggacttaatctcccagtagttgggagatgttttaaaaacacatgctgtgtttgaattgtggctgagaggttttcttggcaatgtgaggaggaaaattttttctgcttcattattattaattcatggattgagtgttggttcgacctacaggcgtaatagattggaactcagtgaagacacagacgttcctgttgagagcaatcagctaatgattacagtttaaagacaatttctgtgatcaagttgtcatttggaagattaaacccatttcacgaggacttggagcctggtccttgctttgaggaagcagtggcttgtttcaagaagccacttctgatctaagaatctacccagcatgcctaatcaaggagaagactgctatttttttttctattctacatgtaccaaaggtgacagctgcccattccgtcactgtgaagctgcactaggcaatgaaactgtttgcacattatggcaagaagggcgctgttttcgacgggtgtgcaggtttcggcacatggagattgataaaaaacgcagtgaaattccttgttattgggaaaatcagccaacaggatgtcaaaaattaaactgcgctttccatcacaatagaggacgatatgttgatggccttttcctacctccgagcaaaagtgtgttgcccactgtgcctgagtcaccagaagaggaagtgaaggctagccaactttcagttcagcagaacaaattgtctgtccagtccaatccttcccctcagctgcggagcgttatgaaagtagaaagttccgaaaatgttcctagccccaagcatccaccagttgtaattaatgctgcagatgatgatgaagatgatgatgatcagttttctgaggaaggtgatgaaaccaaaacacctaccctgcaaccaactcctgaagttcacaatggattacgagtgacttctgtccggaaacctgcagtcaatataaagcaaggtgaatgtttgcattttggaataaaaactcttgaggaaattaagtcaaagaaaatgaaggaaaaatctgaggagcaaggtgagggttcttcaggagtttccagtcttttactccaccctgagcctgttccaggtcctgaaaaagaaaatgtcaggactgtggtgaggacagtaactctctccaccaaacaaggagaagaacccttggttagattgggccttactgagacactggggaaacgaaaattttcgacaggcggtgacagtgatcctccattaaagcgcagcctggcacagaggctagggaagaaagttgaagctccagaaactaacactgacgaaacaccaaagaaagctcaagtttccaagtctcttaaggagcgattaggcatgtcagctgatccaaataatgaggacgcaacagataaagttaataaagttggtgagatccatgtgaagacattagaagaaatgcttcttgaaagagccagtcagaaacatggggaatcgcaaactaaactcaagacagaaggaccttcaaaaactgatgattctacttcaggagcaagaagctcctccactatccgtatcaaaaccttctctgaggtcctggctgaagaagaacataggcagcaggaagcagagagacaaaaaagcaaaaaggatacaacttgcatcaagctaaagactgatagtgaaattaaaaaaacagtagttttgccacccattgttgccagcaaaggacaatcagaggagcctgcaggtaaaacaaagtccatgcaggaggtgcacatgaagacggtggaagaaattaaactggagaaggcactgagggtgcagcagagctctgagagcagcaccagctccccgtctcaacatgaggccactccaggggcaaggttgctactgcgaatcaccaaaagaacatggaggaaagaagagaagaaacttcaggaaggaaatgaagttgattttctgagccgtgttagaatggaagctacagaggcttcagttgagaccacaggagttgacatcactaaaattcaagtcaagagatgtgagatcatgagagagacgcgcatgcagaaacagcaggagagggaaaaatcagtcttgacacctcttcagggagatgtagcctcttgcaatacccaagtggcagagaaaccagtgctcactgctgtgccaggaatcacatggcacctgaccaagcagcttcccacaaagtcatcccagaaggtggaggtagaaacctcagggattgcagactcattattgaatgtgaaatggtcagcacagaccttggaaaaaaggggtgaagctaaacccacagtgaacgtgaagcaatctgtggttaaagttgtgtcatcccccaaattggccccaaaacgtaaggcagtggagatgcaccctgctgtcactgccgctgtgaagccactcagctccagcagcgtcctacaggaacccccagccaaaaaggcagctgtggatgctgttgtcctgcttgtctctgaggacaaatcagtcactgtgcctgaaacagaaaatcctagagacagtcttgtgctgcctctaacccagtcctcttcagattcctcacccccggaggtgtctggcccttcctcatcccaaatgagcatgaaaactcgccgactcagctctgcctcaacaggaaagcccccactctctgtggaggatgattttgagaaactaacatgggagatttcaggaggcaaattggaagctgagattgacctggatcctgggaaagatgaagatgaccttccgcttgagctatgagaaatgattgatagctgaaggtggtagtgaggacactttaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcaaacttagtgactccttgaggtgtttgtcagttttggcttttttctcctttgttgtattctttatgtattgtcttgatgtacttaatattacctgagtttgaaatggatgaagacagctgctaccattaaggaccaaattttatgctaccactaaacaaaaatacccactcagtctgtgttagattgtatgtctttttaaaggtatttagagattcaactaagctttaaagagggctgagcagctcaggaagcctgtaatgtgggcataactctttggacctgatcttgatgcttctgctgctctgttggcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcccttttcttcttcagtacttgcctccttgctggcattgaattaacacagggacaaaatatggttaattttttatttctaattctcccaacaaacccctgttgcccagtatttatgtggtggcctttaaccacctgagggaaaaaatgagcttattcaagctgccaatatttatctatgggctgtagcagtacactgaattgtactgtgccagggatattgagatgctctgggggtatattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccccacctgtcatgttggctcctaaggaactgctgttgtaagcggctcatcaagagttgaacttcacgtagccttgttgggaatatggaaaaggaagaaagccacaggactgcccattcagtcttgttaagattgggatgattctgcacaagcaaaaatgacttgaaatttatgtatcgacacacctctaccaatccatcttcagctgactgaatgttgtatgatagcccttctccaaagcaggggtagaatgttcaggtttcaccacggattttctacttatttcgcttttggaatcagcttacagattccaggtcccttttgtagatattctttattcttttgcttttttaaaaaataaactggtattagtcaatgtttcgtgttccgcattatttgaaccatttgcccttacagaaagagaaatacttgtttgtgttttaaataaaactgatgtaggataaaaaaaaaaagaaagaaagaaattagccaggcgtggtggtgggtgcctgtagtcccagctacttgggaggctgaggcaggagaatggtgtgaacctgggaggcggaggttgcagtgagctgagatcgtgccactgcactccagcctgggcagcagagcaagagtccgtctcaaaaaaaaaaaaaaaaaaaaaaaaaaaaaagaaagtctagattttgtagtcttcctctggaaagccgaattttgttttgccagggagttaagttacttaccattcaacctgatcctttttaagcgtatttttaagtttgggagtatgcgtctagagtaagtttttctttagggctaatttaattatccttttgaagcacgcctcttcaggaggctcgaggaaatattcagggtggtccgcaatgcctccattctggctggctgcaactcaacccccagctcacaaatcccagtagctgtttttgcctggcctcacagagtttcatttcatgcatatgtagcctaatattcaatgaaggactcaggatagctgcctgtatagatttctggagttctttctctctgtgcctcacatttcagctcttttagctcctttaactctgatctctgtctattaaattcagtaagttggatctgccttgtcatggttcctcctctcttactgcagtcttggaagtgcctacatccagaaagccatgttggttctagggcttacctcatttcttttcctgttctgaagactcacacttctgtgctgtgtctgttttctaacgtctgaaaacagctgtctcatgtattttgtccaatttcctagctgtttacagcagagagacagatttggtaccagttattctatcacattgagaagtgatagtccctaaacttgctctaaacatgtttagatttaatgtgaacaactaatgtttccattttcagtttctcttagcagttttcaggagcttcaatccgttaattctcaaatacatccataaatcacttggaatatcttaatgcattgtatgaaagataattcctcctctgtacccatcatcaccactcttcctttaaattgtgggatatgtttttctgagactgtggctttagtgtgtacgagaaaaattcagttgttatcccctcattttggggagtaaaaataataagaatgaggagcattatagtatctaatcttgtccaacaaaaacctaggtaactttggaagttttcttctctctcccccactctcccacttctatgtgtgtataagtgtgtttattgaataaagagccttttatttttatttatttatttatttatttatttgagatgatgtctcactgtcatccaggctggagtgcagtggtgtgatctcagctcactgcagcctccacctcccgggttcaagcgattcttctgcctcagcctccctagcagttgggacagactacaggcacatcccaccacgcccagctaattttttgtatttttattagagacagggtttcacttgttggccaggctggtcttgaactcctgacctcaggtgatccacctgccttggcctcccaaagtgctagaattacaggcgtgagccactgcctcaggctgaataaagagccttttagataatgtcttgcctgacaagtttaaaacaactttcttaccagatatgccataataaaaatctccaagaagttttccttaggctacatctcaatgggccatttaatactatatcaataaactttattacataataagatcttggtgtttatcagaaagggatttgagccagggtgttttaagttggttagtatcttgagtgagaaagatctctgttttcattagccttctcagaaaaaactccccctatttatcaggaatgcaaatgtttcagattgaagtgggtacccagacatagctcaacattgcacaaacaggtgccaaggggaatctgtttccttttctatctaactccaactcctttgaatttttttgacaggtacttagaaaaactgggattgacaaagtgatacagtttgagttatatgttgccatagaaagaggcaagttggcaaatattttggtaaatcatttcaagatagctttgaggaggtcctcaaagcttagtattatacatagagcaagaggattatatgaagtatgaagagaaaatttcttctgattttctaaggaagatattgtttaagatccaagactagaaaaccagttgaataatgtaatagtagtgcttgggcgaatcaaaccttttggtgtgttaagtttaaattctcaggaggatcgggaaatccatggaaccagatggctcctaattgtttacaaggagaaaaaagtcatgcagaggttgagaattgcatggtattaaaacctatagggttaaaaaaattagaaaaaactagtgtggagtttggagtatttcaactggtaatcaaatacagaatgttatgagatagctgatgagatattctttcgtcagatttcctcaaataaataaaggctgttgatggttccatcaagacagttttgcgtgtagggaaataattagcatgtgttttatctccgttaacatatgttcgtaattgcacccatacacttccttagaaggggaaagtttgcaggcctctgaaatgacatttgtacttccatagcagaattcaaaaccaacactatagaaagcatctatagctgccttaaagaaaaaaattggtgaatcagccaagggtgatgggaaacatggggcctgatagacttgtcatatcttgttacaaatgttctcaaaaaagcattattcatgtgcctctgcttcctatgactagatatcagatatcaccaagtctctgtcactgaggagcttatagcttaaaagggggacttttaaataagtaaacacactagtagacattaatcagctcaccaaccccaaaatattggagcattaggaagaactgaattcgaatcttcgctctggtacttaaagtgtgattatgggaatgtgttttaattttaatgaacatcagttcccatctcagttaatagcaaccaagcttcccggtaaaaattctatggttatcctttatgtatctttccccttgcctcttactgccaatttagcagcacgtccaattgatcctactttcaaacagacgtgactacttctctccctttcacagtgacatccaaggccccaacatctattgcctagacaattggcctccagtctacttctacttttgtcttcctccccttgatccctgttcaatttttcttggttgaatagccatattgatcctttcagtatgcattggatcacaatactatcttgctccaaccccttcaggtccctcccattgcactggactatacacactcttggctgggcgtggtggctcatgcctgtcatcccagcactttgagaggccaaggtagacagatcacttgaggtcaggagttcgagaccaggctggccaacatggtgaaacctcatctctactaaaaatacaaaaattagtcaggcaaggtggcatgtgcctgtaatcccagctactcgggaggctgaggcaggagaattgcttgaacccaggaggcagaggttgcagtgagccgagatcatgacactgcactccagcctgggtgatggagtgagactctgtctaaatctatctatctagctatctatctatagatatagatatatctgggattagtggtgaccagcttccaagatgaccctcaatgatcctgcctgcctctgagtacccacactcttgtgaagttccctccctcacacactatgccagggttagtctgtttgactaaccctggttagtcaaaaacaaaaacaaggaaataaaaaaacccaaactcttcagtatgcccttcaaggctccatgtgaccttgtcgtgtctacctcttctgcctcatctgaaccttagctctttccacacccttctcattctgctacagtcatctagtccttactgttctatgagcagctcatttgctaagcacatttcttctccaaggagtggctccatttctcgagtgattcccatttccactggctggtttatcattatcatataagctccatgtctaactcaagtgttaccacttcaaatgggttttcaccatcctagctaaaatagcagccactgtctctcttgctctgttttatatcttcgtggcaatattgccaactgaaattttattattattattttaaaatattatttatttcttactagaaggttagttctgtaatgaccaacttttcctgtcgtgttcactattgttttccaagcacataatcgatacccattaaatatctgtcaaatgaatacgtaatttttaatggggatgatgaataaaatattattttttgaggagggaataaaagaaaataagtatatctataaatactacacttgatcttagccaaaaggccgagaagcgatacgtatatctataaatacttaaaaagtatgaagtactacaatattaatattcttagatatataactaaaagggttggatggtaaacaaagtacttggacatgtttctggtaagtttctctatgagctgggacataagttttacatttaatcctattttctatgttaaaggaggataagtgagttttacccattgaacaaatagacccactactcatatttcacaattagctgctttatgcatatttgaccaacgttgcactttaagcaattacagataacacttagtcctggacttacagatggtttgacttatggatggggaacgcagtagaatattgtgttcccaataatgctgcctatttacaaaagcagagtttccatccttttcattagttaaaagtgaatagtttttactaattaaattaatatttaatatttaatttgtgtcaattaaatatgcacaaattctgcacaaccctcagcccccttttgcagattctgatatgacagttgagtattattatatgagtaatgataactgtcagggccaatgttggaagcaaccatgtgacctactaatacaatatttatcctctgtccctttgattttctgtttagtaggctctccaaattatcactcattatgtatcccaaagcagaaatcagtgtaggtagcattactaaacttagcaaataaaaatatgggatgccaagttaaatgtgaatttcagaaaaatgagtgcttttctggtataagtatgtcctatgcataagtatgtaggggtaccgttttgctaaaaattatttattgtatatttgaaatttatatttagctggatatcatgtattttatctggtaaacatatatataggatatagccagtgacataattcctgatgccatcactggtcctttggctcagaccacagtatttctaatatcagcggagcacagctagattgttcaactgttgcatctgttaaggtggttagaagatggtatttcatggaacaagaatatttactatgccttcctttatctaagtgcctttaatatgtttccttttatttgaataactttgagtgagaaatagacataaaggagagttttcctatgatgcttgactaactctgaatacttcctggcacttgtaagataaacttggtcatgataaattaagtgatcagttattgctcccaaggtttctgtcatctgggtttagggtcagaggtggattttctgtgaagttaggaaaactatagctttagggccgtcactcgcataggtcacttccatggccccatgcctaattttgtattctttttcttaaatacaaaaaaaagagacctcccaaactctataagtgccatgaaaacctgcattctatcccctcatcccccacccatgtctagggataaacagtctagcatgctagctctagataattgctgctttggataatttccagataaaatgcccaaattgacaagacaaatgttttacatgtaaacaagttgcacttacttatctcaggcccccaacaacctgattcatttcagctattggctttttcttttctctatggtcacagttatcacagtatgctctcaggaacatgggggcagagcttcaacgttaaacaggtctttctgttttcctttccactgggagatacctagttcaatgttcctgtaaccagttgtaatatatgccaatctcaaagttaaattctggctctttaggagggagctttcatctgaagacctgggatcttcagattatcactgcgttgtcacttcccctaatttaacagctgcttgttttgctttactccagtcctcaacccccagatgaggtagtagagatcccctactgtttcgtggaacaccagcaacacggacacaaaggcaaactccagctttcctcacacctcttaaagagcatcttgaaccctacaagtctagatggccctggcctattccctgggggatattttttccccataggtagggctggtgagatattatgttggagtcacccggggcctattcttgtacctcttctgtctttctttgggtactttcattcacttggtaatcccatcttttgtcatggctctaaaaaccatccaaatgttgacagctccctagtttatatctgggaaataataggagggtttagagtaaagaagtgacccgatacatgcgtgattaacacatgcttaaaggatcagccccgaattatcccttgactcaaaacttattcaactgtctatctgggtgtcctttaggcatctcagacatactgtgatcacagctgagctcctgatcttgcctccaaatacggtctttctgcagttttccgtatctcgataaatgacaacttaatcttcccagtgtttcaggccaaaaatcatggagtcatttctgactcctctgttattctcacgttagctgttcaaactacctaaataacagtctacctactaaataccctttgtctctaccttcagaatatatccagaatctgatcccttctcagtatcttcacagcaaacacctggcccaggccaccccatctcctacgtggccttgtaattgcctcctaactagtctccctgcttctgttttcagccaactttagtctgtactcaatgtagcagtcaaagcagtcttttcaatacataagtcagagcatgttagttatcctctgctcaaaagcctccaagagcttcccacattaataggaataaaagcccaagtcctataatggcctgcaaggtggtatctgatcagaccctctgcaacgactattgtccttgtctcctaaaattttatccaccacccactcccctccagccttgctgaccttgctgtttttcacagaagccaaacatttccccacttagtgcctttccattggctgttccatctgcctggattgctcttccttcaggtgtgtctatctgtgtgtgtgtgtgtatgtgcatgtgtgtgtgtatacatgcttacatgcttccttacctccttcaagtactttctcaaatgttaccttctcaatgatcaccccatttaaaatcgaaaccccccctccacaattgttaatccttgttttgatttttctccatagcattcattacttctaagataggtttttaaaaattttttattctgtctcttccaattaaatataagctccatgaaatcgggtttttatctgttttcgttcctgctctatcattcctagcactcagaatagtgcctgtcacaagaaatggagggcactcaacatatatccattgaatgcataaaacaggataagaaagtcttaaacatttgcttaatgtgtcttcatcaatccttaaaggttcaaaagcactcaaccctctttctcttctttggacttccccttatggtgtgtgtgtgtgtgtgtgtgtgtgtgtgtgtgtgtgtgtgtgtgtgttttccagctaaaacctaatatccttgagtcacaccattaagagagttgcagctagctcttcagaaatcttgtatctactgaactccaagaacatcatttattcagtacccaaggatgggacatagccaatgatgatgatgggaacattttcaggaactgtgctcactcacatagatttttgttcatggaataagtttctgaaggtctgtttatcagggtaaaacttcagtcctgtatcaactaacaatcccatacagaagggtcactgtttatatttctccaaagcctggtcaaaagtaactttgactaatttgattaaattgattgataaagtaaatcatatcaccaaaacacttctcattccaatgcttgatagttatggaatttgctgagaccacccactgaatacccgttcaaatgaatggaatctcacagagcacacataatcatctctgacttttgtagccatagggatacattaatacctgtgcctcatacttaactgaaaatcaccagttgtctgctgagtagtttactgcatgtcaaatctgaggtccagtgtaatagactgttttaccacttctattcagaattttctaattcatagacattctaattttatttgtctttttctctcaaataccatgatagggtgaaagtttgagcttttgtatcttaatgtttattgaatattaagatacatagagaatactctactatacataaatgcataccattcaatgaattgtccttggatgaacattgctgtaaaactattcaagttaaaaaataatatttccagtatccagaagtcttctgatgtctcctccccatcactactcccttcttcctccccaatgtaactgttacgctcattctaacactggagttcagttgtgtctcttttccaactttctataaatgaaatcatctgtataaatcttgcatctggcttcttttgctccatattatgtttgtgaaattcatctatattattgaatataataactgtggttcattcagtattactgcttcatagtattccactttatgaatttatcacaatatattgtttctagtttttcatttttataaatcatgttgctctgggcattcttggaaatatttttggttaccatgatcccctttctgttgaatatacactttggagtgcaatatctgtgtcataggtatgtacatgttcaactttagtagataatgtaagcagttttcctaaatcattgtcccaatttaactcccaccagcaatataagagacatcctattgctacatatccatgtcagcagttaggattatctctcttctttattttagttattctccttggtaaatagtagtagtatctcattgaggttttaatttgcatttctctgactacaaataagattgaaaatatgcagatatccttttcctgaagtgtccactcaagtatttccttcttttttctattgcattatttatctagttatagttaatttgtaaaagtttaaaaattatttatctggatgcaagtcttttgttagttatgtgtgttgcaaatatcttttctcactctgtggcttgtttttatagtctctaaatggtgtttctgttgaaaagaagtttttaattttaaaacatccaatgtatccatcttttcttatgaacagtcatttttggtcccaatttatcaaatccttacctatcctaaagtcttgaaggtattatctgagttatagtcttagattatcttctaattgatttattattttctctttcacacttttcacagttaaatctacaatcacccagaatggattttcatgtgtggtgggtggtaagggtcatttcttttttaatcgtcaactttttaaaaaaattatttttatactttaagttctgggatatatgtgtagaacatacaggtttgttacataggtatacaagtgccacggtggtttgctgcacccatcaacccatcatctacattaggtatttctcctaatgctatccctcccctagcccctctccccctggcaggccccagtgtgtgatgttcccctccttgtgtcatgtgttctcattgttcaactcccacttatgagtgagaacgtgcagtgtttggctttctgttcctgtattagtttgctaagaatgatggtttccagcttcatccacgtccctgcaaaggacacgaactcatcctttgttgtggctgcatagtattccatgttgtatatgtgccacattttctttatccagtctatcactgatgggcacttgggttggttccaagtctttgctattgtgaacagtgctgcaataaacatacatgtgcatgtgtcttgaattgaaccagcatcatttgttgaaaagactatattctgtgtggatttcaatttgaaaattttatataataaatattgtatctatatttataactatgatttctctttatgtttgtaaggcttagcaattaggatatgctatcaatttatcattttaaggctgattttgtctttttttaaatgtcaaagtatttattttacctcaattgttggaagaactcattggttggagcagctaaacctagatctttgtggagagataatggaaaaaatctgtaataggtgtttgattttctacttaaatctattcactgattactaatttgctcagtttattttctggagtcaatttttagtcatttatatttctccagaaaattatacatttaaaggcatgttttatttttactactataaagctacattcaatattctgttaaatgtgtaaacaattcttgtaaatactgtttttcatttgtagttttggtatgatttttgttttcctattgttacggtctgtatattttataaaatgaatgtctttgattctgttatctattgctgtgaaacaaattactccaacacttagtggcttaaaagaacaaacatttagtatctcatgcaatttctgaggcaaggaaatctaggggcagcttggctggttcaacatctctcacaaagtcacagtcaagcttttcttcctgggctgccattgtctcaaggcttggctggggctggagaatccactgttaagctcactcacttggataccgacagagctcaattccttgctagctcttggctggaggctacattttctcttccttccttccttccttccttccttccttccttccttccttccttcctttctttctttctttctttctttctttctttctttctttctttctttctttctttctttcagacagagtctccctctgttgcccaggctggagggcagtggtgcgatctcggctcaccgcaacctcctcctccggggttcaagcaattctcctgcctcagcctccagagtagctgggatgacaggcgcccgccaccacgcccagctaattttttgtattttcagtagagacgggatttcaccatgttagccaggatggtcttgatttcctgacctcatgatccgcccacctcggcctcccaaagtgctgggattacatgcgtgagccaccgcgcccggctggaggctccatttttttttttaccgtgcagtcctctccatagaactgttcacaatatagcaacttgtttttcactcctttccccttctcactcctcttttccagcaatagatcagagagagagagagcgacaaagacacaaagagacagagagaacaagagagctcaacgtggaaattatactctttcaaagtctaatcttagaaatgacttaccatcacttccacatctgctattgttcaaacagactaaccctggtatagtgcgtgtgggaggagacttcacaagagtgtgggtactcggaggcaggcagggtcattgagggtcatcttggaggctggtcaccactgatcctggttatatacatattttatatatatattatatatattttatatattatatgtattacatatattttgtatatataatttatatgtaatataatatatataaaatatatataatttatatatataatatatgtattttttaagacagagtctcattccatcacccaggctggagtgcaggggcacgatctccactcattgcagcctccgcctcctgggttcaagcgattctccttccttaaccactgaagtagctgggacaacaggcatgtgccaccatgcctggctattttttgaatctttagtagagacggggtttcaccatgttggccaggctggtctcaaactcctgagctcaagggatccacccgccttggcctgcgaaagtgctgggattaccgtcgtgagccactgcgcccaggctggtcatagttttgttgtgaattctatttttttctgatattaatattattttctacttttgatttgtgtatttacatatatatgtttacatgatttttatctttatatttttaaacttttaaaatgtcactatttggctgggtgtggtgtctcaggcctgtaatcccagcactttgagaggccaaggcaggtggatcacttgaggtcaggagttcgagaccaaactggccaacatggcaaaaccccgtctctactaaaaatgcaaaaaaaaaaaaaaaaaaaaaaacaattagccgggcatcgtggcacatgcctgtaatcccagctacttgggaggcggaggcaggagaatctctttaacccaggaagcggaggttgtggtgagccaagatcacatcaccacactccagcctgggcaacagagtgagtctccatctcaaaaaaaataatatatatatatatttttaattaaaacgccactctattttagcaaaacatgggttttgttcattgaatctgaaagtcttcagttttccatagaagaaccgaaaacatttaaatgtactgtcctgatacttggccttacttcttattcctcttattttcaaaaacattgttgaattatatttgtgtctttattaagatgatgtccaaacaggagtttaaaatttcttctgtataatcatggaacattctctgaactagcacattgtagacactcaataagtatttgttgaatcagtgatacagatagatggatggttggttgaaagaggaatgacgccgctttgctaggggaggtgagtgtaggactccctccctcaaagtagtctgttaaacagggaagtggctgcttggttatctgaacaagtattcactccacattttgagctagacataatcattgaaagagagctagaatgccttcctattgacttcctggcctgctgggaatttttgcttccttctcccccagccatccaatttttcaagaaaaattttctgtttgccagcttatttccccaactcccctactcttttgtctttcctaccctctaaagagagtctaggtctcacaggtgatcttttgtagctctgtgatgcctaataatagaacagaaaaggagatggggaagaactgacagaaagactaaagaaaggaattaactagcgagtttaagtggagctgcctaaggatgcaatgcaggaaaaaaaaaacacacacacacacaaaatggatggggactacatgctgaagggactgaagtcaagagggagaatttgggctgcgagtcagccaatgagagattccaaaaggaatagaaagtgctgagaagacaaaagcacatgtagcctgataagggcatggtgaccaggagctcaggtccctcagaaatgagtgtctagttcatgccatcaggtaagctactaagactagcagagctgcagcctgatataggaggaatccagacggataatggaggaaggagatgatgagtatcagttgcagccctgggactggtgcagaagcaggggtggagttcctcctattaacttcccctattgtagatttcactgggaagagatgcctcttggtacagtggaggaactgctccttgaacgtattcaagtggcacatttggctccttgaagtggatccaagtggcacatgggatagatggtggtagaaacagagaagtgcatctcagaaggacatgttgtccttctgccagttatagttctgccagtagatagcctctagggctcagccccttcagggattcttttagctgcagaggtgcaggttaaacaggttgccttaaggtggcccttaacaagtggccttaaacaggtggcctgaaaaaggtggccttagctaaggccaccacccccatcccctcaaaggttggcatgcagtgactgatggagggccatgttcaccctaagtgaggcaactccagcaggcacctacagcttcctgtggagttggctaaggcaatcaggtctgcatcacaacctgacttctccctctgctcaattgttttccccttcttttcacagctgttggtcccaagggataccctagaaatatactaaacgctaaacattgtctcaggtctgctgttggataactcaacccatggcagtgctctgtaagactacggagattttgtgggattaaaactagtagagagtatgaaagcctttttttttttttttttggcagatgcagtattctgagaaatggattaacatgatttaaaatggtggccaagaaatatgattcttcttgtttcattggaaggcctggaagtgtaagaggctaaaatataaaacagactgggaatttgtttcaggagtctaagaataaaatccacaggctaaaagagggttgcagttggagggaaaaaatgtacttgctatttttcaaaaaagagttggaaagatttggtgtcaacctggatgtgaggatgaagacaagccagctagaataaatattgattccaagattgagggcagaggtttctgggagtgtcactgatgggaacagacaaaatggaaaaagacttaatgaagaagataatatcctcaagttttgacatctctaatttaaaatgtcaacaagctatttaagaggaagtttctttgtgttgggagccaccttagttgtccagccatattaaggggctgcaatacagtcatgaaggctataaccagcactatggtatcatgcccagtctaaaatgaggctgagctctgaccaatgtgggggctgcatgtgccaggaagaaggggtgccttttctgactggcacaaagatgttgtgtgagctggtagggggcctggccattgcctcaaaatcagtgagagagacaatgtgatgtctggtgaaatgcacaaatttggtttagattagagatggaaagttagtgaaggagaaaaggctttagtaagttagatttctttagggtgggagaataggcaagtcacttaaaccttctgaatctccttttccttatttgtgtggcaggatgcttttcttttctccactccctcacagcttcctcgtaccaagatatgatagctgaatgagatatttggcaaggcagagaaaagagatggagacgcttagcctaattaatgtgctacacttatgccaagaagggattctatgcttacctagcagataatttaccctgaaactggactaggcaggtcacctttttcttcattttattcttgcatatgcaagatctaattatccagacgtatccacagagagaggaaccagatgaaatgaggaaagcacggttcaccttcaagagaaagaagtaggactctggggttttaagccgaggcatgaaatgtaccgattaatagcgtcattttggaaacacaggtctcaggagttttgggaaggttagtatgagcttgtcagcattgcttatgaataacagtgagattgctgctttgcacctgatctcagtcagacctcagaggctcagccactggggctggttatgcagcaggaatatatccatgcgaccagcagggtgtaagaagtccaggccaggacgggcgcagtggctcatgcctgtaatcccagcactttgggagaccaaggtgggtggatcacaaagtcaagagatcgagaccatcctggccaacatggtgaaatcccgtctctactaaaaatacaaaacttagctgggcctgggggcgcgcgcctgtagtcccagctactcaggaggctgaggcaggagaatcacttgaatccaggaggcagaggttgcaagtgagccaagattgtgccactgcactccagcccaggtgagagagcaagaatccgtctcaaaaaaaaaaaaaaaaaagaaaaaagaaaaaagtccaggccagactccatctcaggctcactggttccaatgtgttccatccatacctcagtggctcttgatttagggaaaaaagcacatcctgctatttaatttgcaaaaattaaataactacttgatgtgtcttttgtgcagataatacccacaaaatattagtttttgccctttttcccttataattttaacatacttattttctttacttgtctcatgttttctttcagagattctaactctctttgctaaatggatataggaataaatactcttaaaatacattttttattgtattgatgtggaaaatgtagaaaagcacaaagggatttttttaaaactctgcaatatcatccaccagtcataatcattattaagatgttttcacagatattcccagcttttattctataaataagactctcatgattcacttatccctcacttgtctaactattttatactttttgacgcactaagattctaaaatgaaccataaaagctggcacatatttatagtaatcagttttcttatttaagaggatgagatagatgagtgtaaataatcttgctatacacaaaattgtttctgctactctgaagacaaggtgttcttacatctcggtctttgagcatatatgtaataaagttttgtgtaaggttgcagactttgtctttaatacaaaggaaaacaacaggtatagccttcatataaattatctcatttaatccataccgtgattttatgagattggtactgttaccttcatgttactgatgagggacctgagccaggagaggcaaaatatctcagtcaaagtagcccagctgctaaaagattctgcctttgaaaaatcgcctgccattgacacctttgtcaccgtcacctccatctctgtctgagccaccatgatcttttttgacctattgcaaaatctatttaacggctacctctaccttggcccctgtatagtgaccaaagtgagcctttcaaaaacataaagcagatcatgtcattcctctgcttaaacctttcactggcatatccctcagggtaaaatccagagcattagtagggcttctaaggttctatttaatctattccccactccctcactttcccagtcactctggtctcacctctccctcttgcttcctgaactcagtgctgccattctccacacagcttgacatgttcctacctcagggcctttacacctgctctgtctcctttgccagaaatctatcactttattcccatctctgattaaatgtcactgctccttcaaacccttgcctggctacgctatataaaatagcccctttcccagctttctttatcaattaccccgattcattgtttttcccgtggtatttgttaccacctggcttttatttgtttatttcttcatttgtttattttctgtcttctcctgcaagaatgttactgtatgagagtggggactttgttttatttgttgtatttccaggcccaaaacagatcctgggcccactaaggaaaatttgttaatgaatgacggaaaggaaggagccagatttccagttcacatcttcaccctaagtccaggctatttcctctatgcattctgaataccagagccacttgaaggaaggaacatacagtgaaacaccggtgatattgtaaaccttccttgcaaccctcttcgcttgccttgctgagattaggaagattggaatgagtcaaagccagagtccttcctcggaagatcactctagcatttgctcttctccactgtcaggaaagaagagaaagcatagagaaaatggtacctataacagtgaattcacaagaaagaggacatgagaccatttgattgtacataagtaacctggactttggatcagaggaccctggctctgctgtgtgacttggaaaaactttttaaaaacctttctgaggttgtttttatcatttttaaaatgaaattaatgatccttcctttggtcatgagagtcaggttctccaaaaagccaaaggaactgtttcctcacgaagtgtcagagagatttttgaaagagctagatactgtatctctgggattaaagtgacaaagcatggcctttaagagatcagaagtaaaagatattttagcacagtggattgtcagtctgcattagcaggtggtggaagagctttcggcagacatgcccctataacttcagttagtggcagcaccattggcacaggtacacccccaggcagctggccctggtaacaaggtggcagcaaggggaattcacatttagaggcaatgaaggcagctgtcgccaccatcataaacttctcctcctcctccttactcttcctcataattctcctttctccctcttctcccctcctcctctcccttcttcatcctcctcatccttcttcatctagctgtgatattttttgtcctggatttaggttgtactggtgaggatagagacagcaaatcaataataatattttaaataaatttttaagcacatatacaacaaacgctgcatttgatacctacactgtctcatttcatcattatttaatctcccttaaggtaggtatagtaactctgcaatggagttgagagaaatgaggcataggagggagaatgacttgcttaaggtctcacaattcataagtgatggcaggaggatttgaacttcttggaggttcagatttgaacctggagtctctttgactccaggacacttgttctaaagtcactcagattcaaaaggtagaatcagatggcttagtgattggatgtgtcagggacaggggactgtgaggaggagaaggggtctaaaatacttcctagttttctgatttgggtggcctgttgaaatgttaatggtgctttacccagggtagggacactctgactcctagaaatagttccagcctctaattagtgtcgagatcattttttaggttaaaaatgagctttgggctagagttacaggaattcttatttcaatctttcacttggttttgcctgtaatagactggctaaactgtaagaggcctcctattaattttaaactgtcttgaactcaaaatagtcaaagtattaagctaatgaaagagcagtgttcttgttgttgagtaatccacttatttattctatagcttcctctcccatgctctttgttccctttgatcataattttaatgggttttggaaaaaatagaaacccatgcactacattggctatatttaacaggagtacctataaaatatcattttgtctaatgtactgtaaataattttttccagatgcttgaatgtttttggagtgtatacctttataaattatacatttttatataacacctgtatctgtttttcctttaattgcttctcaatcttgtgtcacgtttagaaaagcctcctcattttaagatatacaaatattcactctcattgtcttttagaaagcgatagatttatttcataaatgaattatctgataaatttttaaatggtgtaatttttttctaccattgattagaaatgctatgtatattaaaataaattcatatagataagtacatatatttatatataagatatacatatgcatatgactcatatatatgagtcagtgtctccctcagtagaatgtttgatttaacaccccagaacatattttaataccttgttttaatatcttttctcatactcctatagtttttctttctttcaacttttatcctttttatatacacagtaaaacaaaaaatttatttttgttttatatgagaccatatagaatttatatatgaatttagaattaccatatctaaaacattgagcctttctacccaagaacatgctatgcaattgaaagcatttaataatctttcataaatcattcattataattttaagattttcttttgttatgcatttataacagtttattccttggtgttttatcttttgggttactattgtaaataaaatattagtcttcattttattttctaaacgacatttatttcttattggaaatctatacatttcttacaaagatttgtcagtagaccacaaaataaaattattttatttctaataagttttttaaatcaattcttttattttactatattcataatcatatctataaaccacaataattgtgtttcttcctatccaatttatacttcctcattttttgacttgtttatatacttaaatactttcaggagcctaaattaatagcaggcattattgattgtaatgcaaaatgctttattacgtcaacataaagctaaataaaaactactttttatctggtttaacactttctatcctaaattccaccttgatatatcaagtctgtagttccagccttgttctcaattaagatctctccagtaagtttttcggttgtgtgtttttgatccttctaagtcaaagtgttataatgaacctcttaacctagaattgctcttactttgatttttgaggtaatttaatagatgttaataaccaatatgtcttttatgtgtttataatatttttgttttctattttgaaatgtgaattgtgttttatttatttattttgtggtttgtgatgttatttatttcttataattttgaaatatttgtctgcttttgatcctctattatacttttaaaggtgtataatctacttagctttgtacttcctgaaatggatacactaaaatcaatgagaccaatattttctattaatagtgcatttttggtttttgtagcacacactttacttcatacaatggaattcataatgtatcctacctacacacctaatattaaaaattaaccaagataattccctaactctaatataaaaagtataagagaccactaatttacaagaccactatttctatacaaaaaatactaaggaatgactgaactagaagatacattgaagtggttagctctttgcactcatacacagaattaccatgggtttggtagccataaataaagactgataatagtcatttcctattagacactcaagtaggatgatgtatttttttcaatatagttaaaaaattctaagaaatttctgaatgaaaaatatttattgacttaacataaaaaatttattcctgatatagtcaatgattattaaaattgtgtaaaaatatttcatgccaatatgtgacatgaaattcagatctaggcttagatattcatatataggttttatacacacattaacatatgctgtgacttttagaaattgtgcaatctgtgaaaaacgtttgctttgcctgaactgttctgtgcattgaaagatttataacattcatcattcactacccatatcctaaaattaaactgttccagtcaattattctgaatattgacaatgactctagaagttcccaagatgcctctagaagacaaaatactctccctgaaaattactgagctgaaataaatttctccaatttacaaaagcactcatcacttttcacccaaccatgtactagtacgtctagcattttgtcataataattaataaattcaaataaattgtaatatatatgtgtacattgatattgagtactaagagaaatggctatcagattgaaagcttttcagtgagtacatcaattttgctaaaatatcaattttgatgaaaattatagtaacctataaatgttactgatatcttgaaaatatgtaaatctaaagaaattttctttgagaaatcaaattggactaaaataatttatgaatgtattgctaactgtattaaatatataaattttaaaatataaatgggaaacaagtgaataatatgatagaaagtaaaaagcagaagcctactaggtaaaattctataagttaaaaatatgatctgatgtgaaaatattataattattagttttttatcatttatgtttttaatgaaaaaaattctaggaatagaaaaactaaaattattcctttacacattatcctgaatcctaaagttatgacccaaataccatataaactgtggatgctcaattactgttgcattaatatggtcaacaaatgcattttaaacttgagcaagctatgcttaagacaaaggtcaccttttaaagattctgcataaaaggctgcatgaaactccaagtcttagaaaataatttgaaaagcaatgctaaaaggttatacctataaaaacgatttaaatataaatttaaataaaaatctggcttaggtagtataaaactatataacatgcacaagtcattttattgtttgagatatgaaattgaagtatgaaaagtcataaaacctgaagctataatacggtcaaactttaattttaaatatataacgtatgtatttgggaaaaatatatgagagataattgtgtatagatgagttaaatttcaacccatatgaaacttgaaactttattattcaaaaatgcttcatttaatgaagtttgttataataattttggtatgtgtatgggtaatacaatgatatgtactctagaattgcttaaatgaatgatttctatatcattttactataaggatttaagaaccaagattatttggttttctagagcataataaagagagaaaatatatcagtgtatgtaagtgccttagacaaaaagatttagacacttgatctagtggtttcaagactggccccaacccaaaaatacattcaatatgacactttcatatgcagttcgatatcttttttgctttaaaggtaaaaatatacccacataaaacttttacttgaaggcagaaaagtttgcatagtatagccaaaataaataaataaacctaaaaccaactattcaacttgttaataaaatcacggacatcacggcagaaattacaatagtcttagaataaataattattagacttttgggatcagaaataatttaagaaaatcctggtcaaattatactatacttttgtgccatattcacataaagctctatttttacaagcctcctgactctacagaaatagtttttgaaacttcacctgattttcttatggacttttagattctacactttgaaacagaactcttacttataactgaaaattatgttttggatatatttaacattacacagaaaatgtgaatctcctaaaatagcctgtaaaggaaacaggttaaatttaaaacttccagaaagaaagccagaagacacactgctataatcaagcaacttgtatgttcagaaagtgaaaaaaataattactttagtactttaaaaatgtgttcactttctaaatgaaacagaagaaccatgagatgtgttctgaagagtgtataatcttacctatgtatagtacattacctggggacaggtatcatgtctcattgtcataacattttgaaaaatatcttccagttagaggagattcaataaataataaatgtatgaatgaatatatttcattctgttatgatatttctggtagcaagtagggattggtgacttagacataaatttgaggcttcaaaaacaggtgggagtcatgaacacttcacagtctgggcatggtattaagaaattaacatcccagacttagcaaatctttcctggtcttaagtaacaatatggctggtatgatttagtctttggctcattaaacattttataaacccccagaaaaattttttgaagatttcagggcaaaaaaatgtggtaatatgcagacctgtttgcaatacatcatttatataatgaattttaatctgcacccatttaaaatacactttaaaagaaaatgtttatacgctattcattaactttgtgtccgttaacatcatcaacattattagtgtctatcattataatactatcattattttgccttataaattgagtttaattgaaaaatttctccatcccgaaatcacaaagatatttttctacatttctttcatttatatcgtcattttaccttaaacttttagatccctatacacatttagagtctacttctatataaggtataaggttgtaatccagtttcatttaaggtcttattatgagccatttcctcaataccatttactaaagaaccctgtatgttcaaatgagattatagccaaatttctcatatattgagttcccgtatatactcgggttgttgtcagagctctctgttgacccattattattttttttcctttaaaggcacccatatgtgttatgtagtctgtcatgtcatatggttcatcagatcccaccccattagtcttccttttcaaagatgacttcataatttagaaaatattattcataaatatatataacatgataattagtttctaaaataacttgcaatatttttactattgcattaaatgtgtgaattaatttgggaagaattaatattttagctaatttaaggcctaatatttaactccatgcattatatttccatttattcagtgtatatataattttctctttttcattgagcttagtggtatatagagggtctttttaatggagaattagagcatcttttttttaattctaaacattttgcatatcttttgacattataacaggtggtatcacacatataatttctagatattgcaactgatatagagaaacttaattttatataaaatacttgtatctgcaacatttgttgggctccattgttagtattaattatgagacaatatcaagaactcattaaagtgttgataaattacaaaaattttgtaatttatccaagattctctggatatcaaaaaataatggcaaacaaaagagaatcacaaaatcagaaaaaaggaaataacatcacaaaacgaaggataattttcttagtaaataaaaaagcttctgaaaatcattgtttcattaaacaagtatttgttgagcactattctatgtgtcttttgtggcttactacttttccttatcaaaatgttttcaatgtttattcgtattgaagcacatatcagtaattcatctttgtctattgctgaataacatttcattgtatggatataacaaattttatatatccattcatcagttgatggtcatttgggttgtttcaactttttgactctttcgaacaaaactgtaaacattcacatataaatttttgtaaagaacatatattttcaattttttgagtatatactagaagtagaattgctgggtgtaaagtgttatctcattgttttgatttaaaattccagtctttcagcctttcaccgtaaagtataatgttagttatgtttcttcattcttcttatttttttttaacttctcttatcagattgtggaagttcccttttattctttatttgttgagtgtttgtttcataaagtgttgtgagattctgtaatacaatttttttctccatctacattatcatgcattttcttctttatttattctattgatacattaaattacattaattgattttaagccactaaatcaaacttatattcttacgataaatcccacctggtcatgctgtataaacctttctatatgttgctgaatttggtgtggtatcaccgtgttgaggattcttctgtgaattaatttgggaagaattaatattttagctaacttaaggcctaatatttaagtctatgcattatatttccatttattcagagtatatacaattttctcattttcattgatcttagtggtatacagagggtttatagtgctatatagagggattgaaaacatagatttgcctatagttttcttgtgatttgtctggttgtgctattgttgtaatattggcctcataaaatgagttgggaaatgttctcttctcttctatttttggaggaggtggtgaataactactcttaattttgctttaaatatctgttacaatgtctcagtgaagtcatctagccatgaacatttcatagtgttaatttttgttagtttgtttaattactgattcaatctttttacttgttataggttagatttcctacttcttcttgaatcaatttcagtagttggtatttttctattttatcgaagttaactaatttttttaatttacagttgttcatagcatttctttataattatttttctttctgtaatttcagtaatattttatatcttattcctgattttagtatatttgttaatgtttaaaacaaatgaaattttgttttttgatattctttattgtttatctatattttattttattaattttactctacattttatgatttccttctttctacttattttatttaggtttagtttcctctcttatccattgtgttgtggaagtttaggctattgaggtatttacagctataaattttattcgcagcactgcatcacccacatcccatgagttttggtatccattttcaataatctcaaagtcttttctaatttctcttgcaatttcactttgattcattgtttaataaagattgtattatttaacttccatgtaattgtaaatttatcaagttacttattgattttgatgtttaatctcattcaattttggtcagataatgtcctttttattatttcaattttttgaaatatattacagcttgctttatagcatagcgtaggatatgatctatcttggagagtgtgccatgtacatttaagaaggttattctgctgttgttgggtaatgtgttttatagctatctactatttctagatgatttatagtgttgtttgaatctcctatatcttagttgatttatagccaagtgttatatctgctattgaaagtagaatattagagcctctaattgttattgttgaattggctatttctcccttaaattattttttagcttcattattttgaggctctgttgttagttgtgtatatacatatatatatacacacacatatatgtttgtaatcactaccttttctgatagtttgattcttttataattataaaatatctttctttttctctactaactgtttcattttttctcttaaaatctattttttccctgatgttagtataggcactccagttttcttcttgatgcagtttgaatgatatttttttattgctttactttcagcttatttgtatctttgaatctaaagtgtcttccgtaaaccatatatatatatatacacacacgtatacataaagtgtatcttctatagatcatatatagttgactaaatcagaaaacagccagtctaaacgtctctaaattttgactgaatttctgaaatcactttatttaaatatttttgatatatttgaatttatgcctgccattttactttttgttttccacatgtcttatatctcttttgtacctgtatttttttcattgtaattattctaatactagtttcttttatactaagtaaatctctagggcaatattttattttattgtatttattttctcatgatagggtctcactctgttgcccaggctggagtgcagtggcacaatcatagctcattgaagcttctaactcctgggctcaagtgatacttcttcctcagcctcccaagtagctagggctaggagtacaggtgtgcacaaccacacctggctgatttttttaagttttttgtagagacaaattatcactatgttgcccaggctggtctcaaactcttggcctcaagctattctcttgccctggcctcccaaaacactgagattacaggcttaagtcactgtgccagaccctgagggcaacattttaattttgttaatgctaattttactaaagcatatgagtttttgtttgttttgttgttgttttttgtagttgctttggagctaatcgtacacatcttaacttagcagaatttaccacagatttatgctaacttaattctacaatgacatagagaagttatttctatacagatatattccttcttccctccttttattgtgctagaattgttatacataacatgtattatgtaacataatatataataactatatatgtatatgtaagtgtttgttatggaaattccaatcattttaatcaacaaaaacattgttaccatgaaacagttcgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttgagagggcaaaattcagtctgtagaaccttgtctccagggagataatttgcattgccaggagacaaaaaagggaaggagacgtttctcactctactcttttgtaatttccatcttttaaatgtgaatgtgaaatttactcagaaaggtaagttacataaaatttaaataatagggttattgtatctacatggtcatgtaaatattaagtatctccattaccatggcattttactaaataatatatcagaatataattaattcaataattttgttttacagacctaagacacatgcatcagtactttgttaggttttgaaaaatgtcacagaaaaatatctgtatcctcaggaaggaacagcccattaaaatattattcaaaatcaacaagtatattccaagattaattcagcaaaagtggagtgtatttagtaaaattgcaaatgttctatttggagaaaagattgctttgaaataaaagttaattcaactcagagagaaaacaactataaatattaaggatacgatcaataaagttactaaaaatatggctgtgcttattcaagatttagaatccaaacagaactcattgggtctagtaactactagcctgaaattaggaagatttgtagacaacaaattacaaaagtaattgagagactaagaagatttaggacaataaatgtaagaattctcttttaattgaaaacctaattttgtagaatgcttaaaatataactaatcagtcatagataaaatagcatttgtaagtactctacacattgcattctttgaagcaattattaatgattaatactttactctgtgctgttatttgaatgtcatagatctgtataaaaattaaaatgaaatgagacagagtccattcaaaatggcataatgcataattggatacaattttaaccttgattccattgttctatataaagctactatttcaatttaatatagctaatgttctaaccagaaatttataatgttaaatacttcatcctaaaacttcaagtgtcatgtctcccccagacagggatattaaaggccattttttatctcaaggtaagcctgaaatatagataatatattaatattccagtatttcaaattgtaagcattaaaatgtcatctaatgaattttgtggttaaatataatttgacatattttaatctattcaattgcaatgagtaattttggcactttgtttcaacttttaaaaaagtgaatttctcataatggatctcttaaggaattatctattaacataattagaaattaatacatgttattaatggcttaatcaaagaaactgtaaattgatgtgggacttctttgcaactttgctgtgggtctaatcagtaatatttcatgtactcgtcttcacccaccccatcctttattaaatatagaggggaaaaaagtggctcatgtagactaggactggttcaagaattttacaaatatatgatttataaagtgatatggaggagagacatgaaagaaaaactgacttattgtacagcaaacgttttaaaagccacttaacaaaaattaatgctatatttgctctatttctatacaatcagaaactattaataaatatatatctttcatctataatggccagaattattcttagtaggcctcaggaatggtcaaagtaaaatttttgccagggaaacacaataattgccaatgttcaatacttggtgtgccagtcaatgagggaaacaaaaatgttgctttacaacaatccctcctaatgtttaatgttactgttaattgctttatgtaaactctatgatcttagttccttagtgatgctcttattaaccaaaatccttgtaatacttaaataagtacctatattcacctaaccaaaaatgtgtatatacatcatgcttttattagtcccattagtaaataatgaaaatcatttataaaaatgacaaataaatatctgtaaaaataaaaaaattagtagcaaggtaaatccattatatctctattatgtatacatccaagtctttagtgcactgtgattcctattggtgatttttttcaaaatgattttaaaatctaaaagcttggctgggcatggtggctcacacctgtcatcccagcactttgggaggctgaggccagcagatcatgaggtgaggagtttgagaccagcctggatagcatggtgaaaacctgtttctactaaaaatatatatatatataaattagccaagtatggtggtgcacacctgtaatcccagctactcgggaggctgaggcaggacaatcgcttgaacccaggaggcggaggttgcaatgaactgagatggcgccactgcactccagcctggtcgacagagtgagactccatctcaacaaataaataaataaataaataaataaataaataaaagctttctgagaacatttgatcttttaccagtgttttgttggaaaagcaggtgtgaagttatttcatttatagggaatactttatattacttcatgaatttctggagttatgtattaagacatcacccacagtcaggaccaggaaacttaataaatagaaattcagttttaagattgtctaacgaatttataaatttccccttagtcctgtttatagaggcttaggcagactagttttcaaagaacaaaggctagctctcatgtcaactgtattcatttctgcatgtcattctgaaccaaagaaatggatgaaactcatctgtacttttgactgagggaattacatgatattttgctatcattggaaaacaaataaaatgatctttctttactttcaacaaacccatacactcccccatcactatccacacaccatcatgattctacagaaataaataaactcatttagcctatcccaacagagggatttcacaaatttagaataccataaccaagtagtttggaatactcctgtacaaacatgacagattacatgtgtaataagtgacaaagaaatacacctaagaaatgttataattatccctattttatggacattttttgttttgttttttgaaagatgtaaccacattaaaatgtttatgcctagtatcttacttgcaaactctaggaatgactttataacaatagtagctaacactcatgttactaatatactgatagtggtatactactatttcatttcatcacagtaatggcaagcggattgtaatattgatccctataatgcaattttaaaagttatttttaaatttaatttaagttacataagtgacaaaaaaagaaatttgaattccatgtctataactcaaaggtactgttctaattgttagataatactgctgtaaaatctttttaattcccttctgctctggaataaaatctaggttataatactccagattttaaatgagggctcaagtatacttattttaatattgttttctcttaaactaatttgccgtaagaagaattttatagagaatattaaatataaaaatgcagaggatagtttaatggtatatttatgtcacattttcagtaagacaattactatgcttttcgttaagtaagaattactttatataagtggtagaagttttcttgtagtgttttatacaccttaaggatgccaaaagtaaaacaaaatggcaagtccgagccggtattccactacaaataatattttaattctatgactctcatttcatttggatagctttgaactccatctggtcactgacaggagggaaaaaaagtttgagtttccattttcattaatatcttcactttttaaagtggaaaatggaaagcttcaactgctaacaaatcagcaactaatacattcataaatgaacctgctcctataatggtctaaagtggctctctgtttaagaaagcaattgatgcaattggaccttcctattattttctttaaataatgaagttatttgtttttaaaatacaagtgcatttatattcacagtttacatgagtggacaatattatatttggttttatgttttacacaaaatagggatattgacagaatgttaatatgttcatattaacatactacctaacatatcttatgaacatattacttaatgtatcttatgacctaacatatcttatgaacatattacttaaaataaaaaaaaaaaatttcagactacagaaaattaaagcagaaacttttgttgactggatgaattctaagggtgaataggaaatatatttcagccagctatgacaaatagagaaaaacacaactgaaaaagaaccccagccatctatctttgatactatgtctctagttagctacattaatttaataactcatggactatttctgcatcatagtcttattacctggaaaataggtaggttgtattagatcaacagttctttgctggatgattttgcatccccatgggacatttggcaacagttgaagacattgtttatatcacaacagtgggaagggcgttagggctggcaatactggcatctactaggtaaaatggaacaggagaactccacacaacagaaaattatccaatccaaaagagtaatgtcaacattaggagaccctagaacaggcggtatttatggtttctatatctgggatttcaggatgagttttttagagttaattggggaacatgaggtagagtaaggggctgagatgcctttttaccaattaggtttttttcaaacaaaaatttgaagaattagtaacttttagttccaactgaattatccagaatgttctataaaataccttcaaacgaatcatttttctttgaaaatactacgctaaggctaatctttcacttttcaatgtggaggtccccatccaaagtttatggcatttatttatccagtcttacaataacatcttacgttgctatataattataatatgaatattatggatgatatacatatctttataatccatttaaatcacttctaaagcatgaataatatatatgtcttttacacatgcatgtatacacacaaatacaatttacttataaacctattaagaagttagcactatgggaatattatatatattatatatatatataacatttttcatctctctgtctccaaactttgtgattttataatttcaataaaagtacaattttgttcaaactgtatttgtatcttatgtttctgttcatgcttctgcaggatattttacaagataaaagtgtggtccattgttatttgctttactaaagttctaaattttaaatactactaagaccaccaggaaaatactttctaatttattagaaaatacttacaataaagcattaattcgataattcaagaatgccaatataaatacatgaaatggaacacagttaaaaataaatgtatgaacagtcacataaaccatttcatgtcatcattttctgtatttaccaaagttatagctctttcgaatgattattgctaatgtattcatctctgacaaagcacaattatttatttaaatgaatgaacaaaagaaataaacagactggctcattttcatgggtgactgactgaaggaatttaagacttgcttcaataatcctcaattcatgaatctagatggtataaacacatattgataattttaaaactaaaataatcaaaaatgtacattaaaatatttttaaaataaactgaattattattcatgtaaagaatttgaagtgatataaaaatgttaaataaataatacaatgcaattcagtatattatttcaataacagtttttagtgtactctttgaagcagaaatattataacattctttgtcataatgagaagacaattttaaacatcttttccaaatattaaggttgtctggcatatgagactacatttatgtgactgtatgttgtatttcaatgatgaatgagttttacctagaaaagattaatagaagattttaataaaagtaaactatatgagagtcttacagttattgttgtaagagctaaaataaaagcttcacttatagaaaaaaatactaaaaggtttagtaactactcaatatgaatttgcctgttactaaaatattttattattaggttgttgcaaaagtaattgtggcttttaccattacttttaaaggcaaaaagagcaattacttgtgcacctagctattcatagaaggaggaaaatcaatatttaatttaacattccatgttatgtggccactcacttatttggtggtttcaggctccattttggggaattctacagtttctttatggtttcaggaatgtctgcattaggagaggttgggagagagggtatcttgttggatgtaatttcttcattttactttaatcaaaatagtttctcttgtaactatacacatagagaatttcagaagaggcttttaactgaacagaaggatttatagaacaacaacaaaggtagataatttcaaattaatatggtaatatgcactgctcttacactgatctcttggtcaagtaatttaaaacaagaattaaaaactaaaattgaaatttaggtaattaaattctatgaataattttataaccaaaaggggcaactattgagatgctggagattaagggtatcctatcttaaggaatgtagccattgtggaattaggacagcacttttaaatgtagaacatacctgcatttgtttcttgtcaagttcaccattagagacaaaactgattgtcagaactgtggaacatttgagtagcaacatactttttatactgacaattaggttgaaacaaccgaagaatgaaacgcataaagaagtgtgttcatgcccaccacagaataagaattgcacttaaaaagttaaggaaatataattttgataggaaaatatttgttattagagagaataaagaaattttgtaaagtaaaaaataaacccattgacatattgagtagtagtgtgtacattccctgtccaattctattacaagcaagtctaaatctagagccactaaaatttctatgatagacagtttatctttaactagatgtattttttctgttcaactaaaatgccttagtaatttcagtacgattttttttcttagatgtcaaacatcttttaaaattcaagttatggatcacttaactctaaatacatgcttttattttatttccaaagcttagaagacaaagattattaaaatctgagtgttcaaatataaaatatcttgaagtatatgcattaaatgttccatattttaggctaccattgagaagatgtttctctaagcaacatttgataagactaatcatgaaactaaacagccagctgtttagattatagtacaatccttgctgccatgtataacactattatcatcattggttttataatcctttggctcaacttactacttactggagatagccgaagagaactaacaaagcttttaatgtgatggtgttaaaaggtgatatggttcagttgtgtccccacccaaatctcatcttaaattgtagttcccataatccccaggtatcgtgagagggaccccatgggaggtaattgaatcgtgggggccatgtccccagtgctattctcatgatagtgagaaagttctcatgagatctgatggtttttgtaaggggcttcccccttcccttagctctctccttcctgccgccatgtgaagaaagaggtgattgcttccccttctgccgtgactgcaaatttcctggggcctcttcagccctgcagatctgtgagtcaattaaactgccttcctttataaatactcagtctcaggtatgtcttcattggcagtgtgagaatggacttacacgaaaggcgaacataaatccctttctattgggacaacagtatttggagttaagagttaaaaagaaaacataaaaggatgaactgtaaaccttcattcaaaaataaaacagcatattatattacactttcatatgcaataatatttttaaaagttcaatgtaagtataaatttgtgtgagatataaccaacttattatagttgtagtttcataaattaaaagatgtggatgaagttccaagatttgaaattactacgcttttattatcaaagttaaagatggcagagtaataataattatcttaagtttgaacaataaatcattcagagggtggtgcccagctggttgtttacttttccccttagagaagattgaggaaatagtattaagatttactattagaaagatgtttagaagaataattttgtgacagtgattaaattctaaaatccttgatccaaaagggaattgagagtatgaaattagataatgaaatttcctgctgtgtatcacatgccatcactgaataaattctcttgccacatatttttgtattgtgtttcttttcctctgtgtcataaacctctatccacctcatttaacatttttactgatttttttctcccataaatcatattcttattgtgccaaatactattaatataaaatctaacaggctaacataaagaaagagatgtcactttatccttagaggtatctccagatgtgggcctgtcatgtggcggggggagtatctgctgagcctcttaagactgtggagatggcagaagcagttttatgcctctgaggtctcagcaaattggcatcagtcacacttacctgtctgtttccttcactgatctcttttaaactatttctaaaccttccccctgtccatatcgtgcctctgtattcgaaatataatattattagacacagaattttacttaaaaatacctactcacaggaaaataatgagactttctcaaagaaagatcattcctatatttttggcaaagggatgggctcctctgggaagcctttcagagagctacattgacacatttgtataaaaataaatgaaacagtattcatcataactacgtgtctcttgcaggattctataactcctaaactaacattctgcagatggcatgccaatgtgttcaagagggatcatatataatttggatagttttgatatattaataggatatatacatcaggctttctttttaaaaagtgaaatatatatgatcttagaggcaaatcaatgacttttatatttttgaaacccctaaattaactttttaagccaaatgaggctattatataatagtcatcattctttaaaagtttctacttccatttcttcccctcctgataagtttattttctcctgtatcacaccactcaaatttctagtaacctcttaacttccaaaaggaataatggtgtgttcctcatgccctgtgacttcctaccaggatttgcttacagtcactatccctgaatggaaactatttttctctgatcccaagatcctaagcagagcattgtgtgtatgttgtactctacttccaaccaaccctttaaagcaccaggcactctgcatgttgcattctggccagagtgcactgctttgaattcctctcatttgactctttgacgatccttactcagtgctcttcttcagcctgtttcgtcagtctgcaattatctttttcttctttacctccagttgaaattttacttctatttcaatatctattttaaatactttctccttctaatgattaccctcacacccacttaagtacacacacttgtacacacactcactacctctctaggtagaaatggttgattcttatcttgaattctgcttgtactctcacgtagcaaattttttcaaacagccaatatataaacttcaattggacttatcgctgtattgaaggcccagattattattttttagaaattggctacattctagaatgcctagaaaaccaaactagattgtatacttaaaaaaattaaattaaatcttaaaagtacatattaatatttctaataattcagctaagaaaaaacactttctctgaatgtagcattttaccattttcctgacatttctattttctaatgtattagaaataaatgttaaaggttttggggggtgataatggcctatgttttaacttcggcttaatgtttattaatgtgttacttctgaaatcaattatttctataattgttaaatatgtctttataatgtctacaattgttaaatatatctttataatttaaaaaatcatatgctgaaagcaaaaccattggcaaaatgaacgcgttggacatttttaaagcatataagaaagaaagaaaggattacagcacaatactagagaccttagtgcttaataaaattctatgtgttttcccacaattccactttaatattaagtgtaattgtaaaatgattctgaagatgtagcaagatgagtgtcaattataggcaaaagccaggaaagggtagcatggaaccttctagttctttcttccactaccacagtacccaatgaagcaatgtgcaacagatggtagaggctccatcaacctgaagcagaatatcctgctgcctacaatacacatagacatatcaacacaaaactttttctttttaaatttttaactgacacgtaatatttatacatatttatgggatacagtgtgatgtttcaatacatgtataaaatatgtaattattagggtaactagcatatctataacctcaaatatttatcatttctttgtggtgagaacattccaaattctcttttctacctatttaaaaatatacactatattattgttaactatagtcacttgactgtacaacagaacactaaacattattcttgctatctcactgtaactttgtacccactggacaacttcttattcccccactcccaaatccctctaggcctctgctagcaactattctactctttacttctagaagatcaacttttgaagattccgtttatgagatcacgtggtatttgtctttctatgcctggcttgtttcacttaacatattgtcctccaggcaatttcgtgttgcctcaaaaaacagaattttaatgttttttttttatggctgcataatattacattgggtaaatataccactttttttttttatccattcttcagttgatggacacttagattccataacttggctattgtgaatagtgctacaataaacataagagttcagatatttcttcatcatatttatttcatttcctgtgaatatatacccagtgctgggattgctatatcatactaaagttcaatttttaattatttgagggatctccatacttttttccaaaatggctgcactaatttacattcccaccaacagtgtgtgaaggttcccctttctcaccacatggcctctccaacatttgttattttttgtcttttgataatagccattgaaggtgaggtgagatggtattttacagtggtttgtttgcttgttttgagacagggtctcactctgtcacccaggctggaatacagtggtgccatcacagcttattgcagccctgactccatctcaatcaatcctcccccctcagcctcccaagtagctacttactatatacttaatctgtgtgtgtgtgtgtatgtgtatatatatgtgtgtgcctgtgtgtgtttctcataatgcctttccataatgtaaggaacatattgggaaggtccttggaattacagtaaacacaatacatttaaaagaaaacaacccatttcatagttctagatattatcttttctctttctctttctagttcttggtttattttcttgcctttttagactaaatctctgactcactttttgaagctcctaataatgcaaaaatttcttctgaatttactaatttaacctcttttgttatattcacccacacattatatgcatgtcaccattctctctgtctggaataatctttcccctgatttttgcctggttatgtactactgattcttcagctatcacttgacatgcctttgcgttggaaaacctctgggtcctggacttatatactctctcataatttgcattcttaactctttttattcttaacaaaattgaaaattaaattattttttatatttaataaggcatttctgtatccaccattaagccatatgctacctaaagacaagcaccatgtgtcattatctctgacatatcttgtcacaggcaagcacagtgctatgatgagaacataatagatacacaaaagcatgtgatggataactgcagtaacttataatcaactattttgaaaatggtatttctaggctaatcatacttagcatcattgtatcaatttgtatgttcatcttaatattcactaattttgatcattttttcaaaacacatttctattctatagctttcacttttcatagttaatttaaagttttctaaaaaatgaacattttcataactttaaaaaaagcctttatcaattattctaacagcattcagagtaaaaggcaacttaatttgattgattaattttggatttagttaagttagaagttgccaaattataatatagtatataactgaattttatatatgttagatatttacaaattatgcattgaattcaagttttaatatttaacatctggtaacttttatgaaacagatattttattactatatttcaaagtttcctgttttattgcattttatttacttgaaataaataaacaactgaaatacaggatgaagataacaacaaaactcacagctaacatttatcatgagcaggtataggataagtgattgacatatgctatcttatgtaaccctcacaaccacccagaggggtaaacgccactattctcatttagacatgaggaaactatagtcataactaggtatccagttctaaaaaaggagcttaactcaaatgcttgaggccctgccatgatgcaccactacttcattgcattaaacacagtttaaaattaaactacacatatccttaaaatttatctgtgggagcaggagaaataaaactaagaagaatggttggttttattaaaatccctttcctaatgtcattgagcagtacaacatgtttataattaaaatgaatgaaacttaacattggctttattcttttgtgattcctgcacgtagcatccttctctaccacatagcacaacattatggacaacagcatgagaaccatctttaattctgcctcctgtttccagtaactccagcaataggagtcaatgttgaagataatatgtaaataaatcactaataattcagcattacccctaggtgggctagggaagagcataaattatttcaatgtacagtccagtaaatcctttgtttttggtctctgatgcgtaaccattaaagatgcaccttattaagaaattcttatgtaacatttctagacataaatgtcatctgtctttccaaaactgtcttttaaaacaaactcctattcagctatctttacatagttgagtagtataggacatttgttaaacataaatggaaaaaaccatattcttcagaaacaaaatattattcatattagaagatcaaatggagactttttgcttctctataatattttattacttctctgtttttcttctgatacttcgggcgaaactggtgcaagctaagagttgaaaatcaatgccttagggcatgggcttttaataccactacatattagaatcaccttgaaatagtaaatacatgaaagctgacagcccacctcagaacatttaagttataattggatggggccagaatgtttagagtttgaaaagtttcaaggtgtctctcatatgcatacactattgaaaactactcttaagaggtaagaaacctaaacaaataaagtctattcttaaaattcaatttttctacttactctcccatagcaaattcatgtatttcccacgatattatttttttattctccccatataccttacaaagaggtcattagtactctaattatattttgtccttctctttaggaagtgtttctgtcaggtattatgattattttactttataattataatgcaataatattttgcattaaaaattaattaacacatagaatgtaccaggtattgttccaaaaaacttttccaatactgagtctacagcactattgctatcttcatttcacaaacaaggaacttggagcatagagaaggtcaaataacttgactaaaaatcagtcagctgttaggtagcatagacatgatacaaccccagagcagcatggtgcttcactaataataacaaaataatgagttgatagttatatagcaattagaacagctctggcaagtgttaggttattgcttactttactattatcattatgatcattattattattatttactgtgtgattaccatgtgctaggcataatgctaagaactttacatagttacatggttgtatatgctttatttcattttcacctcacaatatccctgtgagatgagaacacttattgctgtaagcaacttgtttcagtcacccaaccaataagcagatgagcctgaacaaaaacccatagttaaaaccatggcgtttttctttttcattttgtatcctgtacaggatttaataatagttttctcaaacagtagtaaactattatttactgaattgaattaaattgaatttgtatatctatgattcaaacttagttacattactttgcagtagagacattttcctttttttatatatatttgtgtctgtcttatttaatatctcttagcctgacgttcttaaaaaatatcagtttatcagatgagtagattgcaaaaattttctcccattctgtaggttgcctgttcattctgatggtagtttcttttgctgtgcagaagctctttggtttaattagattccctttgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaactaatttttgtataaggtgtaaggaagggatccagtttcagctttctacatatggctagccagttttcccagcaccatttattaaatagggaatcctttccccatttcttgttttggtcaggtttgccaaagatcaggtggttgtagatgtgtggtattatttctgagggctctgttctgttccattggtctgtatctctgttttggtaccagtaccatgctgttttggttagtgtagccttgtagtatagtttgataaactggattaagaaaatgtggcacatatacaccatggaatactattcagccataaaaaaacgatgagttcatgtcctttgtagggacatggatgaagctggaaaccatcattctcagcaaactatcgcaagaacaaaaaaccaaacaccacatgttctcactcataggtgggaactgaacaatgagaacacatggacacagcaaggggaatatcacacactgggtcctgttgtgtggtaggtggacaggggagggatagcattaggagatatacctaatgtaaatgacaagttaatgggtgcagcacaccaacatggaacatgtatacatatgtaacaaacctgcacgttgtgcacatgtaccctagaacttaaagtataattaaaaaaaaaaaaaatccatcattcacataaccttaagccaatgacctccacaagcttcactttccttatctgtaaattcagataatggtacttacttcacaggaccatttggaatctaaggagttaatgcatgtaaaatacctaggacataaagcgtcaataaaacagctcttttatctcaaaaaaaaaaaaatcagtttagttaaataacggtttatctctttgggaaatgtaagagagaaaacagtctagaattgcgacatcactgtcttttcaccaaatacagaatatgggtgtggtaggcagcttctaaggtgaccgccaatgatctctgactcttggtattcctactgttgagtctggattggatttaaagacttgtttttaatgaatggaaaatatcagaaataatgggatattacttttgagattaagttataaaaagaaagtatcttcagccttgagctctgagtgttgctatttctctcttcaaccccctatctcagtggaaaaacagcctattgcgagcacccctatgaggagagaggtccatctgaagatgaattgatatctctcatcaacagccggtaaaattctgaggcctgcctatagctacatgagtgagtgtgaaagagcgtcttttgaggcctactgtcagtccctttgacaagttttggggtggattatcttccaattcagctttaagatgactgtggctaaataacatcttggataagctgattcacttcggtgtccttagagaccttgagccagaggaacaaaactgaactacattcacaattgtgagataagttttttcttaagacacttcatttggggataaatttttatgcagcaatagataactaataattatattttggttatgtgatatatgtgaattcattttggaatcttcacataaacttcaaacagatagatatgtatgcagctagaaccaaataaaaacaaaggcctacattactgaatattgggaaagatgtgatttttatgtaaatgcaacatatgtgcagataacaaaaatgtgaccaatatgaatcctgaaatgaaagacaggagcaggcactatgaattactggttttcatgtacagtgaggcttctgtcacagaccaattctccacagcatattctaggttaaatgcaggaagaatttttttttttaagtaaaggtgcttgataattctccttattaatgccaaatatgtcagtaggctttccacaaaaaaataaggaatggtacatcattttcttactttttatttataaaactagaaatattcattacaattataaaaattgatttggataacaaagcatttaaaattgatatggatgaaaaagcattgttaatatcttattctaagtatttagtgggatgataagatttttgtttcagtagttctaacagaaccaagtcattaattagggaaatgatagtccttcaaggacatcattagaatgatgagcttctgctttcaacaaagagagaagccagagaaccgaagtaactcaaatttgatacagattcacaaaggatcagaagttcaaaacatactaatgcatatgaacattatattagagaccactgcatcccaaactggtattttacctaataatatataagcagttataatatttttaaaaatgattcctgctcaaataagtttgagaaaaaaatgctggttagacaggcttgttaattgtagggctctcctgtgctttaaattactaatacgcacgattaatctctaagagtgaaccaagaaacagcatttcctaccttcatttgagcattgagatttttgtgaaggctaaacaattagcctcgcccagagtaatgttccatggaacaataaatgaggaacactcttaagtatcataattcaaagagttcacagtaagctacaagaaagcaggaaccacctttagccactcccagtgtactcccagtactaagtacagtactgacagtgcaggcttttactaagaaattactgatgaatgaatggatagacacccccaaactgtaagttggaaagtattagctacatgcatatattattttcaattgtagccttgcatcaaataatgatttatttctcttcatctttctaccagcatctcaatgcaaggtcacttcagaagtctggaggcttctataacagcacacaggatcaaaggaaggaccctccactcaagaataatctgtcatgactgcggctaatatcaacattatccaagaccttatttaggttccttgaaagctggtatctgtgcagcttccattcaggtggaaggtactgaaataatcatagactggcaaaaatggccaagcgcagtggctcacacctgtaatcccaatactttgggaggtcaaggcgggcagatcactcgagctcagtagttcgaaaccagcatgggcaacatgggaaaaccctgtctcaactgaaataaaaaagttaactggacatggtggcatgcacctgtagtctcagctgctcaggaagctgaggtgggaggatcatttgagcctgggaagtcaaggctgcagtgagctgtgatccggccactgcactctaaacctggcaacagaacgaaaccttgtcaaaacaaaaacaaaacaaaacaaaacaaacaaacaaacaaacaaactctatttttaagtcctcactgctaaatgcaaaattttctaccacagggtggtagtaatagatttctgttattgagaagaccctcctccccacccaccccccccccaaaaaaaaaaacaaaaacttttctctcctggtatttagtacttccttcttttttttctcttttatcaggaaaactgatatactattttcaatgagttttggattttctaagggcacacacagagagaataactttaggctacttcttgaagatataattcaatgatttttaaccaatatttatgccatccagcatcacctggagtatagccaatcaaacaaagcatatgaaccaagtaatcacacaatatctgcattgatgtgttgcctacatgcagcagaatgatctggatagctcaccaaaaacataattcatatataccttttttactccatttgccaacatactttatttcagagaaattttaaattatatctcagctgtttctcagagctcctttgtggaaattacatcctggtttctgttccatacttgagtagactacaggctttccagtacattgtccattggaccaaaatctggagcaagagaaatagtgttatggtagtcaggacacagtagctggagccaaactatctcagttcaaattttcgctctgtcacttactaagtctttatccttgaacgtattatttaacctctttgcctcattttccacaactgtaatcaaagggagtagtaatagtatgagttagggtcatcacttaaattgagtgtattaatacatgcatcacttagaacaggtgtgtggtgtatatatctatatctatatttatatatctatatctatacaatcatccctcagtatcctcaggggattgggttcaggactgcccgcatataccaaaatccatgcatactcaagtcccgcagtcagccttgtggaaatcatggacaaaaaatgttggccttccatatatgcggatttagcttcctgcaaatactatgtttctatctgattttggcagatgaatgtgaatgaggaacccacctatagtgatggccaactgtaattattgaaaaaaatctgcatataaatggatctgcctagttcaaaccatgttgttcaacggtaaactgtatatctcttctggactctccatttggaaacacatggacccagaggatttcttcctttgcttgtttatttttatgtgagtttgggcccacatttatctctattggctgatccagaagattcacagaggttatgttcttcatcttgctatcccaaccgtcaggtccaagactttgtattatctttttctcttacttcattgacttgtagatgcccctggtccttgatccatctttgtgaacttaatgattcaaactctgttgtttatagcaggtttaaaagaacagctcttattactagatgttcagaaaaatataaattttatgtttctattaaatttagaagattctacccatttttagcattaaaaaatatgaaatgtttattcagataaaaatttagtccaatgtagatagatatacagtgtcttctaggtaaaaatgtttagtctcccagacacctttccttcttagtttttgtctccttaagatagtgcctattcatagggaaggggttggggggataaatggaacttattttataaggtttcatggtggtaggggaagcaaacaaacaaataccttgagtgctatgtcctcagatttctacggtttccaaagaattggttatgtgctgttggcacagaattggttatgtgctgttgacatctgctagtgatcactgctgattctgtatcgagtgtgagtctctcagcttagaaagcatgtaaaagtgatcatgtgatcaagtgatcttcatcaagtggaaggttcacctcagcttccactgcacctgtcacttatgagctctcactataatttcattttccttcatctggggatagcaggtagtgattcctaaccttttgtgcaaagacctctgacttcatacagttctcccagcagcctcttggtaaattctgagtcctattgtaactctggaacccagggtggttccaaaaggctacaacatagggccttttctccctgacctgttgcattgctaagtaattatagctgagcccctagtgattcaagtaaaccttcaagaagaacctcatcccagactcctggactatgggcaagagttttctcctcattgttattccttcaatatatgtaacatacctcatggataaggatggctcttatattcttatataatcctaaattaaatgtcaactattaagtattatctctgacatcatctttatattccctccatccttattctcaagcaaatgaaagctatacaacaacatagggaggtactcagaaatgcaaatgatgaaagcataatgtcccctcgtgaacacgaaaacaagttcctggtaatttacgtgcattttgtggtaccgccaaatcccaatcaggaaaataagtactgtgtattgaaattgtacctctgatttcaaaattaaaacataaaaatttttagtagttatataattatgttagttgcatgaaatttgtttctaaaatatgactttgacaaagatatatataggacacatagtaatcaaaacaaaagtggcaattttctcggtagtactatctaccctcatgggctattctatggaattcctttccctattgttttaggtaagccgtcagtatatctgttttgcaaagaaaacaatgatactgggattttagtacaactcatgtcacttagtttccatgtctatttctttatatgagttattatttccttttaaaactatcatttatgtatcatgatagattcaaaatatatctaaatacacgttgcttattatgaatactaaagttaagtaatgcagaatttatagattcatactccagtttaaaattaggtagcttacataggggcatttatattgtttcatggaagcaagtttattagtgctttcctttcaagcatagcctaaatacattaagattaaatacattaaggttaatttgagagtagttttaattccataggaacatacattagccatatcttttcatctggaaaaaattataacaatagcaaaacaataagtctaataatgtctacaaagaaaccatatgagattagaaatatgaaaccttgtataaatccctcttatcagtccccatacaattgtctgaatccccatggctacagtcaattatgcttttttttcccccacagagataccagcaccaataagagaacagtttattctgcctcttgcagtgatttttgtgaatatctcaaaatatcgataataagaaatgggtcctgtcaatcaatgcatctgatggatgctaattctatccagaaaacaatattaaccttttccactgtaagcctatcaaatactagagatctaagatggaataatagctcaaaatgaatttctccatgaaataaaaatagaactgcttgttaatttttctcgaaacacagattagtaaaactgcagctgtttcaagaagtgaatttgtgggaaaatgtcaagtgtgagacatttttctttcttgaccaattaaaagtaataacatgccaactttgagaataatagtgtgggaaatagtggcagtttttaaactttgtaaatagaaatatcaaaacatataattagtttcaaatttttggttaattaaacacaaatacctatttatctgttgtattttgctttcatagtgggcttataatgttggtatgaagaaaataaaaatagctttattgttacagcctatgtaacaaagcatgacaaaaacatccagatatctaatttctcattggtctgggtctttcgcagtgtggatgcataattttgttatcaaattgaatggatatttttaaggatataattacatgtttcttggggaagttcaacaatttaaagtatcttgtcaatgttttatattttccattcctccaaaacttaaaattaagtagtgagtcactgattcaacaagatgtacacaaaagtatgtctactagtataaattataaatgtgaaactatagtttagaactctcatcattaaagttattgggttataatagaaacacatgtaatacatgtaaaaatgtataacacaagctcaagttgagttataaaaacatgttttgctcatgaaatttaattttttactaaatttgattagttgaggcttttaaataaacataaacattaatgaattaaataatgtataattccacaaatgttttctccacatgcatcttatgctatggaaaaatatttatccattctttccacaaatatttattgagctttgaaatatgccagacactgttcttggaagcaagaacacatgaataaacaaaaacattctaaatgctggcctttgtggtacttgtgctcatgttttgtatattaaataaaaaagacaaaaactatttttgtgacatttgcagtttgtggttaagcaggcagtaaactcttcttcacacaagtcaacaggggaagcacaggttgtaaatatctgaatgaaagagtgatgtgatacagaataatgtgtgaaggcccattgtagggaagagacagggaagcctttttgaagtgataactccatggcgtgacacacttttaagtttgcctaagacagttttaatttacatttgttgtcctaacagtctgtcagagtagcctttgctccactcaaatatttaggagaatgactaaggtaaagtagtagactgattgtaagcattgaagcaggttcggtaagggatggttttgattgggtttagggtgatagtaactgagattcagaaatgtggatacacttgatacaaatactctaaataatcttcttttccattcctgtatttaagtcccttatctattcaaagaataagtagcattcaagactctaaagttcaaataacagaatgatacaccacttcctgctttagaggctcacagcccatctgaaagagacagacaaataaacacatgcatataacttagagctacaggaatcctagtgtaattggcaatgggtaagtggatcaccaatgaaagagaggtgaattctaactatattcaaaaacaaaaaagattcacagagtaatggaccatggacttgagatttagaagtgaatgatggtcatttgtcaattgggataatatctctgtaaggtgtatgaggtcctaactttggtgaatgaaaactacaatttgccttcataaattgcttacattttttctgaagaaagatagttttataattccatctattaatatttctttgaaccccctgttacctgagaaggcaatctattttgaaatgaaaataatagaagcttaatacattaacctggaaacactttataatacatatcacactgaagaggtcctacataagtactcttctgttcattttaaacttgagctttattatctgttttttgtaaaccccagagctttcttaatgagcattatgaaaaatcttttaaataagacaaaaacattttaggtttctattcctttttttccctcagtgctttcaaagaaatttctgagcataacctgttgtataaattatactagcaggttatgattgtttggggtacttccttgatttttcacatttaaaaataaaactgctcatgttttttttgtttgtttcaaacagcaagtagaaaaattgtcatacagaatgttacctgtaaactttatctttgttcatgttttagatttttttccttgatttgaatgacttcttttttcttttcaggtacttatatgtgaattattttcaaactgtactttttaagcaatagatgcggaaaaaataggaatactgacttattatgtcctcaaagtctcctctcaacaaataccaggagatttccagttttctcttacatagtttggttggaattagctctgttttgattaatactcatgaacaatgtgtttgttctgccctcttttttaaatatgggagggagttgatgttggtaattatttattatttctctcaactttgctataaaacaggaggaatttcattcaacttccgatcacatttgaattagataccagaagactaataataagtaattttacaatgttgatgtgcgggcaattctagggaagactcaaaacccagaatacataaaagggaaaattcacacgattaattacgtttaaaaattcacatggaaacacattaaagagttcaaaagagaaaagggaaaagtaaagccatgaaatacaaactatccacatgagtactaaaataccaaggtgtaggttatacatgtttatatatttgtcaaaatttggaatgtacacttaaggtttgtgcattttattatatgtaaattttacattaaaataaataaatttgaactctagttaatgatagtaataataaggtatttaagcgaaagtacgctgattcctgcaaagtattttaaattgcatccaaaaataaggtagaataatgtatggataggatgaaggaaatatggattgtttgtgccacgagtttaaataaatattagtgttagaatctaggtggtagatcaatgatgttcattgtaaaagacctttaaattcactgccccctttttttttttttttttttgagacagggtcttgctctgtcacataggctggagtgcagtggcacaatcatgactcactgcagcctcaatttcccaggcttaagctagtctcccaccttagtttcctgaatagttgggactaaacatatggccgaccatgcccagctatttttttttttttttgtagagacgggggtctcactatttttcccaggctggtcttgaactcctggactcaagcaatcctcctgccttggcctcccaaattgctgagattacaggcatgagtcaccatactggctttcactgcacatttgaaattttcataataaaatgttgaaaaatttctacaggatgatttctaataaataatataatgcaattgaataccaattaaaaattgcattgacatgaatggtatcaacaaaaaatttaaaataaacacacaagtgaaaaaaatgaaaataatgcataacttcattgtcgatcacatttataaattaaaattaaattgatatttattctattatgtcttgaaagaagaaaataaattataatacacaaggtttttgagtgtgagggtgttgagaattatatacaatgtccacgtgcatataaatttgtacagccttttagaaatactccttttgaatatatgtctaataaatttaatgacattacctttgattcagcaattcaaattttagaaatgtattttcataaaacattgaaagactggatgcaaagatatatatccataagtttatagttatcaaattgaaagtatataacatacatatttagcaaaattatttgattaaatacatttggtataaataatatgattaaaattttttattgtattgtaagcactgatatagatttatatttatggacataaaaagatagccacacttttttgagtgaaaaaggcaagctatgaaaaattatgttgaataaatatgtgtgtgtatgtgtgtatatatttatatatgattgtatgcataaaagaataaacgtctgaaaatgtagaataaaataaaatttgctatctctggaaatgctatattgtggtcaatgtttactttccttttatacatttccttttacacatttcagtagtttgaaaagtaaaaataaacatttacagataaaaacttgaggaaatatttcacatcagatataatgaataattaatattcttaaagtactgagttcttacagttaaaaactaccaatagtcgcaaatttttaaaaacaatatttatttacatgacaaaatggtagtctctaggaaacacagagaataagaaatatagagaataagtattccttaccttccacatatttacaaccagtattcaaaaatagttttaaaaatatgtttaaccactctaaatgtacattaatattctatacacacaaatgtgaaatgatcacatcaaagtaaaactatttattgctttatatttacttactacatattccaagccatactaaaatgtatttaaaatgtaattctaattgcctaaagaaagcatacgagtttgtataaataaaataccattttcgtaaaatgaaattctaagataaatttgaattttgtttttttgaaaaggattataaataacatttagattatatcatcattcatgagttcaaagaagaaatgaaatctcctttgaatgtcgcaccattctgccctgattagatcaattttggacaatgacaatcgtaattaattactcttagccttcaggatgatgcacaactcaaaatacggaaaactgaaattctataacaaatacaactggctttacaacatctgaacaatttaatacatttaaaattacttaaatgaaaagtaaaagttaaagttattgactcaaaattttaatcagcttgactatccttctgcatctaaacatgaattaaacaatcttaaagctagaaatctaaccacagacagatataagtaaaaaagagaagtttaccagtttacttttttctaatatctgagttgaattagtctcttccaaagtattttttttttgcaattttgaatttactagttattttaatgaatgaagaaataataatgggatataatgtcttaagcaggagtgagtagaatatacaaaaatctaatctaagaatgggaatgagatattggatatttatttatgaaaactgaataactaataaaaatgatctcagcaaatatgcttaatttagatattgtgataatttcttgtgaaacttttgaagttaatgttttgagggaactttaaattctctctcaaccacttgcaatttaattaattagctatcaggcatcagtgatattcaaacttgcctccagaatctcatttatgagatttcaccctggatcacatttttagtttgtcataaaggttggcactctgcacaaaattggcaaggcaaaatatttattttcctctgtattcacttaaaaaaaaatactgtcacatctgacagaaaccatagtaacttctctctaaagttattctttctcaagttttttaccctttgtgctcttgacaacttttctgcaaatttcattgtaacagaaccaatacaattaataagattcctgctgtaactttcctcacgccttctatttatttttgtctgtttattaaaatagtactttttataagagtcgccctatgatattactgcttcttttaattactttttgaaaaataaatacttttatttttaagaagtatgtttaatcaaactcatcttaaatttattttgcgtaccttcaaatatgcagttatctgagataattaatgttttaatatggccaaacaaaatttgtgctttaaagtccattatctcagcgaacagaatggagtgaaaataaattatatttaaaaccacacacatacattatgcagaattttctcctttcagaattgatattcacagaaataaaatgccactcttattgtttagttggaaaatacaattgttagaaaattacatttcatcttatgtgtcaatctctgcagagaaaagcaaattagctttccctggaatgtgagaaagcagcaaaagcaaaacactctaaaattataatttcatattcttatatttttatctttatcttgctaaagaataagaatatattccactcttaaaaattcttgattttgtggaggaaacacattcagcaatctttagaatgatatagataagtgtcacttaattatgaggatacattctgagaaatgtatcattaggcaattttgttattgtgtgaacatcacagagtgtacttacagaaacctaaatgggatagcctcctacacacctagactatatgctatagcctattgctcctaggctacaaacctgtatgaggtactactgtacagaatactggagacaactgtatcacatggtaagtatttcaatatatttaaacaggaaaaggtatggtaaaaatacagtttaaaagacttaaaatggtacactgtatagggcacttgccacaaatagaatttgcaggactgaaagttgctctgggtgagtcagtgagtgagtgctgagtgaatgtggaggcctaggatgttacactattgtatacttcacaaacactgtacactttataaacagtgtacactttataaacactgtacacttaggctacactacatttactaaaaatatatttcattttttcaatgataaattaactcaccataacattttaggtttatttactttttatttactctttgacttttctgtaataacacttaggttaaaacacaaaaacattccacaaccgtaaaaaatatgttcttgctttatatccctattatagaagctttttcctttatatccttactatataagctttttataaaaattttaaaagatttattttcgtttgtagtttctaaactttcttgttaaaaactaagatacaaacacacatattagtctatgcctacaaagtgtcaagatcatcaatatcactgcccttcacctccacattttgtcccacagaaaggtcttcagaggaaataacacacatggagctgttatctcctatgataataatgccttcttctggaatacctcctgaaaggcctacctgaggctgtttcacagttaaatcttttttaataagtagaaagaatacaatctaaaataatgattaaaaacatagtatagtaaatacacaaatcaataacataatcttttattataaagtagcacataattatatttgcttatattttttgtatgactggcagagcagtaggtttgttttcaccatcatcaccacaagcatgtgactaatgcattgcactactacattaccatgactaccaccactaagagataggaattttccagctctattattatcttataggaccaccttagtatatgtggtccatccttgactgaaacaactttacctggtgtacaactgtacgtatccaagatagccaaaaaaaaaaaaaatctaatactaacattgtaagaactgtataaaatttaattttaaaattacatgaatcttttaaaatagagaatgtacccttgttactcctaatacttagctgactctcctttttctagatgagaaaaatatcatcacaattgcaaatcatcttaaaaggagattctcattcagtataatataatttcacttacactgaatatcactttttatttcctttattgcattatctcacatttgaaaggtttgaattgccacctggcagtgtattataatatcatattttacattcactctttatcagatatctaacatggaaattcaagttcatatttctttgcagacaaaaccaatgacaaaaagttctttaaacaatcagtttctccaaagctattctaaatacatttaatcctctgaatcaaatgcataatatgaatatgtatcatgttcataagcaagttacataaaactaaattgttatgccactaaaaatatataggccacatatcatgtgtctacacttatctttttgaatgcattgtgtttcaccttttgagatatagttcacacactggttataaaaatatccagcccaggctggaatgcaatggtgcaattttaggtcattgcagccttgaactcctgggctcaagtatcctttcgaatcagcctccctagcagttgggactacaggtgcatgccaccacgcctggctagttttttcattttttttattttttgtagagacagtatcttactaagttgtccagacttgaagcaaactcaggccacaagtgaacctttccccttagactcccaaaacactgggattacaaatatgagctgccatgcccggcctattaaactattccttatttgttggtggtttttcttttttggtttctttgtattgtgttgttctttttttcccccttttttaactattcttaacatatcagagtttgtctactcagatttgcatgacctcaaactcatagggattatttatcttcattagtcattaattgctaacaatgaaatctaaattggtgagggcagaaaaggatacgcagataaattttgttccatcatttagatacatttttatgtttatattttcctattatgatacttttaggtttctggagctgcagaacctttgtcaaaaggtgcattttttcattgcaaatattctaacctatgtgccataactacaggggaacatcctatatataaagcaaattattctattcaaatttgacacatgtcctctgtctctgacaatatttcaaagtcttcctaactgtactttatttaaaacttctataacttttctagttttattaacggattaattttcacaggatgatatgatgcttgcaatattcagcttccttatgatcaaagccaattctaattctgctatttactcacaagcatactaattactttttaaaatatcgtgtttataatgatcaaaatatctctctgtgtaactgattctttttcctagcaaaaagctcattagtagtcataggactcaataatgttaatattcccaggatgaatgatacaaaagattcattatctttatgccacactggaatcattgaactgaatcattttatacgattacaattatctttcaggcaatgtactcatataaatttaactaaatgcttaaatggcctgttgacccaaagggcactattagttttggcttgataatttaataaattaatgcccaggaaataatacatactttttattccacacttttctcttttattttttgaatcaaataaccgtgtgggtataattagaatattgaaaaaaaaaaagcttcctttcttcttggctacccttccttggtatatgcatgtcttcttcactgattatgatgaagaactgagagaattcaacctacataagttcattttctgtataattgcaatttaaaactttaagcagcatgcttccaaccagttttggtgaaactctaagaacataaataaattatttgaaaagtcagtataaagtataccttcagtatgaatataatatgggtatataagaaagactatttcttgttttctcatgaaatcctaattttcttagttttatgtttagttttctttttatagataaattccttaaagccctaagtcatgacaagcagaaaaagactgaaaagatttcgaattaaaattattttattgtaaaaattatattgattgatcagagacagttaaatattatatttacaaattccaatctgtttaaatgtcctattagtacacataaagttgtaatagtatggcatttgcgatttatcgcaagatttctatacctttacagtacagttctctgacattggctgcacacagcaatttcccatagagctttaaaaaatactaataaaagggcctcaaacccactacttctggcttaattggcctaggatgttgcctcatcatcaggatcgttaaaagatccccaagaagttctattcttgagccaagcttaggaaacattgctcaaaaggtatatcaacagaagaataaagtctaaagtgcaaagtagacatttgctttaaacttgtcacatttctcaaaatttatctagtaatatagaaaacattatttgcatatataagccatttaaaatggccctaacaatacttattatcttaacaatttcactagcaaagtccaaaagaacactcataatggtataaaaatatattaaattatttagacatagccagcattttagacagctaacaggatgttaaaacaattaatataacggtgcttggattggcatgtgtctttgaatgtaaaccctgtatatatatgtatatatatgatatatatgtgtatatgtatatatcatatatatttattatgtatgacatataatcctgggtattactattttaatcaaaagataattcagagctcatgaaatatgatgaattgaacttccttgatactgattcggattgttgtttggtccatctatctgattactgcttaaagaaaaacacaggtactaaatttaccatgaactgattaaattaggtgatactaaatttattatgcactgactaaactaattcttgcaagctataaactaaattgtatttattaactgcattatggaatagaaatattctcatgaacaaattcctaaccctctggaaaaataatactttattttaaatatttctattgctgagttaactaagcaacaactaaacattctacaatatgaaatgttaatatcatttaattaaaatacattgtggatattggtattacataatcactcattctacagtattaatcatagaagttttcttttcatatattttatagaatgttattaatctttattctggtatgttatttattataacttaaaaaagcaagtgattaaatttaaattaagatagtttatattagttgattgggaaaaaatagaattgctcatcatattttccctccttttaagtattttgttttttttacttattttactttttctggttagaatttcatcaattttatcaaaaatatgaaggctgtttaggtatgaatttttcttgagcattactgtgtaaacaagataaatatataaagaaaataacaatcttaaaacttaaattaacttttttctaaccaccccagaagtctctgtaaatgaaacagctacagaggcatctcagtttatagatggtttttgcttcaactatttccattgcacagatatacacgtctgtcttataactttaattttcttgtctttcttatgaatataacagtacatgcaaaatcacattatttagtgttggagaaatcaatatattaaattagaggtgtctggaatacaatagatgttcagaatattggtatatttgttgactaaattaattttattatttaatacggtggtgacttctccatggataaggtgagagacctagttgaatcctttctatgaatattcttcaagcaatcttgtcaataattcactgttcatcatagtaattatgaacataaaaaggaaaaacatctgcagtgtgggaaatctgaatttgaagtataattttcagtctggtacactgggtaagatcatttttaagtggaaaagaaagaaagaaatggaccctgaaatattctgtgtgtgagcattagcagcaattcaaatacatgatctgattgccagccaaacagaatttatttaaatatgtacacaagtaaatgggtttacatgatttagggtagtttttacaggtactaaaagttagcagataactttgtcttgaatgtaagccatgtgtacaacagaatgtaaggatccaggcaattcgtttaactgagtattgacttttttcaattatgatgaattatgataaagtgattaaaaacacactacctcggtcttcacataatatatgttttcatttgtaatatgatttcctactttgataacttcaaacctaatttttttatgtttttcatatggatggtttatggttattaggtaaaaatatttatttagattatgaaataaaagagcctaaattaataaagttggaaacttttgcatacttttcttaaacaactgaaaaagaagcaatttagttactacaggcaacatggtgtccatgattagtacaaaatttaattattcacaaagtgccaggcacatgggatatacaatacgacgtgtctttaaatttcacttatttcattttccattatctttaggtttatattatttcacagataataactacacatttcataactaaatctgaaatctatacaaatgcacattatgagtgtttttggagatatggacccccaaacagatggtgagatgctgaaaatttagactaccatataaaaattactcttgctacactgtacttcaccaaaatacacaggactagttaacaattacaccctaattaaagaatcttgttgtctggggtcaaagctttaattcatttaatgtccgtatatttggtaaaaatggtaatatgtatggatatctccagaaaagttcaccacctagcaatatctatgcctgtgaaaggatccagaatatgttgcattaaaaaattatatatatgttggatgtagtccaatgaatgtcatgactcagaagaaagtacaataaaccatgttccccatagatgaccagttgtctccacaaaatgtacatttgttataaaatgcataagaatgaactaggtgtacttaaaatggatctacataggtttaatctacttggcaagaaaaacatttatattattagatagagaaagtggttgcatcaattacagcaaataaatgacagtatttgttttttatttgtcattattcttaaatcctctagaggcaaaatggttaatgaaatacttctcagcctgcatttatatgccagccttttaaataaaatctgtaaatattcaaatacaatctatgcatattctgtagtaatctttaaagattatcaataaagttatagacataaacacatacatgcatgtttgtgtgtgcatgtatacacactacaaaggctagtccttgcaaaagatgagaggtatgttctcattgttcattatctattcaaaaccactagcttactgctacactgtgcagaatcaaacaaaactttctagaacataccaaaaggcgaaattcaatcatcgtgtttgctatttcaaaaatctgaaaaatgttgcttagtaacttgtctgcaagtaggttaattgaattcgaataattattttaaaatactttgcaaattactttgtcctttcatttttaattttacatctacattactattgatcaataccttgcttgagacaaagtttagggtactttgcagttttcatcttttgaacaagactggcaagtagtgggtattaaatgagcattggccaatttaaatgaatactctgaggaaaataattcatcccagttatccgaatattcaaaaccgagttcattttatttatttatatatatatatatgtgtgtgtatatataaatatatatatttagtacatatatatgtactctatatattatctatgtagacacaaagctaaatgatgtttactgtgccacatttttactgtcttttggataatatgatttttaattttttaaatattatgttttcttgagaccagatatatatatttgatttttaaagtatgttttcccccagggcatctacacgaatacttctcagatatggttacttagcaaaaaaagttctcagccaggtgcggtggctcacgcctgtaatcccagcactttgggaggccaaggcgggcagatcatgaggtcaggagatcaaagtcaacctggctaacacggtgaaaccctgtctctactaaaaatacaaaaaattagccggtcgtggtggcgggcgcctgcagtcccagctacttgggaggctgaggcgagagaatggcgtgaggccaggaggcggagcatgcagtgagctgagatcgcaccactgcactccagcctgggcgagagagcgagactccatctcaaaaaagaaaaaaaaaagaaagaaaaaaaaattatcaaatagtatgaacacaaattaatttgatgtgaacttcttgacacaaaattgtatcaagagttagaagaacatgttaatgcattagcatcaagcattaaacatttactcttacagtttttcagttttaagtaattaattttattaaattatatattttagtataatggaaggctgatatccaatttttaaagccagcttttattccacatgttttactcatttattctgatgtaatgacatttttctagtgttaatagtcatataaaatgtttctgctctgtgagtttcttcactaattcttgtgtttaagttttctgagtttgttttaattcactcaaaattatttgttcactctctagaaattcattactcttgcaaataatcaaatcactgtttaagacaattaatgtgttaatcaaccttgtttgcttcaaacaacaaacccacaagttagaccaattttaagactaattttattgaaccagagaatttaatatggcattattttcctatatgttttaagaagtaaatctttaggccgggcgcagtggatcacacctgtaatcctagcactttgggaggccgaggtgggtggatcacgaggtcaagagattgagaccatcctggccaaaatggtgaaaccccgtgtctactaaaaatacaaaaatttgctgggtgtggtggcacgtgcctgtactcctagctactcggaaggctgaggcaggagaatagcttgaacccgggaggtcaaggttgcagtgagccgagataacgccactgcactccagcctggtgacagagtgacactctgtctaaaaaaacaaaaaaaaaaagtaagcctttattttctaataaaacgaagaaaaaataaatacgtatatatcttagttcaatatttttaattcaattggtgactgatcactatgactaactaatacattgaagcttttaaaaatgttattatttccctggcttatttatacgaattaagtattgaatatgtgtataaacattaaaacaaataaaaattaaacatcatatgcagttacaacaaatgatttctaacattaggacatggatttttatggaaagggagaaatattttttatactttctttgatcttcagttcaggtgattttaaataatttaatgtgcttgtttctgcacatattcattaaacatcaagagtgttagaaacctatgtataactaagaaatgttgacctggagaaaaaaaatattgtttcacctcttatctatatttgatattaattcagcaggttgacaatataacaagagcctgtgaacgaagctattgatttacttatgagggacttaaaatatctagtttactagtgacagtcagaatgcaaattaatagagaaaaagaaactcacttgttacgacttcaaaaactattctatcattctatcacatatctattggtaaatgtttaatgatacctgaattaaaattacataaaattagcaaggtatattgataaatgtttaatgagacctgaattaaaattatataaaattagcaaaataagttcatatggtattatttataatatattttttaaatttattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccaccacaatccccagagtgtgatgttccccttcctgtgtccatgtgttctcattgttcaatttccaccaatgagtgagaatatgtggtgtttggttttttgcacttgcaatagtttgctgagaatgatgatttccagcttcatccatgtccctacaaaggacatgaactcatcatttttgatggctgcatagtattccatggtgtatatgtgccacattttcttaatccagtctatcattgttggacatttgggttggttccaagtctttgctattgtgaataatgctgcaataaacatacatgtgcatgtgtgtttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccatatcctctccagcacctgttgtttcctgaatttttaatgatcgccattctaactggtgtgagatggtatcacattgtggttttggtttgcatttctctgacggccagtgatggtgagcattttttcatgtgtttttcggctgcatgaatgtcttcttttgagaagtgtctgttcatgtccttcgcccacttttcgatggggctgtttgtttttttcttgtatatttgtttgagttcattgtagattctggatattagccctttgtcagatgagtaggttgcaaaaattttttcctattttgtaggttgcttgttcactctgatggtagtttcttttgctgtgcagaagctctttagtttaattagatcccatttgtcaattttggcttttgttgccattgcttttggtgttttacatatgaagtccttgcccatgcctatgtcctgaatggtaatgcctaggttttcttctagggtttttacggttttaggtctaatgtataagtctttaatccatcttgaattgatttttatataaggtgtaaggaagggatccagtttcagctttctacatatggctagccagtttcccagcaccatttattaaatagggaatcctttccccattgcttgtttttctcaggtttgtcaaagatcagacagttgtagatatgcggcattatttctgagggctctgttctgttccattgatctatatctctgttttggtaccagtaccatgctgttttggttactgtagtcttgtagtatagtttgaagtcaggtagtgtgatgcctccagcttttttcttttggcttcagattgacttggcgatgcgggctcttttttggttccatatgaactttaaagtagttttttccaatgctgtgaagaaaggcattggtagattgattgggatggcattgaatctgcaaattaccttgggcagtatggccattttcacgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattatgaatgggagttcactcatgatttgcctctctgtttgtctgttattggtgtataagaatgcttgtgatttttgtacattgatcttgtatcctgagactttgctgaagttgtttatcagctttaggagattttgggctgagacaatggggttttccagatatacaatcatgtcatctgcaaacagggacaatttgacttcctcttttcctaattgaataccctttatttccttccactgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgcggtttttgtctttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttatgttgtgtctctgccaggctttggtatcaggatgatgctggcctcataaaatgagttagagaggattccctctttttctattgattggaatagtttcagaaggaatggtaccagctcctccttgtacctctggtagaattcggctgtgaatccatctggccctggactctttttggttggtaagctattgatcattgccgcaatttcagatcctgttattggtctattcagagattcagcttcttcctggtttagtcttgggagggtgtatgtgtcgaggaattcatccatttcttctagattttctagtttatttgcgtagaggtgtttgtagtattctctgatggtagtttgtatttgtgtgggatcggtggtgatatcccgtttatcattttttattgtgtctatttgattcttctctttttttctttattagtcttgctagcagtctctcaattttgttgatcgtttcaaaaaaccagctcctggattcgttaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggcatgttgtgtctttgttctcattggtttcaaagaacatctttatttctgccttcattttgttatgtacccagtagtcattcaggatcaggttgttcagtttccatgtagttgagcagttttgagtgagtttcttaatccggagttctagtttgatagcactgtggtctgagagacagtttgttatcatttctgttcttttacatttgctgaggacagctttacttccaactatgtggtcaattttggaataggtgtggtgtggtgctgaaaaaaatgtatattctgttgatttgaggtggagagttttgtagatatctattaggtctgcttggtgcagagctgagttcaattcctgggtatccatgttgactttctgtctcgttgatctgtctaatgttgacagtggggtgttaaagtctcccactattaatgtgtgggagtctaagtctctttgtaggtcgctcaggacttgctttatgaaacttggtgctcctgtattgggtccatatatatttaggacagttagctcttcttgttgaattgatccctttaccattatgtaatggccttctttgtctcttttgatctttgttggtttaaagtctgttttagcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggaccatttagtccatttacatttaaagttaatattgttatgtgtgaatttgatcctgtcattatgatgttagctggttattttgcttgttagttaatgcagtttcttcctagtctcgatggtctttacattttggcatgattttgcagcggctggtattggttgttcctttccatgtttagcacttccttcaggagctcttttagggcaggcctggtggtaacaaaatctctcagcatttgcttgtctgtaaagtataatttttatttttaaatgtttccttgatgtgtctcttttactgagttctaatatgatgaatcaccaaatacagataatcatagcattcaatgaagagaagttaagtgagttaattaacaggtgtttataaagctgtggtgttatgctttcactaatctttccttgtggcaaatattgtggcacattatagaaaaaataataaaactaaacaaaactaaaaataagcagttcccaagtctccaagcacaagacagagatgtctataaatttaactgaacaacttttccagtttatgtcagcaataaagggatatctaaatggagaccagaatgagacagaatcgtttgtccttctcagctgattctctctggggctcactcttctccccagttggttaatccattgttttcttcacacaggttagacacagaggagaacctttggagatgagaaatttgaactttatatttttcttctttatttctacaggctacactgaaaacagttgctctgtatcaggttagccataagttagagcaccaacttaaattaccttgaaatacatcaactttttataaattttctgatttagagatttcaaaattacttctgctattaatcaaattttccttagacatgttttccattattattgtaatattatcattattaaaataatagtagtagctacattcttttacacattattcaattatggtaagtaatttgcatattttttcttatttaagatctatacaacagttttatgggatggtggtgttaaaattatttttccttggaataataagaataaatatttgggatacctggtttggattactgcattggagaaaaacgtacttcaaagcagactatcattgttaagattgttgcatttcttgagttaatcaagagtaagaccacatttttaatgaatatctcttactatataggaataatctttcttttttttttttttctggttttgaaacagtatctctctgtcacccaggcaggagtacagtggggcagctacagctcattgcagcttcaacctctcgggtccggtggtcctcccaacatcaccctcccaagtagctggaactataagcatgcacaacaccacccgactaattttcaaattattcgtacagctgagatctgtctatgttgcccaggctggtctcaaaatcctgggctcatgtgattctcccacttcagactcccaaagtactgagattgtaggcctgggcctccaagcttggtgattctcctttttaataccttaatttgagatatggccaggcaaacagtagaccttacttctaattacagaattgggaggaaagaaagagtctgagctctgggcacacaagctgatgcagttgatggacaatgtcctgctggataacctccaaagacttggttgtaattttctcaatctccatttttcataggaacctagtagaaagcaggggacagcgaagtcatcatccaggaggaactaacatgaaaaacattttgcatatatattattattttaaaatcatttgccttaatttttaaactgcttatataaaatgaatgtttatcccttgaaatgaactacattaaaatttaatgcagatatttcaggtggcttcagctcaaaataatttgggtaatttttaacagttgtttataataagtaaatttatctttaaaggacagctgagataaataatttttatgaatttacacttacaaatttttagtatagtgttgtgcctaggggaaagtttaatacataataggtattcagtaaaaactttttgaaaaaaaaattgaagcgataaaaggttagcctggatttgccatttaatcagttcagttcagagtcttgagtatgtacatatgaatcattgttaaataaacatggaattattttgtgaattaaaactaatgtatgtacatttcttagatgatgtctaacatgcagtagacgtccagtgagtcacaaatggtgcatagtgtttacttttggaataaagtgagacagaagacaattggtattttctctgtctctcttgtataacctagcataactcacctttcttgaacataggctcatgttgagtgggaagcaagggagtaatcacatggaagaatgttctgctttcaggaattaatgcatcctattcctaaataattaactacaggtaagtatatgatagatggatggatagatagataggcagacaggcagatattctcaaacagcaattaaagtaaacattacaacttaattcaatatctcatattacagttcaagaatctgagaaaatattttctaaaataatgatattaggcatagaagagacacacttagtggctatatagaaatctcaaacttatacaaaagcaataaaagttcccctgatagatatcagtatgggaatgttatgtttacattaaaccctgtattttaaaatgacttagtattggggttggcagttttgcccccttaatcttcaatcccttgatattgcacctatgaatatgtcagcttacatgctaaaagaaactttgcagaggtgatgaagggtatgatgaggagactatcctggattagacagtttcagtctaatcactctagtccttaaaggaggagagccttttttcagctgaattcagaaagatgctgtgatggttaatattgagtgtcagcttgattggatcgaaggatgcaaagtattgttcctgggtgtgtttgtgagggtgttgccaaaggagattaacatttgagttagtgtgcatagggagaggcagacccaccctcaatctgggtgggcatcatctatcagctgccagagcagctagaataaagcaggcaggagaaggtggaagagcagacccgctgagtcttcctgccttcatttttcttctgtgctggatggttcctgctcttgaacaccgaactgcaagttcttcagctttggaccttttggacttacactactgtatgtcaggggctcttgggcctttggccagagactaaagattgcactgttggcttccctacttttcagattttgggacttggactggcttccttgctcctcagctttcagacggcctactgtgggacgtcaccttgtgatcgtgtgagtcaattctccttaataaactcccctttatatacacatctatcctattaatgttgttcctctagtgagccctgaataatacagatgctctggaaaagggagggaggggagaaattcaaagcctgagaaaatttcaacctagaggaagggggctgttatacagggaaagtgggctgcctctagaggctgagaagacctcaagccaattgtcagaaggaaaacagggacctcaatctcaaaatcaaaatgcactgaattctgccagcaatctgagcgagcaaggaaacagattatcttatattccccgaaaagccatggtactctgtcaacatttcgacttcttcctggggagacttggagcagagaaactagctgaaatcaccaaattctgacctcttgaaactgtgagataatctatttgtgttgttttatttcactaaggttgtggcaatttgttatagcaacagaaaactaatgcaggcataatggaggattcagataattacaaatttatccagctttcatttgcttacttttaaatctttccaatatgaacaacaaaaacatgttaattttgtgacttgcctcagttaacaaaaggaaagttctggtgtgaaaatgtcaatataataccgcatattttaggcaaagagaggttgtgaaatagtctcatataattataacatacatgttttctatttttatgtttactgaataaatgaaatttaacgagtttgagttaagtttctgaaaattaaacacaattgcttatatgcaaattgaaaacttgcatcaaactattttgttttgttttatatttgaaattacagtgacaatgatttccatttagctctaaagccattaagcaaggcaaatttctcaagaaaaggttcttaatgtagtccctgaagttaaatgtaacaattgtctatctaaaattgctcttggaattctacatcgcaataatcatttgcaaatgtaatatttttcagttaccaaaactattttatctttactgaactttcctgtggatgttctgaaattattccttcccttcctttaattgcagatttttcaaatgtagcttccagatagcagcttccaggtagcaatcatgatctaaatcactgaagcctgtgtagtgatgtgtatagtctcttagtccctaagaggttccacaaatatcatctcctatacacgttttgaacctcctagacgatgatacaaagcacttatagtcagactattcagtcctgggagatttttgaggtctaaaatctcacagtgattatttggttcttgtatttgtagttcatcaagtcacacagttcatcaaattcatttctggctcagaccttgccatatttaggggctaaaacagagccactacctagagtttgcttgaattctaaggccaagatcatagtctttgttttcttgttgttgttgttatcttctatatgcatttagtaatctcatatcactgggaagtctggaatgtccaaaagcctagatgatgtactgtggaactcacatgatccctctgataagggtgagagtctatacagggatagatacaatgaataaactaaaccttaatccactccctgtataattgaatctgttttaaacaaaccctaattttttaattaaagctcctctgatcattgaaatcaattgtatttgtttacctaaaacaagccatggacccgaataaggagtagattagaatacagaccaggaatggagtaaagaggtcaaaagtgaggaatgactaatttgcaaaataacaaattcaaagatagtaacaaatatcccagcctcaaagttgtaattaataatgataataatagtaataatagatatatattgactatgtgtgtgctcggcagtgttttatgtattgtatggactcataagaacagagagcccctggctcaatggaaatgggcatattatgtaaaaaaaacacacacacacacacacaaaaaactgtcttgttaaaaaccaatatatttcaggttttcttttctttctttctttccttctttcagcctgcctttctttctctctctgccctttctttctttctctttctttctctctttctttcatctctttcctttcccagtttatcttcatataaatattgattacctgaaattggtgctactgtaacaatgacaataaaatgcacagtatttactttaagtctgggcagtaaacagcaagggaactcttactggaggctgtaagaaaggcaatttgtattacgcaagagtgaaacataaaactgtcacttgtgataccatgaaagagagaaaatatcccagtgaacttgtagctttaggtcaaaagttgaacaagtttaacaaagagaatttgtgatggttgcatttgtaatggtactgagaggtgacagcgtgctggcagtcctcacatccctcgctcgctctcggtgcctcctctgcctgggctcccactttggcgacacttgaggagcccttcggccgccgctgcactgtgggagcccctttctgggctggccaaggctggagcccactccctcagcttgcagggaggtgtggagggagaggtgcgagcaggaaccggggctgcctgccgcgcttgcgggccagctggagttccgggtcagctggagttccgggtgggcgtggtcttggcggccccacactcggaacagctggccagccctgctggcaccaggcaatgagggacttagcacccgggccagtggctgcggagagtgaactgggtcccccagcagtgccagcccaccgatgctgcgctcgatttctcaccgagccttagctgccttcccgcggggtagggctcgggacctgcagcccgccatgcctgagcctcccacccactccatgggctcctgtgcgcccgagcctccccagcgagcaccaccccctgctctacggcgcccagtcccatcgaccacccaagggctgaggaatgcgagcgcacggcgcaggactggcaggcagctccacctgcagccccggtgcgggatccactaggtgaagccagctgggctcctgagtctggtggggaggtggagagtctttatatctagctcagggattgtaaacacaccaatcagcaccgtgtgtctagctcaaggtttgtgagtgcaccagtggacactctgtatctagctgctctggtggggccttggagaacctttatgtctagctcagggattgtaaatacaccaatcagcaccctgtgtttagctcaaggtttgtgagtgcaccaatcgacactccgtatctagctgctctggtggggccttggagaacctgtgtgtggaaactctgtatctaactaatctaatggggatgtgaagaacctttgtatctagctcagggattgtaaacgcaccaatcagcaccctgacaaaagaggccactcggctccaccaatcagcaggatgtgggtggggccagataagagaataaaagcaggctgcccaagccagcaatggcaaccccctggggtccccttccacagtgtggaagctttgttctttcgctctttgcaataaatcttgctactgcacactctttgggtccacgctgcttttatgagctgtcacactcaccgcgaagatctgcagcttcactcctgatcccagcaagaccaggagcccaccgggaggaacgaacaactccagacgcgctaccttaagagctgtaacactcaccgcgaaggtctgcagcttcactcctgagccagcaagaccacgaacccaccagaaggaagaaactccgaacacatctgaacatcagaagggacagactccagacgcgccaccttaagagctgtaacactcaccgcgagggtccgcggcttcattcttgaagtcagtgagaccaagaacccaccaattccagacacagtactataggaaagagatgagcttggaaaataattcaatggttttcatgcaaaaatatgatggcattgtttagaattttaggggtgtgtagggttgaaacacatttttaaccacaaccattaaaaagcaaaattgagaaatgatttgatcagcaaaggtcaatcaaaactcagattcacagtaaagtcaagtgtatgactatcacactcactgttaaaactatacagtagtttaagatgatgctcagtcaatcctttcagttcaacaaatagtgcaaggaaatgagactgaaggtaagcctgttctacagattcctggcaggatcaaggtacccaaaattaaatctaaagggagagtcatatcattaaaagaatagtatgttttataaccagaagttatgacacacacacaaaagacttgaatctttaagggggttattctgaagctgtcatcacagggttaacaagaattctggacagaaatatagttacaagtatgcattagtcaggctgcaatttgattcacttccttgtaaccaaaatcaaagtcactagatatcgaccatttgcatgtccattgttcttctaggtaggatatctgaagttagaatcataagacttttaagaatcctgaattccagcagaacagctgatgccaacccgaaaaccccacatgagaactaaatcagcatgagaatgcagtttcttcttctccctgtctcatgactgcaccctgcactcttcaactaatcaacaatctccacacatcagtccactccaaaacctttaaaaaccctaccctcaaactcctcgagaagacggccttcaggtttcctcctgtctctttgtttggcggccctacaattaaacctccttctctgctgcaacctgatgtcttggtgtattgatttgtcttgtgcatagggcaatgggcaatgaaccttttgaggctataattccactaagtcatccacctctctggaataaaaaataaaatgacctcaatattctaaagatgtaaaacaagcctataaaaaaatcctgcacagcctccagagaagacaaattctcaaattccctctttaagtgaagacaagaaggataatagaaagttaaagaactcccaaaggtcaatcccatggatgatggagaacaaggtacagaactggattgctaatcctaggaagtgaaattagggtctaatcaaggaatacacttccagtgtaaaagcacctcataaattccacacagctggatttcagaattgctgttgaccaatgaccattatatctcctgttcttcccatgtcaaaatggtcactgtggttgtcttgtgtctgcttcactatgtaatatttggtaggggaaaggggatcattgacacttaggtcaataggaatcacatccagacttcatttagagactatcacattacctagattcacggattttagttagatactaagattgcttgggactttgtgttccccccgcctggggaaacaggagaaacaggagaagtaaacagttacaccttatggaacatcttctccattaatattttcttaatagagcatttttctgctttttctatccaaacttagtagaacttacatatttctcaatgtaaatattttgaccaatatttatctaaaaaaatttcaaaaactcaacagcaatattttagcaaaaccggtatatgtgaaagtctcaggttgcataacaaatacatttgacagaacttctaaatcatatgcagatatcttgaaaacttgcagagtatcaacaaaagaaataccattcttatatgaagcacatcacagtgtcattgtcagttaaaatattctctgtgactttgtacttgtgttgaacatcttgccacattactttttatatttctatagtacttgtctaaaatagtaaaacaagtcctccaaacaataaagaaatttgtataaaaattattgagaaaagctgtatcaatggaagaaaacttactgaatgcaaaagaactgcttgttaacaaccgtattgtttggtagttaagaaccaaagatgtaagcaatttatatacttaggcaatagttcataatgtgtattctttaatgcattttaaaaagtaatatattggttgtaaatatttgactgatgtgtaactcattaggaatatttttcatttaaattattaagaaataggctacttgttagtattttcacacataaacctctaattcgcaggaataaattactgtgattaatgggagacccctgtaaaaaagaggatcaaccaagtttttggtgacaatgaagacagatgtgaccattatttgtgctgttgaaaaatatcctcattctccagcccaccttctggacacaaggtagttgcacttcctgaattctgtctggaggatggggctgggtggtgagtttcagtccgtgaggtggggtggaagaatgcatatcatttctggaccaaagtacttaatccactatgatatcctccagtgtgttatttcctccagctactgtgaaaagtaatattagctttggtccttgaatgaggatggcatatacaccagatgggctataatggacacctaacatgaatggaaaaaaaaaaaaaaatcctgtgttgttttccctctgtggggcaagtgggaggtgagttttacttgaaaaatctagtctgatctctgtttctctacaacttcattatgactgaacaagcacaaatactgtcatctctactctgatttactataaaagacttgtaattgatttttctctttcatgttcataatctgcaagtcttctttccatagagggagaataaatttttttaacatgcaaataagattgtgtcagcagttctaatgtgcctatggataattcgagtagagtataagtaaaatttactagtaggtgttccaggaactgtgaggccaaattttagaaagtccattattatggatgttagagttcccaagcataaaagagaataatgaatggaaagaaaggttataattcagttagtggctaaagtcactgaatatgtacaatgtggcagacactctttagttctcacatcactctaattctcttacaacttctcctactttatatatgaggaaatttaatgacagaaagattatggtaaacaatatgtcttaggtaacacaattgttaacgtaatagaagtgggattcaaacttgccacagagcctaacacttaactgccaaaaaccaaaaaaaaatcctgaaagttctatggacagaaccaataaaaagtaggcaaaatgagctcatgaggagtttatgaaagtgcctgttacaatgctgaatgcaaagcaactgcatgctttgtacttatattcttatctggatgctttataggtaccagattttctctgctcgttcatcagtagacagatgaatgttcctgatttccacttgacaagttaatgcattttggaagtgtaaatactcaaataaaattcaaaatcaatgtctaataaaatttttctgagcctggactccaccactagacaacgtatgcatgtaagaaatccgcacttatactcactaactctataaagacaaaaatacaaattttcttctttttcctatagtataaagagctcccttggtgcgggtgagcatgttattattcatgctctatcatattccaaatttcattttatgctacaggttagcatatcaattactatcctcattttccattgaaaggtcagcgttgctgtttgtgtggtttttgagcagaagaaatatgcattctgaacagtgttataaatgtattagttattccttaataacttattatgctacttggatgactataagaatgtaatatataccactaggtaagttatattttctcaagtagaaacaaagaattgaaaaactagaagattatcttatgatacctagtttaacttccatgttccataggtgaagaaattgagtcccaagtaagttaaataactttccctgaatttcagaggatactagtaaatagggataaattgaggaccataactgagggcccttgaatctgtgttccatgtagcttatgtaattaataaaataaaagcctcaatgttacacagcaaatatgtctatctacagaaatttattaaatagtatttttaatagtaaatgagaagtcaaaaaggttggctcatataaagatactatataaagtatttttcttgctaccacaacgtaatcattgcattgttagggttgtgttttctctgaactatccatcataagatttattttttgacttttgtatatctaatgctttctcacttagatcttctagtaattcacatctgagttcactttgctctcaccacttttctaagcagggttaggctacaatggtaacactttaccttcttgcagtgtgctatatttcattttgtaattatatgaaaagacattgtaaaaaagaggaaagaaaagctcaatgtattttacagaatgcattttgtgccaagtctgaagtaccacatacttgtgaataccagagagttttcaaagcattttcattttatttcacattatttcatttaattctcccactaatctgtagaggtaggcgaagtaggttttaatgtctctgttttatagatgagaaaacttgtcattggaaggataagtgacttgcccaagttcacactggtattaagtggtgaagctgtccattattcagtgcttctccctctacagtttactgagataatcagtgttgcttaatagtagctgcctagaatacatctactataattatgaaatacctaccctcaaagccacaaactggcccttttccaatttctcacacttttatagagcagaggtcagcaaactaaagcccacagatcaaattggagtccttcctacttttgtaaataaagtttattaaaacacaaccacagtcattcatttacatattgtctatggctgttttcccgctgcaatggcaaaggtaagtagttgggagaaaggtcacatggtcccaaagtcttcagtgctcttcggcctttgccttgaatgtgtgctgacccctgctagagaatatgaaaagctaaagtatacttccagactcttgcagctattctttcagaaactacagaaatctctaagtaatctttccaggaaatgtttttaaaataaacagacttgactggcttggctcttcttttctttgtccctttcctatatttgcttcttccaacctgtattgtgaacaacacctgggattgcagtcattacttagtatacatgaagagacaaacatatggacaaatgaggacggatagaaagaaaacagagttagggtgcctaactacatttctgagcaacttcttcagccctggacttcgtggatctataaaggattctctacatatgaaatacactgttagtagtgttacttgattataatttaaaaaaattataatggatgcattcaaatgtcctgtcatttactgagtcataacaatagtgttagcttccatgttaaggccactaaatattgaatcactttaggattcagcattttactcctttatctacacccactcccttagcgatcttatataacctcatgaatatacagtgtttatgtgatgattaatcttaattctatcacaaggccagtcatctattcagctagctactcggcaactctacatggaagtttatccatatttcaaacttgacttctgcaaaacctgatcctcttgaagatttccccattccagttaatagcaatttaatgtttcaatgcttgtgccaacaactgtggagtcatccttgatttctctctgtcatctacattccatatttttagcaaatctagtcgtaaccccatcaaaatatttcctgaggccctgcaagctgaagcttagtccttgttatacaggtgagaagaatatgtcagattgccagtgccttcctcttctataactaaaagttctttgagtctaacatctggataaattgtgcccaacattaaacttcatttttcttctgtctctatagaaatgcctcttattaaaaatcaatttgccttcatcacagacagaagcctagaccacctgagatgccatctcctcatattggaaacagctgtttaactgaactgatctagtttcaggactagtctgcagttcatttaagtgctgtgctaaaactgttggtaaggttatcaacatctttgtcacataagcctaggaacactaactgggaaccccatgagtagatgcagataactgcaaagtggttttatttttatttcccttgtgcataacccacctcaaccccacaactatgcctcttgtcaacaggaagaagctagagtgaccatcagccttttcccatctctatagccaacaccttaagagtaaggtgctatggagcccaaagcagggtttaaaactacctttgcaaattatatcagggagaaaattatgacagtaaaagagatctgatttaaccaccccgccccatcttgcctttcccttcaacattcctgagcttaggctaagctaactttgagagacatttagtttatatgacttttatcttattttgttatttttatagagatgaggtctccctatattgcccaggcttgtatcaaactcctggattcaagcaatcctcccaccttggcctcccaaagtacaaggattacaggcacgagccacagcacccattcaatataaaatttagttttaaatgataataggcctcccccaaaactcaaccacctttgtaaatctaatgaaacattatcaggctagggggaagagctaaggtgtggtctgatcacaagatatgcaacatcactatagtatattgcccttttgagatatttgttcaggttttttgcctgtctgacacctggacctgattgctcctatggctccacatggaagcaactccgcttaagaggatagctgtgccctcctacaatttcatctctgcctgaaccaatcagcagcaagtacccattacctggccaccccatcccttccctcaaactgtctttgaaaaactgctaacctaaaagcctgagatgagattgatttgagtaacaaccccatcttctgtgtagtgtggcaggccttgtgtcaattaaacttttcttcagtgcaatgccatggtctttatttatgcagcgggcaggaagaactgatcaagcaattatccttctactcttgtcttatttggcctattctctatacctcagtcagaatgacccagtaaaactgaaaagaagacaaggtcatttctctgcgcaaaatttttcaatgatttgctgtctttcttaaacagaagcgaaaatctttgacaacaacctacaaaatgttttgcagtcagtcccacttcctccccaaccctaccttgttatttccatgacctcaattcatattatagcctctttcattcattgtcctctggctacacttttttgcttgcttgtcttcctgaacatgccaagcattctcctgcctggaagtctactctggttattctttgtttgcattgctcttcaaccaactagctacatggatatctcttctcttgcaaatttctgctcaaatttgattacctcagtgagctcttccttgactattctgtataaaacagccaacaattaaccacttcccttaagatgacagcaagaatgaggaaaataaaaataaaaataaataaaagcataaaagattatccacttctctttcccattagtacttcctatattctctaatcttccattctttatttctatcattaatgttttattatgatatataatttatgtactataatatacactactcttaagtatttgctttttctccttaactcatgtcttctatgacactatatactttacttttatttatttagttatttattttttgaggcaggatctcaattctgtcacccaggctgcagtgcagtggtgtcatcacagctcatcaatgcagcctcaacctcccagcctcaagcaatcctcccacctcagcctcctgaatagctgggactaccagtttacaccaccacagttggatatgttgtttttttaaaaaattttgtagcgatggcatccccctatgttgtgcaggctggtctttaagtcctgggcttaagcgatcctccacctctgcgtctaagattaaaggctaagcttaaaggcatgagccaacacacttggtcacatttatttattatttactatatgtcttcctgaatttaatttaaaaacgataaaggcagaaattttgtttgttttatttgtagagaacccacagattttttagtaagtttctggtgaataatttaatatgcattttctcatttaatcctcacattaatgagttatttcctccacagaaaaaaggaaaaaactcaaatttattatatttaaaataattggcattggtcacattgctagtaactagtgatggaagtgacgaccagtgtggagcagctgctgcaaggatgctggttgcacagcatgagacatggacagggttgcatgttctgcagagctggtgggagccaggagcaggcgagagcccagacccctacttagttgatgaggcagaagcccgtgctccctggcacagctgcagccacccagctgtggcgctggactctagcatcactgcactcttgggggcccaggaagctacttgccatagcaggcttgaaagtacctgctcctgctccctggcctctccccacttccagcacccactctggcatggagcaaagttgtaaccaagcctgggcactgttgcaactctaacaagtgtgcgggcactcgggacagggctgacacaccagctccctgctgcctcagcctcctccagacttcgggcaccaacaagcacaggagggaggctggcgggcgtggtgagtggtgagagcagctcagcatgggcctgcagcacccctcaacacaaacagcctgggcactgtggacagcatgttgatggtggcaagaagcagacaggccctcgggtggaaaggggtgcatcccaggtgaaaccccaccttcaaggcagggatggcctgaagcctgggggccgggttgtcagttccagctggagtccactacccagagtgagaacttacggtgcttttttcgggcctgccaatgacagcccatggacaaataagcgcatatttcctcccttctgagcccactgaaaccctggactcagccagactcagacatatgtcaggactaccagctgtgggaaggaactacccacttcaggtctcctggagtgataaggatgacctgtctgcagaaaggagcgatccactaggggtctcctctgagctgttctgttgctcagtaaagctcctctccaccttgctcaccctccagttgtccgcatacctcatttttttaagaggcaggacaagaagtcaagaccaactgaatggtgggaatgaaagagctgtaacacaaacagggctgaaactccccccgatcgccatgctgtgggcgatgaaaaggagagaagagctgaagaggccctttggggacgccagacctaggggctccccgagccagggccgtgacaccctctttggggctctgtggttcctggcgtctcgaagcttctgggtgccaccgcagtcccctcatccagacacaggtgcccacagtggaagctgcttgtggtacatctgatccagccacagccttacacagagcccgcacctgtgccggtgcctggagctgcccaccgcgctgcagcagccagcatgcctggctgtgcgcagtgggtggaccccacgctcactttctcacatatcccttgccactccatgcctggcttacccttggccggcgtgggatcctagccggtggtgcaagccaagcacagcctggcaggctgactgggcagaacgagccagtgggcccaagcaaaactcaggcaaacgtgccactggccacagaggtttccagctggaaaagcaacaccctaaggaactcaagacagcagtgttgccaagattttaatttagaaattgtgaagtcacacaataccctcttaattaccatgctctatattctcctagctgctctgtagaaaaaagttcagacaaaacaaatagtaacatgattgaaatggagattggcaggatactagaacaagcagatatcaagctacttcagaacaatatcctcttagttgccaaatctaagagaaaaagtaaataagctcataataaaatacagagaacaaaaaacctgagaatgtatgattaagataatatcaatatgagaaaatactacatttaaaactagttgtcagtggaaggaggagtagagaaaggaagagaatagaactctattaagtcaagtttcaggaagaattttccagtctgaataaataagataagttattagggaagtaataaagggtcacttctagaagaataaaaacctgtatatgtttatccattaactcaaaaaaaaattattcaatcctttcatcttgaaagagaaagagatgcatttaataatggattatttaaatgcatctctttctctttccaaggcccaaataatgttatcacaaagtaacaccaacaatgtgaaaacccatagaattgtgactacaaaaattgagatatttcagcacacttttagcggatctaaagtgaatttaagaggtaggaaccatttagtagagccaaaaacgataaaacctgaaattctctagagtaggatgttaatgaatggtgaaagattctgaataaggaagcaaaaattgccatggaaagcagggaatgaggcaagattataaaaacacagaacctgttttttcctcaggactcttatccttacctcaagtacacaggttccgttgctgtttgagatcagtgttttatttgctaaataaatatggagcagaggatccagacttgactccccaggtgtaagagaagagtgaggcacaaagctggaaaaaaagaaataagaaaaattattttatctttcagtttcttctcatcatccctaagctctcccacatcttatggagggatataatcccctcctttcagattagccagtatcctgcctttagctatagtcctacatttattgtctgtgtaattactgagagaaataagatggtaattaactttcaaaatgggcagtatacctgtaacaaagtctttgaaagcaactgacatacaaaaattctacaaataaaagtaagtgtaagctcaaataatacaatagtacattatttatagaataatgcttttcccattccattgtattttaaacctatgaacccaaatgccatactggaaagaaatgttagggaaatgtcagcagtaattcagtgggtccatgaaagggcttcaacttggcaggaaacctctaaaattatatgcaggatcatatttgtattttcatagtgatggttttcatgagagtatctctaaatgaatttcaaaaataattctttcattaaaaagagttttttttttcctttaggaaactttttaatacataggctatccgtgaaatatgtatatgtcttcagttgctgttgaaagcaaaatcagctactcctctgtctgaaaagtattttacttcatcttcattcttgaagggtattttcaaggcatatagaattcaaggttgggagttttgctgttattgttctttctgtgttgttctgggtttttatttggcatgttgagaatatcattttactgttttctgacttttattgctgctattgacaagtcacctttcaacttaatattttctcttgggccattttttaagatttttttatggtgtatttgatgaggtacagtttcattataatgtttctagttgtggatttatttttatttcttttttcctgaaattacttaggatccttgactctatggatttctgtcattgaccatttctgaaaaattatcagccacaattttttttttacccttggccagtaaaatttattatctgtgccctatttctttttttctcctcttaggacttctgttgaaataatgttacattttctcactctgtcctgtatatactttattctcttcctgtattttccttttatttctttgtctcccatgcttgtggtgttttttacagtgtaaacttagcttagctagaaatatgttttccatatgtgcttccctatatgcttccaggttatagtgggccaaaatagaagttggtacatgatttggaaagtggagaggaagcaacagccataacctctgttggttgttttggtgttaggctgtaagaaccagaagcatcaacgctcagagaagcaaattcaaaattaaccatactcttcccaactctgcatttgtaatattcacctgctagccctattgaccaagagtgacctcaggcctactccatctcagatgcaaaggcaataccctgacacagatgtctccactagttctccttaatggtcccattctgcaagtcagccatgcctggtttctgagatctctggcaagttctaatttgtccacccatactggttcttcagagaggaggagagcaaatttttctgatcctctaactcacccattctgacccttacttacccagtgtcttgtgtagttgtctaaagttttagtgctataataaatgtcctattctgtattacttacagtggtagtgctcacatggttgaactttgtctgtactgcgtactgttttactgcactctttttaagaacactaacttcacatccttgtatataattagctatgaggtctatgcaatgaatttttaatttattaaattttggagatctttatgttctttatatccttttttacatctgtagcatcacattttatttccctgtttctgttgatgtccttaacttttgtctttgacttctttaagttaaaaagcttaagagtttcttctgccttgacctcctgggctctagtggtctttctggcctggaattagtcatctcacagagtaatccacgaaaagatttagaaacaactgagctcgaaccaaagcttggaccagttcctaagtaataaataagttctccttgtttaacatcacactagattgtaaagtccttataaaaaatagatttgcttattttatccataactgaatatatagggcctcgaggagttctgagtatctgagaggtactcaatacatatttgttgaataaaagcatggccaaaaaaggataaattattttgtgctctccctgatgatttcaataggatgtacttctgggtctatttattttgttgtttgtgtttcggtgggtacatgcttttggtgtgtttttactttatgtacctggctacctttgatcgagctaagcattacacataattaactgtataattaagcataattaagcactgcataattatttgtaggaataattagaggactgagatgaaggaaagccttcatccagagaggatttctgtttgtttcagtcaacgggggcattacttgtcctcagtcacattcaacaatttgaatacgttagattactgaagcctccagacttttaaaattgggctacaattcttcaagaaagccaatcattttatttttttttattcacctttgtcccaaaggtgtatttattaggtagcaacttattgtgggacacttacctgttagactcttcattttgttctatattttttaactatagataggtcaatacaaatattcacatttatgtaactaacaaatacttctattagttctagttttccctgtgatttcagtctaataagtatttcttttcttacaagacctgcagtgattttaagaagatattttaaaatatatcttacgcagatttttagaagtttttaatagaattgtttgtacaaacaatcctcccattatgggaaacacctagcctccagaaaataactttaagaataatttagagagctttgattaaaaatgtagataggaggcaggactagcttgcagttcctgcttggacagacagagcagtgtgtgaagacttacatcataaaattttgctccaagaactaccacaggaaaataccaggaaagctgagagaattatctgaccctttgaaggaactggattgctactgcaggctccctgagatgccaaaacattgtgagtgtacttgctttctcagcagggatgctggtggtctgaggcaagttctcagccctggtcaccagctgcctaaaaatagactcagtgttgttggggggacacagtgggagtaagactggcctttaggactgtgggctgtgtgggagcagggtgagtcctgcgactgctgactttcccccacttctttggtgacctgtacgactcagcagaggcaacctaatacacctgggaatataactccattggcctgggaaccacattcccattccacacagcagctgcagcaagccccacccaaggagagcctgaactaagacatgcctatccctgctaccacccggtggtctttctctaaccagtgtagttgccaaagaaaaaggacataatctcttgggagctctatggccttgtccactggctgagaaacctgaatacttaaccagacattcctagggcaagtttgcatcctccctatagtaccacagctgatgcactcttgaaagtgccacctcctgcctggagggcaaccaacacaaaaccagtgcactgaacaaaaacacaaccaaagaccctcacagagtccacctcactcccctactatctccaccagagcaggttactggtatccacagctgaaagacctgaagatgaatcacatcagaggactctccagtaccagcccagagctcagtacctctgcttggtggctagatccaaaaaagcgaaaacaatcactgaagttcacctctcaagaagccctatccctagggggagggggtacaagaataccacatcaagggagcacgcggtgggacaaaaaaatctgaacagcagctcttgagtcccagatcttccctctgacatagtctacccaatgagaagaaaacataaaaacaattctggtaacatgacaaaacaaggttttttaacacccttaaaagatcataccagctcactagcaatggatccaaaccaagatgaaatctctgaattgccagaaaaaaattcagaaggttgattattaagctcatcaatgaggcatcagagtaaagtgaaatccaacttgaaatcaaaaacatgatacaggttattaaagaaaaaaccttcagtgaaatagatagcataaataaaaacaatcacaacttatagaaagaaggatacacttagagaaatccaaagtgtactggaaagtctcagcaatagaatagaacaagcaaaagaaagaacttcagagcttgaagacaaggctttcaaattaacccaatccatcaaagacaaaaaagtaataaataaatgaacaaagcctacaaaaagtttgggactatgttaagcattcaaacctaagaataattggtgtttccgtggaagaagagaaatcaaaaagtttggaaaacatacctgagagaacaatcaaagacaacatccccagccttgctagagatctagacatccaaatacaaaacactcaaagaacacctgggaaattcatcgcaaaaagatcattgcctaggcacatagtcattaggttatctgaagtcaagacaaaggaaagaatcttaacagcagtgaggcaaaagcatcacgtaacctataaagaaaaacctatcagattaacagcagatttctcagcagaaatcctgcaagccagaagagattgggggtcctatttttagcctccttaaacaaaacaattatcagccgagaattttgtatccactgaaataagctttataaatgaaggaaagatacagtcttttccagtcaaacaaaagctgtgagaattcgccactaccaagccagcactacaagaaccgctaaaaggagtgataagacttcaaaataaaccaaaatagaacctccttaaagcataaatctcacaggacttatataacaataacacaatgaaacaaacaaggtattcaggcaacaaatagcatgatgaataggataataatacctcacatctcagtactaatgttgaaaatgaactaatatagggactttagcactccactgacagcactagacaggtcattaagatacaaagtcaacaaagaaacaatggacttagactataccctacagcaaatggatttaatagatatttacagaacattctacccaacaactgcaggatatacattctgttcatcagcatatggaacattctacaagataaaccatatgataggccacaaataagtctcagtaaatttaagaaaatcaaaattatataaagtactctctcagaccacagtggaataaaactagaaatcaactccaaaaggaaccttcaaaaccatgcaaatacatggaaattaaataaactgttcctgattgatcagcagtcaacaataaagtgaagatggatattaaaaacgttttgaactgaataatagtgacacaacctatctaaccctctgggatacggcaaaagtggtgctaagaggaatgttcataggattcaatgcctatatcaaaaagtctaaaagggcacaaatagacaatctaaggtcacacctcatggaaccagagaaacaagaaccatacaaactcaaacagagcagaagaaaataaataatgaatataagatcagaactaaatgaaactgaaacaaaaaaactacaaaagataatgaaacaaaaagctagttatttgaaaagagaaataaaattgataggctgttagtgagattaaccaagaaaagaagagagaagtttgaagtatgctcaattagagatgaaatgggagatattactattgataccacagaaatacaaaagattattcaagtctactacgaacacctttatgcacataaactagaaaacctagaggagatggttaaattcctggaaagaaacaactctcctagaatataccaggaagataaagaaactctgaacaaaccaataacaagcagcgagattgaaatggtaataaaaaaaattcccagctaaaaaaagtgcggaatcagatggattcacagctgaattccttcagacattcaaagaagaattcaaacgaattctactgatactattccacaaagtaaagaaagacggaatcctccctaaatcattctataaagccagtatcaccctaataccaaaaccagagaaggacatcacaactacaacaagaacaaaaaaactgcagaccaatatccctgttgagcacaaggacaaaatactagctaatgaaatgcaacatcatattaaaaagataatccactatgatcaagtgggtttataccagggatgcagggatggtttaatatctgcaagtcaataaatgtgatacccaacataaacagaattaaaaacgaaagtcacatgattatatcaatagatgcagacaaagcatttgataaaatacagcatcctttatgaataaaaccttcaacaaaagtggaatagaagggacataccttaaggtaataaaaaccatctatgacatacccacagccaacattatactgcatgggaagaagctgaatgcattccttctgagaaccagaacacgactagcatgcccactttcaccacttctattcaacacagtacttgaagttctagctagagcaatcagaccagaaagagataaaagacatccaatttggtaaagaggaagtcaaactgtcactgtctgctgatatgatcgtatacctagaaaaccctaaagacttatctaaaaagctcctagaactgatgaatgactcagcaaagtttcaggatacaaaattaatgtacacaaatcagtagctttgctatacaccagcagcgaccaagctaagaatcaaattaagaaccacttttacaataacagcataaaaaataaaatacttcaaaaaatacctaaccaagaagatgaaagacctctgcaaggaaaactacaaaacactactgaaagaaatcacagacgatacaaacaaatggaaacacattccatgctcatctcatgggtagaatcgaaatcatgaaaatgaccatactgccaaaagcaacctacaaattaaatgcaatgctcattaaaataccaccatcattcttcacagaactagaaaaaacaatctgaaaaatttatacggaactaaaacagaggccatatagctaaagccagactaagcaaaaagaataaatctgcaggtatcacattacctgacttcacactatactataaagccatagtcaccaaaacagcatggtacaggtataaaaataggcacatagaccaatggaacagaatatataaccctgaaataaagccaaatatttacagccaactgatctttgacaaagcaaacaaaaacataaagtggggaaaggacaaactattctacaaatgatgctgggataattggcaagccacatgtagaagaatgaagctggatcctcatctctcaccttatataaaaatcaactcaagatgcatcaaagtcttaaatgtaagacctgaaaccataaagattctagaatataacatcagaaaaaccattgcagacattggctttgccaaagagttcatgactaagaactcaaaagcaaatgccacaaaaacaaagatattgtaaatagatgggagttaattaaccaaaaagcttttgctcaacaagataaataattagcagagttaacagacaacccagtaattgggggtaaattttcacaatttatatatccaacaaaggactaatatgcagaatctacaaagaactcaaacaaatcagtgagaaacaaacaaaaaaacaaacaaaatcttagcaaaatgtgggctaaggacatgaaaagacaatcctcaaaaaaagatatacaaatggccagcaaacatatagaacaatgcgtaacatcactaattatcaggaaaatacaaatcaaaaccacgatgtgctaccatcttactgctgcaagaatggccaaaataaaataaaaaataatagatcttggcgtggatgtggtgaaaaggaaacacttttacactgttggtgggaatgtaaactaatacgaccactatggaaaacaatgtggagattccttaaagaattaaaagtagatctaccatttgatcacgcaattccattactaggtatctacccagaggaaaataagtcattataacaaaaagatacttgcacgcacatgtttatagcagcagaatctgcaattgcaaaaaatggaatgaacccaaatgtccatcaatcaatgagtggataaagaaaatatatgtgtgtgtgtgtgtgtgtgtgtgtgtgtgtgtgtgtataccatagaatactacacagccataaaaaggaatgaaataatggtatttgcagcaacctggatggtattggagactattattctaagtgaagtaactcaggaatggaaagccaaacatcgtatgttctcattcatatgtgggaacagagctatgaggacacaaaggcataagaatgatacaatagactttggggacttgggagaaatggtgggagggtcgtgaggagtaaaagagtacacattgggtacattgtacactgcttgggtgatgggtgcaccaaaatctcagaaatcaccattagagtacttattcatataaccaaacaccacctgttccccaaacacctattgaaataaaaaaaaaatcaatttataaaacaaacagagaaaagggaagaaaaaagaaaacaaccttcattcacatttaactgaaattggtggctgaacaacgcactattccacctaggcttttacacatgtaagaaagggaacaaaagatttttaaaaagtgtccaggcctggtggctcatgcctgtaatcccagcactttgggaggctgaggagaaggtagatcacggggtcaggagatagagaccatcctggctaacatgctgataccccatctctactaaaaatacaaaaaattagctgggcatggtggcacacacctgtagtctcagctactcgggaggctgaggcaggagaatcacttgaacctgggaggccagtgagctgagatcgcgccactgcactccagcctgtgcgacagagcgagactctgtctcaaaaaaaaaaaaaaaaaaaaaggaaaaaagaaaaacttaaacaataaaaattgacattacttgcaagacccaactattttctatgatttcctttattctagcaagagttttgtatgtgttttgttttgtttgttttgttttcaagattggacgccttttcaaagaccttaacctatgtgtttgtgcataatgtgtatagcataggttcttttctgaaagtgtgtccaatcttaaaacacacacacacacacatacacacatccatgtgcatttgtaataactgaaactaaaagaagctgattactaagaatataatgaaccttattgtttactcttcatcaaacatataatcatcaaatatccatttaaattataaataaaaataagtgatttcataagataagtttgatgccagaaacgaggattgaactggtttgatccatgaaatgctgatacatgcaaaatagaactccatttgtaatttctttaaagtaatactccattcttttttattagaccattgatgagttcgctcctttctctagatcagaactatttagattgtttttttacaaattcagtatgaaggaatttgttttttaataggtgtgaatagcatcgatgtaatgatgtgtcattgagccccacatttctgtcactagagtggtaaaatgacacagaggatgaaccaaaagtcacctgtagatgacaatgggtgaaagaaaacacatttaatttacatagaaacatacagaatgtcaaaagagttaaaattcatgaataaaatttcattaaaaatgcattctaaaatattagttaaatatacactacttaagaatgatttaaaactagcattaaatgtattaaaatggatatattttgcaggaaaaggatgcctgtgttttcagtgttttatctgaattatttaatggtttacaaaactttctgtgaatgaagggaaagcagttttttatctgagtattctcagtgttatctgagcattctcattgcctacataacttattctgaatgaaggcaggcaaaatagagagaaaagactgagtatctataccatataatactttaaatagaaaacattagccctttgttacatatctataggctgaataagaactcaaacacagctcttccaactcaacacacaatgctctctttgaggtctgaaggttataaggctatactcataacagattctcagtctcacaattaaactaaaatctaggcttgaagagattaacactatttagcatgccaggctgggttgtaacacagtagccatatatttattttatttcattttgattttagacctgcagtgtattgccagaccccaggtgagtttgaaatattgcaatggttatttcagaatactttgtgtggctttactgtcatttatgttaaaggtaaacaggattctctgctcgatcattgacatcaaaggcaaaaacgaatgataaattattttccctctattcttgcattttgagacaatttttgttgaagttcaaatttacaagcgtttcgggaggatgttttcttctggggaaacaacattcacagcagtccagactgagggtacacagagagcaaaaacagctctagctgctgagtgtcctgcttatactctcacatttgcccatctactaatctctattactgttttatcttatttttacagatcctacatatctaggaggttccttttaaaatgcaaataaaatatctaaatgggagtgtcactgacttcattatcattcatcaacaccataacagggattattttatcacattagtttgcttcagagagttgagctgcaagaaaatgggactgaattcacttatgttttgaaaatgaaagtgctggataacaaggtagcagttttcaacaaatttaaatataaaaacctttattaatataataaaatgtctaatgtctattaaattatatagtggcaaaagtcttagagaattcagggacatgttaatattatcaattataaattgtactagagaaagctactccaaatgggtggaaatcaaagaagctgatcattttccaaggaatgaccttgcatgcttttacctaaaggaactgtttaaatttttagatcagaaaaataagtgaaaaaaaacagaagaatggtctaaaatatatatacttatttaatgttactgtcagaaaatataggcttgtaagagagcttggatttcaattttagaaagaaacttcggtttctttggagacaatgtttatattaattcaatagtgtttctgtacatatatatctgatattgactgccattgtctcttctataactttctttgagtcctaggtttatatttaatcttatgatatcttcatgtatatctcctataaatatttcaaacttaaatttttaaaagcataagacatcatttcccctctccagttgcaaaactcttccttctttgtaaatgaatgaataatacagcaaccactagaggatgcaggctagaatcttggaagtcttactttatttcttctcttatctcattatgtccttactttcatgtttacttttgaaactatccagttctctctttttctgtaaaaaatccagagtctcctatcatccagtcaaaatttctgctgtagttgtgtaaccagtctctttaatccaaggtatattttcagtgctatattagcagtcatactgaaaaaataaactaaccattgttatttgggataatttattatgcagtaataaataactaatacgctaaattgagaactcctggaaagagagaaaaacatataaaagattctttttttttacactaaatccctaggctccatctcactttgatggtattagacacaatagaagctccatttttttctgatgtatgtagaattaaaataaataaaagcaaaacatcaataattaaaacaactataaaaatgtgtagctcaaactagagggaagctggaatggcttgaggaaggaaaatgataaatgaaatcaaagaattgattcatgtgaaataaaagaaaaatgctttttgcaaacaatactgctgactaaagggtatacatcttatgaaatgaaataatttatttttttgctcactgaacactatgatggagttatagatgcagaagtaattttgtagttgactttgaaaattgttttgaaaagtagaagaaacgagttagatgtttattgaggcaattggaggaaaaattgtgctgaagttaaggaggatagggaggaggagacaggaagagaaagaaaatatcccagagaagtgtaatggtggtggcattggatggcttgttggtgtcacttttttcatattttgaaattttttaatgtatgttcaaatcacagaaaggactgattccacttctgtgtagttagtgtaaatatagagagcacctactcagtgaaaagaaaattaataagcttgaataatttagaagaagatggaactcttagctagaggtcactaaaaaaagagaacatcaggaatgtaaagacatactagggagaatattgaactttcccctaaaatacagtaaaattttgagctgatattgtctagatctttaaggcaggaagggtgcagatgaaatatcagttatctaatatcaacatgagcttagtttaatgaatcatgagattgtacttatgttaaataactacattttgaatcagtgataactatccaggatataagaaatcatttattttccataacaggactgtaatgcagaggtttggctacacagatgatggagaagccaaatatctcccagtaggaagtcactaccaatactaattaggagggataaacgaagaggaggttcaacctaagccagaagatagtgttaacaggcagaagctacaatcatgtggacatgtcctgaaaaagtgggagccacaaaggatacacagattctggatactacctaattcagagagaaagggcgagggagagagaaataccctgtgttttctatttcttcacttaatttttatctgtgcctacctttgtccaaaaccacccagaagcagatgacagggttgcccagaaaatacaagattatcagtcctgttacacagagcacagcaagaaaagaacaaatcattggtcaaacacacccaggatgggcatagtttatatgtaagggggaccaaattatcaaataacttgataaaaagagtgaatctagagatataaagtaacaatgaagataaaattgccaccaaacaagtttgcctagcacaagctttgatatacactgatttcagagccccattaggatactggtgccactgagacaattaaatttcagaacccatttaattttatacaggaacccacttcagctcagatatcatatcattgccgtattcacaacatttaaattgatttgcgggcaatccaacttttaattctgactcatgtaagtcttctagatttacagcaacaccatgttgaactgcactggtttgtcatctctcccattccaggatctgtttatattcagcactgtatctcaaggacaggcaaatagagtcagatttttgacatagccgaagagtggtgactttagagaaccctatttcctcttataagagctttttaggaaataaccagttactagcaggtttaatgcattggcaaagtccaagtgtcctctacatctcacatcctttgtgtcatctataaggacataggaaggcaacttccagaagcaaaaatatgtctgtatcttctgccctcactttttaggtcaacacagccaccacaacccgagctgccattttcatttcctgccatggatatctgacagtccttcatactgaagaaaagtaagtttcattgatataaaaagttataggattattagaagtatttatacttatttttgtttttagcatgcccactaaatacttcagagttagtcataaattgacaagacaacccctcggctttactcatttcattatttattagttctcaaaacaattttctcaaagtgtgaaagtttcttttaaaaaaggtagcatgaaactatttcagccagaaatagcctatgaattcatagtatatgtgtcactttcctttgcctttctgtaatagttactcacagacctgagcttctgtaattggcttattttattacttggaataaataagattgtatacaagaaatcctgtaggagaggaaaacacaactcttgggcgtggatattattctttgacaacccaaagatttttccaaatggttaataaatggaccattatcttatttactcttgaggaaacttcttttccagcatctgaggtaatgacttcccagtttttgacctgccactgtaaggtttaaatttggttttcctcaaaactgatagatatcagaaattacatctaaagtgttaaagattctgagctacatagtactgggtgtcaaaaggttacagagacatccctataccagctgagagtccattaaaaaggtcactcacttctgttctcacaagtattgttcactgaattgagtcaagaaacgctcaataaaagggaaaaagaactaaaattgttcctgagaattacctgacaaaagtgagatcaccgaaagaaatgatttaggaccataccacggagagacacaaagtggtaccagagaccagctcattaagtttaccatatacaactatggtaatttgtttttaaaagatattctaaaacaggtaagtcaaagtttcacatatggaaatatgtccaaattaaaatgtgcttgtcttcctgaagagtctgggtcattcattaaaaaaaaaaaaaaaaaaaaaaatgtttgtccaagattttagagcaggaataaaatatcttcatgagaattacttttctattcataacaggaatttgtagtaactcaatgcatttttataattaaaatgtattattaattttgtgtaatacaaatgaaattggatttagagataagtttctggatgacattgaaaactcagtattagaaaaattccaaataatttatagagaattctcaataatttatttaaatactctgccatcaagtagatacagcataactgctcaccacttaagtgtgagatgcatatagtgacttccttctaaagaatatagtatgaaaatgaggggaaaaataacatctgtacaatcaagatacctggaaaatactgctttagtgagttaatcaaggttaacatcattaataagttgttgtttatagtatatatagtatatataccaattataaatatatgttgatagtgtatccccttgaaatggtacaatgaaaatggcactttacctctttattttccttgaaatagataaaccatatctagccatgagaaaaacccagacttaaggatttttcataaaatatctcatcatgttcctcaacacttttaaaataggcctactttgttttattgtgctttgctgatgctgtgtgtttttttatttgtttgtttgttttttaacaaattgaagggttgtgttaactgtgtccagcaagatgtgactgaattgctgcaatcttatgatcaaatttggagagatgagagttgctttttatggatgagcaaataacatggtttcttgagatgtaatctattcctggcgaagatgctgtgaacaatgttgaaataacagggatttagcatattacataaagttagttgagaaagcagtggcagggtttgagaggattgactctaattttgaaagaagtacattggtgtcatttttccaacaccatgtgctcacttcgtgtctctgcgtcacattttcgtaattctcaccatatttcagacgttttcattattatatctgttaaggtgattagtgacctttggtgttaccattgtaattgttttggggcaccacaaaccatgcccatataagatcacaaacctaatcaacaaatgtatgtattctgactgctccacccactggcgattccctctttcctccccgtctcctcagtctctctattctttgagaaacaacaatattgaaattatgccaattagaaactctacaatagcctttaaatcttcaagtgaaaggaagagtagcacatctctcatttaaaatcaaaagctagaaatgattatgcttagtgaggaaggcaggctgaaagctgagataggttgaaagccaggcctcttgcaccaaacagttaaccaagttatgaatgcaaagcggaagttcgtgagggaaagtgctatttcagtgaacgtatgaatgataaaaacaggcttatggctgtgtgatctggataaaagataaaaccagctaaaacatttgcccaagccaaagtttaatctgtagcaaggttctaactctcttcaattacgtgaagacagagagatgaggaagttacagaagaaaagtttgaaagtaactgggaagtcattacctcagatgctggaaaagaagtttgaaactagcagatgtttgttcatgaggtttacagaaaggagtcattcctataatataaaactgcaaagtagagcagcaagtgctaatgtagaagctgcagcaagttattcagaagatctagctaagataattgatgaagatgattaagatgaacaatggattttcaatggaaacaaaacagtttaatatgagaagaatatccaaataggaatttcatagctagagaacagaagtcaatgcctggtttcacagcttcaaaggacaggctgactttcttgttagaggctaatgtagctggtgattttaaagttgaaactgaatctcatttactattttgaacattttaggccccttaagaattatgttcaatctactctgcctgtcctctagaaatggaggaacaaagcctcaatgatagcacatctgtttacagcatgatttactgactatgttaagcccactcttgagacatactgctcaggaaaagatttgtttcaaaatattactatttatagataatgcacctggtcactcaagggttctaacagaggtatacaatggagaagcatgttgctttcatgcctgctaacaaaatatccttctgtagcccatggattgaggagtgatttttactttcaaattttattgtttaagaaataaatttcataaggctacagatgccgtagatcgtgatttctctgagggatcttccggaaaagattcaccattctaaattccattaagaacattagtgtttcatggtaggaagtcaacatatcaacaatactagaagtttggaaaaagttgattccaaatctcatagatgacattgaggacccaagatttgaatggagggagtaactgcagatgtggtagaaatagcaagagaactagaagtgggagaggagctgaaagatgtgactgaattgctgtaatctcatgatcaaacttgaagagatgagaattgctttttatggatgagcaaataacgtggtttcttgagatgtaatctattcctggtgaagatgctgtgaacagcgttgaaataacagggatttagcatattacataaagttagttgagaaagcagtggcagggtttgagaggattgactctaattttgaaagaagttctactgtgggtaaaatgttatcaaatagcattgcgtgctacagaaaaatctttcatgaaaggaagttaattgatgtatcaaactttattgttgtcttattttaagaaattgtcaaagatatcccaaccttccttcatcagtcagcaaaagccaatattgaggcaagatcctccaccagcacaaacatcataacttgctggagagtcagatgatcactggaattttttagcaagaaagtatttttaatttaagatatgcacattgttttttaggcataatgttattgcacacttaatagattacagtatagtgtaagcataagctttatatgtgctggtaaccaaatagcttgtgggatttactttattgaggttgcctggaactgaactcacaatatctatgaggtatgcctgtattatcaaaagcaaggaaagtctgagaaactgtcacagtctatatgagctcaaggagataagaccaccaaatgtaaaataatgtcctatataggaccctataacagaaaaatgaaatgacataaaaactataaaaatctgaaaactgtatggacttttgttaatcataatgtatcaatatcagttcattagttgcaacagatgtatcatggggaaactaggtgtgaaatttaagagaagactaatattcctgcaactcttccataaacttaaaactattataaaatgaaaagtttatttctttaaaaacttagattagtaaaatatagttaaaatattaataaactccctgaaaactatgaataatgataactatgactaacatgattgtattttgagtgatcaatctactcagatattcagtatatttcaaatttaatgtttgcttaatggaaacatacttaaaagtaaaacattgcccagaagtaaatgaggaaagttaaattttaaattatgatacacatgtaacatatatggaattgaactgcagcctttcctaactttatatggagcatctccacctccctacttgccaattccaacactaacccaactctaagcacactggcaaatcatattgtgtttacagatattgtcttgggatggggataaaggaaagaatacattgtatctcatatagcaagcattataaaaatgatctttaaaccttttttttcttttttttaatgaaaggtctagaaggtttgtttagctttattctcacactctccagaatctttttctttttctctttttgaagaccacatgggtgcagctttattccactcttagtttatctagatcctattgtttttgtagttaatttaaatctctcttgatttatttaatttatagccttacatatcaatatcctggaagaacttgaaaatgttcctttagatttttatttttaagaaggaaagataaaagtattgcagataacttttttaacttcctttattatttgctctgccacaaacaacctatataatattcagtatttttttccaggattaacaaaaggaaactttgttttcaacaatttttatggtgcaggagtactatctggcaatacaagtttatttgaaacagaactgcatgacactcacatattaagcactttatgaaggaaaaccgtaagaaaatatcctagaaagtaaaatgttggaatataaaataaggaatcctatgctaaatctctgcctttggtgatttcaatgattgagaccaaactcagatttccatcaagattcgtaaaacttatcctgccattgttgaattcactactggagtatatatactgttcctggtcaatttttagaaacacctgagctgataaaagttaaaagaatcacgaggagaactggaaatactgacttataggagataataaatatccttagattcatatactatgaaaaaatgttttgctgtcttcttagctgctatgctttctatttcttttttttgacacacaaacattagaattttcaaacaaatttactaattttatgaacttactattttatttatttattattctatgtacagtattccattactatacaatgaagagtatattttctttcatttttaggtggttaataaaataattcacacaaggttatggctaatcaaattattgtagtcaagaagtcagaattgcagataacagctcttggaagtccacccctaagtatggagggtgttcatgagtttaagagaaattttcgtgaactgactagtcacataaactggtttctactatagttggggacaggactggctgtataaatgacagggtatagtgcaaaatgaagataaggggctgcttattaaaaatttattcagaattttaaaatggtgtcaaaagatcatgaaaccaacagcaagaaccttttgagcattgagtcctgtgcaaatgtaaaaaatcatgaagctggtcctgcataggggtagtgagaattagggaataaatactattttccttttggtaacttagtgatcccctgttttaagtatgaatccataatcttaaactattttctcttctttggtataccattgcatgtactatctctccttttaagcttttctgcttttctcttgtatttatttaatttataaaccttcaaataaatgaaatatgatgaggggacagttcctcatgtagcacttagtcataggtaaggagtggaaaagcgcttcatggcactttattttaatgtttaatttatataactatacgcctttttgaaacctgtaaggacaaacaattgaacatctaaagacagatatccatatgtactgtaatttcctgaattctacatttttgggaaaaaagatgttcttctatggtaagggaaatatatgtatactcacacaaacacactcacacgcaattatatatttttagtaccctattacgtttgaatataacatgaaataacagacatatgcaatgcttacggaaaattgatatattaactttctgatactgtgatcaccttaatttcttgataattcattttatttgcatgtgaagctttgtaaacttatattttgaaattgaaagagtcaattagaaagcacctcaggactcatagtgtccttcttttattgctttgtaacacactgcttttatgtaattgctttaatactctactatgtagcactagtgtgacaatgattattatgataatgatgataataaaagcgatatttaataatataaattgtaccttgaaataagctgtaagtacagtctacagagcttaaatgctaaattctcaaaataactcggtctataagtggtagtcttttatttgtttttctgcagctcctaaacactttccaaaatgtattcagaaagtgattataatggaaagatggtcttccttaccaaaggaatgtttagatcctttctgagacctagggactatatctcacctccagagaaccataggtttatataaccaccatatatgagacggtaaaatattaattacaacaataagcatcttttgagaactttttccaggctatatcagaagcaaaaaaggttttgtttggtgtttgttcttgctttgttctatgccccttccatgtagtgaccattattatacatatcttgagggaactgaggcttaaaaagattatataaatttaaacagagtaaatttgcacaaggctatgctacaatgttaaaatactttcacagaactttataacttacaaagtattttcctatttagctcaataataaacacataaggtcacttaggctccaataataatacaattttgaatgaatgagatattcttgccttatacttccatggaagagaaaggaattgcattatacactatttccatgatttagttacagacatattgctatgtgaacagaaaggaggataaggcaaattctacctggaactttcggatgatttcatgagtggtcatttgtaccacttctcccaagcagttttagaattatatgagcaaatgtatgaagatggtaaaaatctgtgcctgcacaaggaacaatacacagtctggtttggttagagaatagaatacaaaatggcagctattcttggaaaatgcatattaggctgatctataaaactttgaattcctacttatatgtacaggatctttctgtgtcagttttgaatggaggcataatgaaaggatggagaggcaagaaggaggttacttaaaaggctacagctaaggcaaagttaataatcaccagagattagacagtagggaagaaactggatgcaaattcaccacactcattttactttttttctggtcacaccatatttctagacttcctttaagtaaaggttaaggataaattaaggttaaggataaaaaaaaaggcaaaagtaaataaattatttgcaacctatcatacatatctaacaacagaataaaaagataaaaggtactgattctgaacattcccaaaatttaccacttaatttctggaagaggtttatcttctactcaaatttagtgaagagagaaggtcactgtggcttaatgaaatggctcatctccaagctaatgtccaatctcatatcagccaaagtatgatcaccaggttacattaaggatgagcttgatatatattttttcactcaaacacccatcagctttgcaatgcaatattctctctcaaaggcaagggagacatcgatgttaaataaaaaacaaaagaatttagaacaatctattttgcattgttacatacttatacaattgcaattaatatttgctttattttaatctaccataaaattgtctgtaaatggaatttctcctcaataaatgagtgctccacatcttttgccccatctttcagctcaataatccatgctcagggtggatgtggaaaccccgtattgaagaaggcagcatgtcaagaaccacagtgttgaaatgactacatgctctgttataaacactaaaattttaaggtttatctttaatatctgctagcattatctggaatgctaaacagtactatagagaaaaaataaaagggaaggtggaagaaaaataacaagttagtcaaggttgttataaaatgtgacgatttagataaacttaacaaaattttacctctggtaaactaggatgttggcactataatacccaaaatgggatacataagaaaaaatgaatctactctgaaatgtaatgatgatcaggctaagcgtatgttagggtttagagggagcgcccctaaaatataagaaaaatatttgaaaataatactttgaaactatttttgacagctcaaagaagcagcagcttctttcttgaagcagcaaagtaatcatacgggggtaatcacaatgtttcttatgctcttatatgcactctacagtttggcattgtttatcaatttcattctttccagcgattagagcctctaaaaattcatgctagtttagaagtatgtctgtgtttaggtatctagagaacaggaagagagttcgatatgttgctcagcagagaaaccaattctaagagtatatggcacaggagtcaaacccttagaaagattgttagagccatgaattggtataggaccacaggagacaccatagaaaaataagagtagagtgtcatcaggctatagtcccatttacaaaaaggaaggctaattagcaaaactaaatatagtcaagagataggagaagaaacttaaagaaaggaattatcactagcaaatataatgagaatataccaacttggacttatccttactggaggcatcagggaaaccaaatgggttcattggccaaagtgggcagaaagatagctttgaaatgcatctgtcatggtttggatcatggtacaaaagcaagttaaacttatgtagatacatcattagtagataaaatctttatttatttatttatttattttttgagacggagtctcgctctcttgcccaggctggagtgcagtggcacgatctcagctcactgcaagctccgcctcccgggttcaggccatttcctgcctcagcctccctagtagctgggactacgggcgcccgccaccacgcccagctaattttttgttttttcttttcttttttttttttttttttttttgagaccggagtcttgctctgtcatccaggctggagtgtagtggcgcaatctcggatcactgcaagctccgcctcacgggttcaggccattctcctgcctcagtccccagaatagctgggactacaggtgcggccaccacgcccggctaattttttgtatttttagtggagacggggtttcaccgtgttagccgtgatggtctccatctcctgacctcgtgatccgcctgcctcggcctcccaaagtgccgggattacaggcatgagccaccgcgcccggcccataaatttttatatatttcaaccaaaattagaaaaacagaataataatagtgaaagaaccagaaagtgacaatcttcaccaaacgttcagtctcaaatggtatgggcaaaagcacaccatgcacacagaagaaagggcagactgagatgaatgtgggtcattagggttcaagaagtgttatggaaatgaagggagtaaagaaaagaagaacatcaatccaggatacaaaacccatggataacttcagacaatgcatttttacagctgtgaatattttaatatgatagctaagtaaagcaaacatattaaagaaagttgaagagaggagttacaaaagaagtattgtctagaggagtcagagggaaatataatttgatagagaaaagaagacaatggcattaataagcacttagtatatatgagaaagttgctagagaggatggtgggcagaggagaaggattctctgggttcaatatgaaatttctccacttataaattatttcaccttagggaagttattcatttttaatatgctcacaaataaacaggataataatttgttttcatattatttctttcagagggagtaaacagagatccttttaataattatgatgtgacaacaggtgcaaaacttagacaaactaaggtatctgatcaccatatttactaggcaaaatattgaggttaaaagaatttgtgctttgttttttcttttcagttttcaacgttctcatcccagtagataacaaaaggtctgtgacaagatgggacatagcaattctgtctctgtgatctgcccatcaggaaaagagctcttaataatccaggctaaccttttctgcagttaaatgtacccagtttcctccttcagtggtatgatcttagacatcagctttctttgagggaaatcttcatagagacattgagagaaatctttacaatctaaaattacataatggaataggtctgtggttatagttcagttttaactagggacatacaagtcataatgtcttaacttcaaatatcgaaaatccataagaatttaaggtatgagaactgaaggacagaaaaggcagtcttatttgtgctatgagatgttcttaaatccctcacataattgcaccaggaagtatactttctttcttcatttatctcttaaagctcggtcttaagacgaaggggctaaaggcctgagtttcaatttatatttgtttcataatagcagtgacccctcaagaaatggccactaaactgtgggaaacgatgaattcctacacagtaaaatagattattttcttaaaaatggcacaaggttttatgagaattacagcagaaacattgcttagcatcatgcatggcatgtactaaatattcagtctatgctacttaggtatccttgatgttataatatgaaattgtggatatttgtaaatatgcagtctcctaatacatagttgtaaaaatgtgtgaaggtgtccagtgagcaattaatagattcttaaataatattccattcttacccttcatgatttgtatggaagatttagagaatgaaacaaaactctgggatctgtaccttttaactgaaacaaccaccagaactaaatttacataaccatgataaataaatctctaaataagataagtatggataaactttgtaaactttctctttttaagatacaaacaacaataatagtgtgggttatttcttcataaatcatatacactcccagttatttgtgtcaaacttctctcttgtgcctgatggtttccaattcaaaacatggtaatatttttccagtattcaaaggaagttctgatttgtcagtacatagaacttaccatctccaggcatacgtattgatggaatgtaagttaacaattcaaatctttttttttttttacattgggtggtaatttggatttatgtttctttaaaactaagtcattggtgtcatgttcatttccctatagctaagattccatcatactgaaccagaaagaaatagtatgtgtgtacaaaaatgtaagaaatcagtactccaagctatataataggttgtcaaacattattctcataaaatatctatagacacattggccaatatttacttattttttatagtaatgtagaagcaatagtagttaaaaacagggactttggagccagaataatctgtattggctcccatctccatttcttatttgctttgttctctaacaagtctcaaaatttcttgtctcagttttctcagttttaaaatggggataattatacatatgctttacatagcatatttaaattactaattactgtagtaattaaatgttagcataactaaagtttatacctgtcgggtagtaaatattatgtggttgtactaaatagtaagctgtggttgtcaattctaatattcttaatagtacacacttcattgtgttctacagatattgattaaatataatttttgagaaatttaaattttgacttttctctaacatattaaaatattctaaaatatagaattgctgggttcatgagactatagaaaccatatgtgaaaataaagtaatatcagcatcctatagacatcttctagaatcatagaataaaaaaggttctttatctgttatttgtatttcattttattaagctaagaaagattaaggataaatactcttgaaaaatacataaaaataataaaaattaaaaataaataaaaaatacataaaaaatataaaaaatagaaacgtaaatctacattgccacccaatgtaaaaaaaaaaaagatttgaattgttaacttaaattccatcaatacatatgcctggagatggtaagttctaggtactaacaaatcagaacttcctttgaagagatttattaagagatttgatgaaagtgattttaaaaatgcaaacacagaattaatctcttgctctgactactgccctatctcctaatttgttgttctacttctgttcttgctcttacttattctatttttcccacagtagccagagcaatttttgtaaaacatgaaactgattatgtgactgttctgctaaaactcttcaaattcttccactgtgcttaaaatacaactaaattcctcacctttgtttacaaaactcatgtaatctgttccttgcctaatgctctcacttaaattcataccattctctttctcacttatttggcttcacccataactttctatttctggaacacatttatgttcatttccagcaaagacactttgtaattgccatttcctctgactggtaagcattggatctagattttagcaccattaccatattcttatgattcagatcttaactcagtgacgcctcttttcagaggactttcccaactaccaaatcaattgttgtttaaattccattcttatcacgaatacccttattaattgtcagtcacattactcttgtagcatattaacatgattgttctcagaaattatctgttcattcatctacctcttgattgcaagattgcaagctccttgagaccaaagattttgctggcattttccactggtacatttttcccacccagaacaatatttcctaaattacagtatcacaatacatatttgtgtaagcaatgaataaaaggacataaatcaaaagagaagcttgttgatatgctaatatgaagatgctgatgttcaaacagaattttatcagtaaatttggaataaaaagtgttggaaaagatattcaatggtaatggggtgagtggttgatatgtattgtacaacagcaactgagaaacattaagtgtgaatagaaatatcagcaaatgcaccattgaagtagtatcagtagtacacaaagccaattcatcatgaaatagtttacactctaactcttccataagtttcatatttggctctttctttagatcccctttgcccactttattttgggctatcatatttcttcctgttttctaattaggtgttgtctttatactgtgaatcttagtcttacttgaatcaatgattagtagaaatcactgttgtgactaacatgcttcttcacatatgtgtttaaaagtaccctaaaatcaattcatttaaagtgaaagcctgactgttttttaaaatatctttcaatactacttcattatcacattaaataggcaataaccttgcacctcattattttatattgggtcttggctaactgtggctcttggactaaatccagctggccagctgtttttgtaaacatgattttattgaatcacagccacacctatttatttattgtctatgactgctttcactctacaatgacaggatcattgcaacagagactgtacagccaacaaaacaaaaaaatatgtattatctgccctttatcagaaagcttccttgtccctactttaaaccactgttttacagagattaaaaactatataaaattcaaatcattttcttccatcagctttactgagtcatatctgtctctctccctttccatacaatataaagattacctttcaagatctcttattagcctttaaacattgaagacattggcaaacagacactactttgttttcactagtttcttaataaaactgttaattgacaagttaccttatttagcaggaagccaataaaccacagtgtaaatcagtagattacgctgctttaagcttttgaaaaaatgattagtctcactaaagggttgggcaattactgccactgctaactaattttgtacctggaaataaagatctgcaatttgttgcccatagctatagcacacagcctgttgacttagtacctatacagttataaactatggattctaagaaaatttaaatgtatgatgtttatttaagtatatatggttatgatgttatctaaagtacatttattatgaatttcttggtatataatcattcatgcagataggaggatctctcattttgcaataaaacttttaattttgacccacacaaggtaaagagatgctcttgaggtacctgcttctaaactacaggcgatgaatgtgtgtgtggactcattggtgaatcctcatatataaacaaagtagatgatatattcatgctaaaaggaatctgacttggagcgaaggcccttttctagaggcataagatttagtcatacaaaaacacttaaataattttaaaggcatcagactctctgtacagtagggattataaaagactgaaatttcccttttgtaatagggtttctggcctctctggccctccagaaatattaggtatagcttaaaatcagagaaaaataataccaattgccagagaatgctttgtccttcatgatgtcaatagctgtccctcactggttgctctgatctcttctttctgtcagcttctcttcacctatacacagacaactatgatttgcaggccagaaatgtaagagctatgcatattggtgccacattaaatccatggtcatcaccattaaatgagtccttaatatagcaagaccaccttgtttcattttttctgtaaactcctgtttccctcattactatcattgtgtaaaaactgtgtgtcaaatagagttattaacacccgcacagttggacatatgcgagttaactatggctttgtcacacaggaatggcatgatctggaaaaaatgggttaaactctccatctcttagttttttctcctgtaaaatgatgacaataatgtttataacatatacttgtgatagcattaatggtacatagcatatagttagtcctaataaaaatgatttattgtctccatcatgcctctctgactcctcctcctcctcattgtttttgaacatgtaacccatatgctactctttcacctgagaaattagaacaaatacaacaagattaaccctgcacctttctgtttctccttttatcatctttcaatggaggacttggcttctttctaagggccatttctctctgtcctctagtttagatgccttctaattgaatgctatttactgttcaactacttgttattttcttaacatttccttgtaatataaacactctctcattaaaagtcaattatggaaccaaagaacttctgttgcatatctccttttgcatggatggaccttttggtttcccttatctctttgggtttaggggtggtaagggattcccattgttgctaggcatgaggtatttcaacattctgttaaggtttcctcactctgttcacacttctgtaaatagttatttcattgaaatatcatattaaactctgtgtgtgctactgttctgtgccaggaccatgactgatacagatgcctatgatctttatggagtcagtagaagtgttagtctaagtttctgggttaatcatccaaactctattaatagcttattacatgccagatactgagaaatttgaacaattgataatgaatgctaacttaagactaataagatcaaacaatcagaccttatttcaagaaaaaagccctgctacttaccttaggaactaatttctcttcttttccaaaatatatgccatttcaaatgatcagtttaccctcgacactagaatattttctcttcatcattccatatttaaaaacatttatttaacataaaaagagcaagttaattacaatccttgtttccttggccacagttatagctatctcacagaggagaaaacacattttatatgaatggcacctatatttcttttcaccgagacacatttaacaacccatcttttaaagcacaaagaaaggagaaaaccttcagaaatatgtcttttcaaatgttgttaaacattgatttgtctgattattataacttgagatagtccttattgtagtaattgaatacttaaaatttaagaatttatgccatgttatatgttaattttatgcatccactttctatttctcctgttccagcctcccacatcctaggacatctgtgaagataacaaaattgcaaatgccagatggtagtatgatcattaaattaaaatcagttccactcttgtttcaatcatgaaacagaacgatcaaatttgtaaatgtttctattttggatattattttattttacatgaaaacaaagagatgtactttaaaaacattacattggtaaattacagtatttttttctctactaatcttattttgtaaggttctaaaatttggttgactaacacttgtgttctgcaaattagtttacctaaaaagaggaataaataataataaactttgaacaaaaaaaactaatataaaatactgttatatttcacataactaatggaaaaaaaattctgacaggctttcttgacacaaaaatattaggaataaattttgttccttgttgcagggtgaagtaaggaagatggttgaataagtaccaaaccctcctctgaaagggacaccaactcaacaatatgcaaaacattctcctttgtgagaaacccagagaccagccaagagactcctatagcccaagtgagtatcatgccagccacactgaagttgatgggaaaatttgtggcacccacttgccaaagccctgcccttagctcagaaatgtgcaatcagaaggaagatcctaactcctcacttctccctggggaggaaatagaagactggaacatatgtctaatgttcagatttggagggaactagctaagagactgatttcttccctatttgaatctaagtgctgacaggaaagggtgtcagataagaaaccagtggaaacagaggcagccctttgaactagcacacactcagttaccatcatctttctccccagctcagcataacagtttcacctgacttggcatactgacaggaatttgaatgctctagatgcttgaggatactgaaaacaaacataagagctccagaggacctacagtatagcagacagaagctgattcaacttgacagtttgtccctcagggggaaaagagaagaataaaaggtgtgtcaaatattctgactttcgggaggagctgcctgaaaaactggttgtttacttgctagtctcagagcactaaagggagctggcatactctaaatgcctgaggccaatgaggagaaaaagaaatgagtgacttacagtaacatcaaaggatcttcattagtggagacagacaccataagaaggaggaaatttcagcttctaaaaaaggaaaccagtaaaatctccctaattaggaatttacaaattcacagaaaacatttgagagacccgcaaaatatgtagctgggtcatttcaagaaaaactttccctgtttggagctggtccacaaatactgggagagggggctacttttcaaatgcatagatcccaacaaaaagtaacaaggcacatgaagaaactgttgtaaccaacagttgggcacatgagccaagcaaagtatcaaaaaactatctccagaaataagtcctaaagaaatggagatatatgaattactcaacaaaaaattcaaaattaaccattgtaaagatgctcaatgaatacagaaaataaatacataaaatgacaacatcaacaaagacagaaaattttcatgcgagtccatgtgaagagaccaccaaacaggctttgtgtggcaataaagctttttaatcacctgggtgcaggcgggctgagtccaaaaagagagtcagtgaagggagatggggtgtggccattttataggatttgggtgggtagtggaaaattacagtcaaagggggttgctctctggcagcaggggcaggggtcacaaggtgctcagtggggagcttctgagccaggagaaggaatttcacaaggtaatgtcatcagttaaggcaggaaccagccactttcacttcttttgtgattcttcagttgcttcaggctgtctggatgtatacgtgcaggtcacaggggatatgatggcttagctcggatcagaggcctgacattcctgtcttttatattaataagaaaaataaaacaaaatagtgttgaagtgttggagtggcgaaaattttgggaggtggtatggagagataatgggcgatgtttctcagggctgctgtcagtgggattggggcagcgtgggaacgtagagtgggagagattaagccgaaggaagattttgtggtaagaggcaatattgtggggttgttaaaagaagcatttgtcatatacaatgattggtgatggcctagatgtggttttgtatgaactgagaaactaaacagaagatacaagatctgaataagagaaagagaaaaacaggtatttaaggactaagaattgggaggacccaggacatacacttagagagtggccaagggggttcagcgtaagtttttgggctctatccttgtcagagttctcctttttaagttggaggctgagcttgatgaggcgtgtttttaaaagaccattagtccattctacgtttcctgaagattgaggacagtaaggtgcatgaaagttccactgaataccaagagcctgagaaactgcttgggtgatttgattaataaaggccggtctgttactggactgtatagaggtgggaagaccaaactgaggtattatgtcttacagaagggaagatataaccgcggtggccttttcagaccctgtgggaaaggcctctacccatacagtgaaagtgtctaactagaccaagaggcattttagtttcctgatatgagtaaagtcaatttgccagtcctgggcaggggcaaatccccaagcttgatgtgtagggaagggagggggtgcaaaactaataaaaataaacacacagaaattttgaaactaaagaataaaattatataattaaataattctctagaagaactcaaaagcaggcttaattgtgcagaagaaaaacagtgaacttttgaaatgacaagcaaaaagaaaaagaatgaagagtgaagaaagcctaaaagactgatgtgactccatcaagggaacaaatacacattatgagagttttagaaggggaagagttaaagaggtaaaactcttgttggaagaaataatggcagaaaacttcccaaattggggcaaggaaatgaacaaccacgttgaagaagtccagtggcataaactcaaagaagacaacaataagacacaatgtaatcacattgtcagaaataaaagacaaagagaggattttaaaagccagcacaatattgcagtgaggcgagatcacaccactgtattccagcctgagtgacagagcaagactccgtctcaaaaaaaaaaaaaaaaaaaaaaaaaaagcagcacaataaaagtgattcattatatacaagaaatcctccataaaactaacacaggattcctcagcagaaatattgaaggccagaaggactagaatgacatattcaaagtgctgaaataaataaaattgccaaccaagattactatatggaacaaatctgtccttcaaaaatgaaaaagaaataaagacatttccagattaacaaaagttgaggtagtttataattatacttgccttacaaaaaatactaaagggagtccttcaattgtaaacaaaagaatgctagatagcaacaaaaaaaacatattaaagtatacagcttggtagcaaaggtaaatatttaatgaatacagaatccttcaatactataatggtagcatatgaatcacttttagttctggtgtataatgaaagtattagtataaaaatacaactaaaataaatttatacacaatataagaaagtataattgtgacagtaacagaaagtgtatgtgtggaggaggaagtaaatatgtaaagttttttgtatgcaattgaaattatgtgttatcagcttaaaatagattgttataattataagacgttttatggaagccccatggtaactgcaaagaaaatatctataagagatatgcaaaagaaaataagaaagcaattaaacactgacagtataaaagtcaatgggaagaaaagactgcaagagaggaaaagaggaacaagaaaagctacaagatagacagaaaacaatgaataatatggcaataataagtctttatcaataaatattttaaatataaacaaattaaaatccccaataaaaagatacagagtagctaaacagattaagataaaaaccaaaaccatgatttaactataagcaccctacaagagactcactttagctttaaggatgcacataggttgaaaatgaaaggatgaaaaaaagatattatgtgtaagtggttagcaaaagaaggcagaggtagccatatttgtatcagacaaaatataatttaagtcaaaatctgtcataaaacaaaaataacatcttagaattataaaagggtgaagtcactaggaatgtataccaaatatatatgcacatagcacccaaatatgtaaagtaaaataggcagaactggagtgagatagagagtaacatgatgatagcaggaaatcccacactccccttttaattatggatagaaaaccagatagttgaccaataaggaataagagagcttgaacaacactatagtctgattgaacccaactgatacatagaatcagtctacacaaaaccagtagaataaacattcttctcaagtgtacatattcttctccaggtaagaatacattgtaggttgcaacacaatcttaagaaatttaaaacgattgaaatcacaccaagtatctttcttgcacacaactgaataaaaatagaaatcaatacaagaaggagaagtggaaaatttacaattatatgaaaactaacacactaccaatggatcaaagacaaaatcgagggaaattagaatatgtactgacacaaacaaaaatgaaaacctaacataccaaaatttatgagctgtagcaaaagcagcactaggaaagaacttcatcgtgataaacacctacattataaagaaaaggtatctcaaataaacaacctaactttataccataagaaactagaaaaagaagaacaaaataagcccaaagttagcagaaggaaggaattttaatgattagagcagaaacaaatagaaaatagaaaaacaattttaaaaatcaacaaaaataagaattggtttattgaaatatcaacaaaattgacaaaacctcagctagactaagacaaaaagagagagtattgaaataaaattataaattgagacattacaactgatgccacagaaattaagattataaaagagtattacaaaaattatacgtctacaaattgaataacgtcaaagaaatggatcaattcccagacacatacaacctactaagactaaatcatgaagaaatagaaagtgttaacaggcatatatctagtaagaaaattgaatcaataagcaaaaacctctcaacagaaataaagtctaggactagatggcttaactggtgaattctaccaaatatgtagagaggaattaatgtcaatctttttccacttgctaaaatattgaagaggagacaatacttccaacatcattttatgaggccagccttattctgagattaaagctagattaaaaacactagaaaaaaattgcataccaatattccagatgaatacagatgtaaaaatcctctgaaatttcctagcaaaccaaattcagtagtatcttaatagaatcatataccatgaccaagtgggatttctctcagggatgaagggactgttcaacataggaaaatctatccatatgatacaccacatttacagaattaagagtgaaaaccacctgatcaccttcatagatgtagaaaaaatttgacaaaactcagcactgattatgattaaaaaaattaaaaaaactagaaattgaaaaaaaaatctcaacacgatgaaggtaaaatatgtaaagcccatagctttatcacagtcattggtgaaaaaaaaaaaaaaaaaaaaaagaaagaaagcttttctggtaagatcagggataaggcaagaatgtgcactcttatcacttctattcaacatagtaccagaagtcctagctagagaaattaggcaagagaaagaaataaaaggcaaccaaatcagaaaggaagaaataaaatcaattatattcacataggatatgaccttacatgtagaaaacacaatagatctcatataaaaactgttagaactagtaaatgaattcggaaaatttccgggataaaaaatcaacatatagaatcagttgtgtttctacacgttaacaaagaacaattttgaaaaataagttaaaaacaataccatttacaatgacatcaaaaagaagaaaaaaatacttgggaattatcttaaccaagggaataaatgactataaaacattgatgaaagaaattaaaggagacacaaataaatggaaagatatcctgtataaatattggaagccttaatattattaaaatgtcattaccacccaaagtgatctatagggttgaggcaatcccatcaaaattccaatgccatttcatttttcagaaatagacaaaataatcctaaaattcataaagaaccacaaaggacccccaatagccagacagtctcatgcaataacaaagctagagggctaacttcaaaacatactacaaagctacagtaagcaaaataacatgatacaggcataaaggcagacatataaaccaatgaaacaagtttgagggtgcagaaataagcccatgcacatatagtcaactgatcttcaacaatacacaatgttgaaaggatagtatctgtgttagtccattgttgtgttgctgtaaaggaatagtggaggctgggtaatttataaagaaaagagttagttgccaaatggttctgcaggctgtacaagcatgtctccagcatttgcttctggtgagggattcaggaagcttataatcattgtgaagggaacgggagccagcatgtcacatgatgagagcgtgagcaaggggatgtggggtaccacgctcttttaaacaactagatctcgtgtgaactcagagtgagaactcactcattattgcaataatggccattaatgagggatctgcccccatgagccaaacattccccacgaagccctatctccaacactggggattacatttcaacatgagatctggaggggacaaacattaaaattatatcagtatcttcaataaaaggtgttgggaaaaattgaatttttttcacatgccaaagatattcagatgcaatagaataaaattgtattcttatctaacagcataaacataaattaactcaaaatagattaaagacttaactataagacatgaaactataaaattcccagaggaaaacatagtggaaagctttataatgttggtgcaggtcacgattttatgaatatgacacaaaaagcacaggaaacaaaagcaaaaacagacaagtgagactgtgtcaaactaaaatacttcaacacagcaaagtaaaaaatcaacagagtaaaaaggcaacctgtagaatagaaaacaatatttgcaaaccatatgtctaataaacaaacagcaatatccaaatatatgaggaacttgtaaaactcaatagaaaaaaagaaattatccaattataaatgggcaaaggacatgaaaatatacatctccaaaaaaaaaaaagacatacaaatgacccacatcttcatgaaaagatgctaaatctttttaaacaggaaaaaacagatcaaaaccacaatgaaatatcaagtcatccctcttatagatggccgacatcaaaacaaaacaaaacagaaaataatcagtaaggatgtgataataataatcctcagtaatcctcaataatcagagaggatgtgaatacattgaaacccatatcccctcttggtgttactgtaaaatcgtgctggggctataagaaatagtgtgaagatatctcaaaaattaaaaatagaactactatatgatctagaaattctactcctacatacttatctaaagtaactgaaagcaggatcttggagagatacttgcactttcatgctcactgcacctttattcacaaaaaccaagacatgaaaacataaatgtccactgacagatgaatgtttaaaaagttgcatatatgtgtatgtgtatgtgtgtgcatgtgtgtatgtaagtgtatgtataaaatagaatattattcagctttaaaaaagaaggaagtcctgtcatctgtaacaacataaatgacacttgaggacatcatgctaagtggaaaaagccaatcaccaggacagatactgcatgattccacttttatgagtcaccaaaaaatagtcaaactcatagaagcagaaagtagaatgttggttgccagagtccgaagaaatggggaaatgaggagttattgtctaataagtatagagtttcagtcatacaagatgaaaatgttttagaaaccttttctacaataaagtatatatagttaacaacactgtactgtataactaaaaaactgttaataagatatatttcatgttgtgtgagattttttcaccacaataaaaagtattccttgttatgacaaattaaaaacaagaaaatcactacagtatagtaaaggaaactgcatcctgaaatatttatgaattatttgagatcatgttgtaatctgttattaatctcaagtcgtacaatagcaatttgtttcttctaccaatttctcacaaagtgtggtctgcaatagccttcagtcagaataaaaactctggtatctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatccatactaatttcagatctagaaaattaagtaaaactattcaaagttccttaacaatatgaactagatttgaaagttccaaccactttcaacattacataagatcctgataatcatactatttgttttcaacctcagaaatagcaaaaaaatttaattttgaaaagcaaagaattgatggttttgaactttattaaaagcatcatcagcattttattcattctatagtaaagaaaataatataagaacttgaaagtctattaatgacagtaaagtaaactagtttattttgttttctaagattcaagaaaaatggatcacttctatggctaaactaatatcttgaaattcctttattatagacctaaaaatgtaaatatggtttaaagactgcaatttgtttaggttagccctgtgattgactctgatttatatgctgagttcaatttcagctttctattataaatgacctaataacaaatattctcacaattctcttccgacagaggagatgtggggattcctcaccatcagcaaagaagtgatcaattctgcagaaacaccagctgggctaactcaattcaattcaattcaattctcacactctacctcgatgtagcaactgagctacatctaactctattcaattctcacactctaccttgatgtagcaactgagccacaggttgaaggttcagtttcacgagattgcctcccactggccaccggtgatcattttaaccttcagccccaactcatccctagagccttggtctatctggcaaccaaatgtcatcatctatgggggccaacagctgtcagccaacttattagcatattagaagactttggagattctaaggattcaattcaattctctaactcaattcagttctcacactctacctcgtagcaaatgagccacaggttgaaggctcagtttcatgagattgcctcccattggccaccagtgatcattttaaccttcagccccaactcatccctagagccttggtctatctggcaaccaactgtcatcatctgtgggggctaacagctatcagccaactcattagcatatgaaaagactttggagattctaaggattttaggagttgtattccaggaaatggggtcaaagaccaaatgtatatttcataataccacactttgaagaaaaatttaagtgaaattaaatcaatatcaatatttcagtggaaagcttcagtgaggaagataatttaacaaaggaattaactttttgctttacgttaatgatcttcacgatatagcagagctgaattacaatggtaggctacaagcctttatttaaattttccccttagacatgaacaatgtgttttatgctagcagaagacatgagactcctgggccagagacaaaagaccttattacttatggcttaacaggcagcataaatatcattctcctgtcctctgaccaagacaattttaatgttcccctcagcttgagtaaatgctaaacagatttcttcttgattttaggcccctgacttccttcgccctttgagatgtaaagaatctttgagcctcttgctagttttatagctcacgtatatttgtcttaagaacttgagagccatccttctaaaaatctaatcattaagaaatatagtgcctctacctgtcaagctctgtgagagagtaggactctgactttggtaagtgccaatcagcaaacacagcctaatcacgttgacccctacctaacaaatagtcttcaatacttttccactaggctactccagcaattaaaaactctcctgccttttgtttcagtggtgttgagttcaatctctcccctactgcaatagtcttaaccacaattgcaatattgttgaataaagtttgcctccctgtttagctgtcaggtgcaatttttctttgaaattctgaagtctcttgggagcaatgaagagtggtccaggtagaagctgcagtaatagtttgtttatgtcactgctgagaaatacaagcataggaaactccagtttcatcagagggttgctagcaagtctgtccaatcttagctacggagtgggaagaaaacatggtatttattatcctgattaggagacaaatcttgtctctgacccaaaaggaaaccttatctgtatcttccaaggcttttagctatcctaacatatgtcataaataattttatatataagagttaatacttacataataaatgtttgttcatttggtatattataatttgaaaatattaaaatatagttatttcttgaaatacaaatatttttattattcaatcacatattagtttatttaatacagtgttcaacaaacatttttatagattgcctaatatatatcacatgctatgatcaagagctataagacacagtaaattcatgctctccgggagctccaatatagcagctaaataattttctagttgtgtaccacattcaaagaagtcagagccagagcacagagacaaatacagagtttcaagaggtgatgctaaatttatcagacaaggagaaggaaaggccatgtatatagtaaaaagaaagaaaagaaggtaaaatggctttaatatggagtatctgagggaacagtaaataccatatgagagtggctagaattacctggaaatataaacgcggtcatggcagaaaggaaagtttaggccactatcaataagttgggctttatttgtaaatgatgtggtgtcatttaagcattttatgcagaacagtactatgttcagatatggatcaaagagaggcaatgctctacactgagactgttattagaaactgtcatagtcttgaattaactacagggaatataaattcccaaaccttctttacccatggtgtattcatttcaaaaatatatttgatgtgtttttatcactcacgataaaaattgccaaattgtttctcaaaaatattttacagcagtattatatcttcattagaatttagttttaatgtcagcacatctgatgaaaaatagtctaaagtcaaaattatccttgtcagtttctgataaaggtgccattttgaagatccacaatctgtctttcaaagtactaggttactccagcaatgaaaaactatcctgccttttgtttcagtggtgttgagttcaatctttcccctattgcaatagtcttaactactattgcaataatgttgaatacagtttgcttgcctgtttaactgtcaggtgcaaattatccttgtcagtttctgataaaggtgccattttgaagatccacaatctgtctttcaaaataacaacactacttttttctccatggtaaaacagtttacaattcctccatggaaatatcagatgaagtagtggcttgtatttagggtccatgttttattaagataagtactctgtttttaaaaactagcagcacattcagtgcttactgaagctcacagtatcagggacatgagttggaactgacaaggattgagagagcagcagattcatattttcttccacaacccactgggtctaggacatatactcagcagaatggcaggcaacatttccaacagtatctgaatgtatccactccctctctcaaccatgtataattaaagccaagtaatttaaatagaaccagtgcaaatggactatactgtgtttttatttcattttctttgcaataatgctaattttggaccaaagttttaggcaaagggtatcatcactgttaaaaggggaaaaagctggttttccttttggtttctgtttattctttagtggattgtagattaatattcattgccttagaatttattaaagtcatgatacttgccaatcaatttttgtataagcaatttgtttggtggagatgtaacatgataacaataaggactgatttattgtcttcaaattctgataaaaccaggattgaaaacaataggagacaaacattctgctatgttacagaagggtgcgagacacagtcatgcaggatttagttaaaaatagcaaatcctcttatctccccaagctctacaagaaaataataacattttaatggattatttgaagggaattaataggctataaagaaagctgtggcacttcctctgtcagatggtgggagggggtccttttcctaaagccaaacgtgggagcacgttcaaaagaatgtagagaggacacccgccagcaccttctttctcaaacaatgtttgctgagctgcagaaatgtatagacgctatatggtacagaaatgaagtgttgtgtgagagtttttgatacacgtttgtgtgtgttctagagaatttggtaatatacatgaacctaggggctgttttccactggagaagtttaaaagcagcagcagtctgttttgagatacttcccatggtaaggtgaggagagaagggtcagcagttaaacatgtgtccttttttttccaccttttattttaggtttaaggggtacatggttaggtttattacatgggtacatcgtgtgtcacggggttttggtgttcagattatttcatcacccaagtaataagcatagatatgataagtagtttttcgttgttgttgttttctcttcttttgtttttcttttgtcttcaacctcctcccacctcccatcctccaccctcaagtgggccccggtgtctgttgttcccctctttgtgtccataggtactcaatgtttaactccaacttatgaatgaaaacaggcagcctaaagatgtatagggcttctatggcctgaggagatgatgcggataatgggctggctcctgttatttttatgtagtccaacctataatagggttagagtgagggtaataagatatggaaggaatgttttcacatgggtcactctataagggcatagcctatactagacaggtgagtagggacaaagtccctgtagcacttccaaaaaacagcaagcctgatatatgaagaagaacctcaatttgaatgatggacacatagagacgtcaatggccatatttcagcagcattttttctctaattcctttgctcacttcctctattgtttcttaaacctagaatcaagaatcaagtctgtgctgggaagaaagaagctacgactacgacatcaaattgaagttttgtttatataaactagacattttaatgtctgaatgtgtcagaattaccataataaaatttttcttttaattgaaattgattggaaagccaatagatagacttaaggttcagcaaaaagaatttactagagtataattgaaggcaaggtctggagaaaagtaaagtattttcctatttatatcacatagagttcaaccttcattccctgttcaatataccagctgcaagagtattaatcatttggcatatttgccttaatattctctttttgttgttttaacctctttttatttccattacagcgaaatgtgtgtttccatgcatatgtgagagaagacagttaatatgtccaaatttcatattttcctttgtaatctatatcttttatgtactgaatgagtcattcacattctagaaggtacaacaatgttgcaatatattctcattaaaattctaatgccttcaatcctcaaattaatattctaaacattaaattcatataaaatatatttgatcactgttctaaggtaagtacagaagaccatatggtgtgcttcccagatctccgttcaagactgaaaaacttattcccccatctactggaagtgcattgcgagattatttcgagctcttcctcaacttcaggaattgttctacctgaagaatgttgccttgattaagatcatgttcttcccagtgtcaccctacatctaatgatagccagatgcaggtataaaacaaacaaacagactgaaaacctaatcctttcttttctacttaagataacctgaagggacatctctagaggtctttatttagactgtatcagagcccattttctctggcgttcttcccggctcttccccagaagacaatgctaagagcccttaattgatactgatgtctacctctgcatcttgaaaaatctaatatgggacagaaaagactgaaatcagtcctcctccaaggtcagaagccatttattacaatgccattttttagtaattattattttctttctggtgctccaatggctccttgatcatacagtaaggaggcctatgtagtggagtcgacgcgattatgtggttatgcacgtgtatgcttctgtgcttgtgctagcacacacacaaacacatacgaatacataaacacacatatataacatatgctcacacataaatggggagaacaggaggattcatatgtttgttaaacaaactacaaaatgaaagataaatacaaatgaacttttaaaatatcactttaaggaattcttatttatcccttgggtaatgggttgtttttaaagcaagaaagtattattatctgaattttttcctaaaaggcaaatagtagccatgtgttgtatacataaacaggaccaatgcaaaggtcattataacacatgaggtgagagatgatgaatacctgaagctgggtattgacactggtaaaagttaagaggtactcattggaagctagaattgatggggcttggtgacaacatgaaaaattgaaagggagctttttttttaatgttataggctatttaaatcgattttattagaacacaaaaatgttatttttaatttaaagtattagaagtataattattctatagaaataaaaggcataatatattctttagtcacacatttatacctagactagtttcacgcatgagtgataaaggatgcattagccatattactgttcttcttgtgtttttgaaaccaagaaatattcagatttaagtttatacatctttaaagcataaaaaatgcaactgaataatttatgagcagtagcactgagactacttaaaaagaatacagcagtatttgaaaaattacatactaaaaatgcaaggttatatatgcaagaaaaaagacaaactcaagacaatatttcaggatctataaacataacagtccagttggaaatttccagctttaaatatgacatatgctgatgtgaatgacaatagaaaaaatctgaataatttagggacatatcaaggtcaaataactccctacttttccgccttttgtaataaattaccacctcacttttccagcagtaaaccaacctctaagtagaaagattctaaacataaacagataaagattatgtgggatgccctctctcaccactcctattcaacatagtttggaagttctggccaggacaatcaggcaagagaaggaaataaagggcattcaattaggaaaagaggaagtcaaattgtccctgtttgcagacgacatgattatatatctagaaaaccccatcgtctcagcccaaaacctccttaagctgataggcaacttcagcaaagtctcaggatacaaaatcaatgtgcaaaaatcacaagcattcttatacaccaataacagacaaacgcagagccaaatcatgagtgaactcccattcacaattgcttcaaagagaataaaatacctaggaatccaacttacaagggatgtgaaggacctcttcaaggagaactacaaaccactgctagatgaaataaaagaggatacaaacaaatggaagaacattccatgctcatgagtaggaagaatcaatatcgtgaaaatggccatatggcccaaggtaatttatagatccaatgcctccccatcaatctaccaatgactttcttcacagaattggaaaaaaaatactttaaagttcatatggaaccaaaaatgagcccacattgccaaatcaatcctaagccaaaagaacaaagctggaggcatcacactacctgacttcaaactatactacaaggctacagtaaccaaaacagcatggtactggtaccaaaacagagatatagactaatggaacagaacagaggcctcagaaataatgctgcatatctacaaccatctgatctttgacaaggctgacaaaaacaagaaatgggaaaaggattccctatttaataaatggtgctgggaaaactggctggccatatgtagaaagctgaaactggatcccttccttacaccttatacaaaaattaattcaagatggattaaagacctaaatgttagacctaaaaccataaaaaccctagaagaaaacctaggcaataccattcaggacataggcatggggaaggacaccaaaagcgatggcaacaaaagccaaaattgacaaatgggatcgaagtaaactaaacctacagaatgggagaaaatttttgcaaactactcatctgaaaaagggataatatccagaatctacaatgaactgaaacaaatttacaagaaaaaaacaaacaaccccatcaacaagtgggcaaaggatatgaacagacacttctcaaaagaagacatttaagcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcaatgtggcgattcctcagggatctagaactagaaataccatttgacccagccatcccattactgggtatatacccaaaggattataaatcttgctgctataaagacacatgtgcatgtatgtttattgtggcactgttcacaatagcaaagacttggaaccaacccaaacgtccaacaatgatagactggattaagaaaatgtggtacatattcaccatggaatactatgcagccataaaaaaggatgaattcatgtcccttgtagggacatggatgaagctggaaaccatcattctcagcaaactatcgcaaggacaaaaaaccaaacaccgcatgttctcactcataggtgggaattgaacaatgagaacacatggacacaagaaggggaacatcacacactggggcctgttgtggagtgggggtaggggggagggatagcatttggagatatacctaatgttaaatgacgatttactgggtgcagcacaccaacatggcacatgtatacgtatgtaactaacctgcacgttgtgcacatgtaccctaaaacttaaagtataataaaaaaaattatgtgtaaaaattaagataaattgaaaagtagaaaaaattatcctatattattttgagttgctgtgatatatatgaatatagatatgtttaataataacataagtattttactgcttcatcctgttttcaactttatatgatcttcctttagaaaatctacttttttatatatactttaagttctgggatacatgtgcagaatgtgcagatttgttacataggtatacatgtgccatggtggtttgctgcacccctcaacccaacatcgccagatattgtgggatctggccagcagccctcaatgcaatggggatctctctttgttcccagacagatcggcaggtcgagaaataacagacacacacaagatagtgaaagctgggtccaggggggtcaccgcattctggtcccgcagtaccaacaatgcactggatataccagcatttattactaagtttagtgagggcgcgggtaggttagtgagggatttagggtcatttcattatgaggtgagatggtcacatggggatgaagtaattctttaacataacatctgtatgcagaagtacagtatacagaggtaagaatttacaatatagtgtgtgcatcagtaatttctaacagagccttaaaacagaaacagtctttctataacctatgattagcaagatattaatcagcagtaacagttgcagcaaaagctggttacaaacaatccatagaagcaggacgtgaagctagacaaccagttagaccagaaattctcagaagggagtatgccttaaccctaaacagacctagaagacccgtggcaagatgagggcgtttatagccctatcttatccatatggacaggtgcccctcatgcgtccgtttataaactctccacaagggtcgcattccattcccagagctatgaacatctgcttttctgggataggaatcttggtgatgtgaaacctccctgactgcacgtccattcataggctctctgcaggcggaagcacatcacgcgctgttggctcattctggcagtccaacctggcattgtcttaacacaatcctgcatgcaattttgtatttacaataatcaggagcatttcatcttttattccgtagcaatagtttcacggggtctgcctacatcaacccatcatccacattaggtatttctcctaatgctatccctcctctagccccccagcccacaacaggcccccaagtgtgtgaggttcccctccctgtgtccatgtgttctcattgttcagctctcacttatgagtgagaacatgtggtgttcggttttctgttcttgtgttagtttgctgagaatgatgctttccagcttcaaccatgtccccacaaagaacatgaactcatccttttttatggctgcacagtattccatggtgtatatgtgccacattttttaaatccagtctatcattgatgggcatttgggttggttccaagtctttgctattgtgaatagtgctacaataaacatacatgtgcatgtgtctttatagtaaaatgatttataatcctttgggtatatcctagtaatgggatcactgggtcaaatggtacttctggttctagatccttgagaaatcgccattctgccttccacaatggttgaactaatttacactgccgccaacagtgtaaaagtgttcctatttctccacattctctccagcacctgttgcttcctgactttttaatgatcaccattctaactggtgtaagatggtacctcattgcggttttgatttgcctttaactaatgaccagtgatgatgagctttttttcatacaattgttggccgcataaatatcttcttttgagaagtgtctgttcatatcctttgcctactttttgatagggttgtttgtttttttactgtaaatttgtttaagtcctttgtagattctggatattagccctttgtcagatggatagattgcaaaaatattctcccattctgtaggctgcctgttcactctgatgatactttcttttgttgtgcagacaatctttagtttaatttgatcccatttgtcaattttggcttttgttgccattgcttttagtgttttcgtcatgaagtctttgcccatgcctatgtcctgaatggtattgcctaggttttcttctagggctttagggttttaggtcttacatttaagtttttaatccatcttgagttaatttttgtataaagtgtaaggatggggtccattttcagctttccacatatggctagccaattttcccaacaccatttattaaatagggaacccttttcccatttcttgtttttgtcaggtttgcctaagatcagatggttatagatgtgtggtgtttctgaggcctccgttaagttccattggtctatatatctgttttggcaccagtacaagttacctcacttgtatgtttattgcagcacttctcacaataggagatatgaaatacacttaagagtccatcagtggattattggataaagaaaatttgtacacataaacacagaccatgcaatactactcaggaataaaaaagaataaaattatgtcttttaggtggaactggaggccattataccaagtgacaaagtcagagacagaaagtcaaatattgcatattttcacttgtaagtaagaactaaataatgttaacagtgaacatagagcgtggaataataggcataggagacttggaaagtggggaggtgacgaatgagaaattaccaacgggtacaaagtacagtatttgggtgatgtttacactgaaggagtgaacttcaccactgtgcaatatagccatataataataccacacttgtgctccctaaaactataaaaataaaattaaaaagaagcagaatatgaaaaaattgacataattcatagaaaacactaaatattaatttgaggtacttagtttattaaaagaagatcttttcatacttgtttcctggtaatgaaaaaagtggatatacatttttccttgtgatattataattgtaaaagatgtcactacaatgataaatataaatggaaagtataattttccaattaatcatttataagaattgttttccataaggaactacaaagggactaaaacatataatttttttggttctaacacgacatgtagtatttataaacatgtagaactatccagttctggagaaagaaagtcattctttaaaatatgttttcaaattgctacaattttaaaaaaaggtggaaagacaattttcaatactttgcattatattttgtttgaaagatatactctaggctaattttcaactcatagagaaggtttatattttactttttagaattttggaaataataactgcaccattacattgtaagtttttgatcccttctttcatatggtcttggctcctgagatacctagatgctcagacatctattaagcaaataaataaataaataccatacacttcaaggtgagacaaagctttgtaaaatggtcttcataagtagcactacacaagaaaataatataaagcattctatcaaatttcccaataataacaagaagtcaaatagatttcatcgcttccttcctttcttcctattttccttccttctctttcttttcttctctctccagccttacttctgttttattttttccctctttcctccctttttcctctctcttttctcccatttttctccttatgtattctacaatgaatttatgctgcataattttacagttcatatagcttgtaactttgtaaaaatgaagaaaacatgtaggagagctctgatagagacacagccctcaaaagcaaacaatcttcttttttcctttcttttttttttttttttttttaagtcttgggccatagttacaacaaaactgtaccagtggtggtttataaaatgcaagagaaagaaagatgtttggcattttagggacacatttgctagtaccatcctgatttttaacatgaggttacaaaaaaaacctattttacaataaaacctgcagaagtcactagtctgatatttaatattagagaagtattaagatttggaaaattatagaatttcaagtataaagataatgacagagaaaattaggaaaggataataggaggagtaagaacttgcttttatgcatctgagtttagaaaatccatctgaatttttttaaaaagacatgaagtaaacgcaatgagatatggaagatcctatgtgtcttgtgaaataatggctcataagacactgaggaaatggtcaatagacaaatctaagcacccatctcagcttgcacagtacattgctggtttctatgggttgtcctagacctttgttttcattttaattgctttagtgtttactacttttaagaatgtcctgattttgatgctatagtcacctgatgaatacagaacccccacaaggaggatgaagaaagtagataatatctaagatcaataaaaagactgaaacttttgttctataactgaacatgattgtttaaaaattatgtataataacaaaattagccaggcgtggtggcacatgcctgtctgtaatcccagctacgctactcaggaggctgaggcaggagaattgcttgaacctgggaagcagaggttgtggtgagccaagattgtgccattgcactccaggctgggcaacaagagcaaaactctatctcaaaaaaaataaaaaataaaaaaatatatatatatgtataataaaacatatgcactctgtgtaaactagtatgtaaatatttttaaatttagtaacttatggagtttaatcatattgccatttgattcttcatattttttttttgtctcttgaagttgtgatgcaatttaatatttttggtgattgttaaaagaaacttcttcaggtatatttttaaaaagacaaatatttgcatttaaactaaattactccttcttgattataatttctaagcagagatcgcccttgtgtaatcagtagtatagaagaggctcaggtaactaaaactataaatatagttaacagtgtactttctggggtcagcctgcctgacttggaatcccagacccaacactgactggttatttcaccttctgcaaattgatgcacttgtgcaaaatgatgttaactagcaacgaggtaaaccattggcttgttgtagatttaaaaaaaaaaaaaaaactttgtaaaacccttagccatttatatttgtccatagtttgctctgctatgttagattgggaagacaaaggaaaaatgttcattttcttccttcaaagtgtttaataatctcaagaaaagacagtattgcgtaagaaaaattattaataaaatataaaatttgatataatgactaagagagaaaattccttaatctccctgataaagtcataaaaattttcaaaatgaaggagaatttgaggtgagaccagaaagcttaggaagagttgaaagagagcaaaggcaataatttgtgaaaaatatacattttacaagaaaactacatatcattcagtgatactgaaatataatatgcaagggcaaattaggtgtccatgtacatagaaataagtgttcatttagtttcttaaatgattaggcaccactgagaaattttcaacagcgagttatgtgtggaatattttaaaaatatcaacctctgggaaaagttaaatatagattgcaaaattagaagagacatggtatttatcacccttgtttggcaagattatgacaaataatattacagtaggattaataatatttcccgaaactctcagaaggtatatggctagtgaagagtagaattaaaacacaattctgttattaaactgcaggtgttctgagaaattctactgcatttattgaattttaatttgatatatacctcagatccaatgtaatcttttgatttttcttcatatatcatgtgataaaagagttttcagtgggaaaataggagaatggtagaagtcagtgaaggaaaaagagagaggaagttgggtcacagccatattaagctgatgcctattaaatatcaaggagtcaatcattgttatttttttttttactttgcctaccttagcaatgttatatctatatgtaactatttctacaataacattttataaatacatgcacatacaggtaatatggctctgtcaaaaagttgatttttttgttgacttttatagaaaactatctttatagtcaagtatgaagctatataaacatagttatataattacaaagtagcaatttggctattctatatcctgtgaatattcaaacacatacagaaacatacatggttctgtatttatagtgttaagaaatgacaagttaactgcaacttgagcattttactcaaatttggtctaaaataattattctaaagccgtatgaaatcccagaattcagctgggattagagggaatgatctagcttgttttggcaggagaatatataaaaggtaatataataggtctctttcctactcagcaatcctataaaacaaaacaaaagttcctctgcctgcagtagtgtatactgagatgaaagttaaagattctgttgtattcttcaaaacgactgatcttggttcctgagccagtatgcctgttctgattaaacattttctggcaaattctcagagatatatttaaaaatgtcatactcctggttaaaaaaaatctgtattatttatctaaacatctttatttactttaccatatttggttaaaaatgtaaactgattctaaaatacaattcgttgttttcaaattatattacctaaatatgctataagaatattagacaacttttgaagttagtaacttcgagctgattttaatcatttattttgagagtaaactatttgtacatttattcattttgtgtggttgttcttaacggtagtcttgattttcttagttgctatcattattacaaacctctttctctgtttttgataagctagattattaaatgaaggaaaattaatggaaaatataggggaagctaagatatggaaacctcttcaaattctcaattatataacaatacataaaagtatcgtataaattatctcactggtaaggtaaggcggtacttgagtcttgcacatcctaaaaatgaaatgctattttaataatgataaataattcaaagatcacttaagccattgtaaataaaatattaaactttgaaatgtattttatgcactgcttaaataaattgacaaaaatatttctaaagaaaatttaaaaatcatccagagtacttagagtgtagaattcttaatctatattgtttcttctgctaaaggtaagagctatcgaatagcatatgtcttcacttttaaaatacaccatattgaattctgtaagcttagtctggtttttgttaggataccaaaggcatgaaaagattcgatagttaaaaaattcaaactgcagccagattacatatattctgaggcatgtatatctcacatatatgtttttgtgtgtttgtgtgtgtgtgtacacatatacatataatgataattcactttggataaaaaggtatgttttgtctcttagttttaaaattattataattaacagtctaataattaaaatgatatagattaaaaagtcaattctcagtgtatatcataacgaatagctacttcatcatgtatactttagacattttaaaactattcttcacaagctaatgtgaaattcatgttaagtgcatattcacatcaaagtcacttttacattaagtgtttactgcaggcatgctttacaatgtccacatgatcatcaaggcttgagtgaccatttgaggtttcatcttgcattctatttgtgcaggtagtctttcagtagatctgacattgatcatctgtcaatttgattttctaatcttatgagactcattgtaaacaaaataactaaatgtatgcaggcccacagagaaaacacaacagctctgcattttatttctgacagaagcattcttttcaatcaagcttaaaaatagaagaaaataacagtatgttttcactttatgaattcttaccaaacgattgggtccgaggcatttagaatttaaaaacaactaatctaaatagaaagagcctggcttgtgaagttttaaaattagacgatggaaccaataacgagcatatgttaatgaagacatgaaatcatcacggcattacatctatcttagtcagagcctgtcagtatgcccattgcctaataaattgtatccctagtcacagtttataagacacaagaagacattttcagaacctacaaatgaagccaatatgtgacatttcaaaactgctgtactaccacaattagtggaaaatatacaaagtaacaaatacgacatttatttcacaaagagtggcttaaagacttgcctagctcatcagcttcctatgaaacattgtcaggtaatatttatgtgtgtcagggtgggagggagacggatatggtttaggtcagacgctgggggaaggaatgtattatttcaaatacggtatctgggaaatacttatttgtctgacaaaggtgcatcattatacataaagaatagttgccttcctaagcactgacacaaataaatatttatcttccgtacatagatgacttgcattaaaatttgtaaattttttattgcttaattgagaagcataatctctgaatattaatagacaacatggagagttaatgaagtttttgtcataatgcagtacatttctccaacattctctaataaaagtatttgtagctaactcaaaatactggtgggtcctatataattaatgcatcgattaaatatgaactacaggttatatcaataatataagactttttcttgaattataaatcaaaaagagataagagctgatgaaaactatccacatttacttttaggatgctaaaaaaatgaagaatgcatctagaaattgtattctatgtaactcagatggattctatctaactcagatgttatatcacatcttcctctgagtgttctcccacagctgtggtgtgcactactgttttttgtgaatttcaaggcaccttctggtttctattacatgaattgctaaaacatttaccatgctgcaggtgtctatacatgttatcctttgacttcctcatatacctttccttactaaaattctacaactttgcatcagcacagtgtttgctagttaattcttgaagttttttctaaaattccccacagaaaccattaaacatggattgtttcaccataagaaaaactaaagaatcaatcttcctgatattattcaaaacagattactttttcctacaattacttttctaaactgatacaacataatgtgtatttcttcaaactagtcaataagtagaacaaaatcaccagttttcacatttgattcagcacgagctttatttgctattcatgaattggatttacttcctatataaatatttctcccaatctttcttaccatttggtcaatgttaacaatggcacttgattcttgccaagtgaaaataattttaatttattatcttctacttgcatacgtattcgttttagatcacgtctatatttctgttttattatttttactatggctagatatgatattttggatgcttatttgtgcttataatgaagttgaagtttcacataattttattcctctttacaagtatttttatcaaaattatgaaaccctattttacatataattgaaaattgaaactaattatgaatttcccttacttaataaatatttgtcaaattttgctcaatattatggttcatactgggcaatggtaattacaaaacaaaaaaaaaagaacgatgcagaccttgctttgaacaagttcacaatgtggtagggaaaccaataagccaacagatgtaagtagtagtcatgtacccaatttcacagaaaaagtctgacatgaacatgtatagtagctgcagaataacctggtgtgtgtaatctattcatcctaaggcaaggagatttttaactgatggggtacttatcagcaaacagtcgagagagaagacatgaacattcttctgtaaaatgacaggaagcccaagtgctggaatgactggacaaaggaggtgaatggtgaaatatggaaagggacagtcctaatcaaagtcttattaatgaaggccatgaaccaaccaagctgagtttggattattcccttaaaactatattaaaacaggccgggcgcggtggctcacgcctgtaatcccagcactttgggaggccgaggcgggcgaatcatgaggtcaggagatcgagaccatcctggctaacatggtgaaaccctgtctctactaaaaatacaaaaaaattagccgggcgtggtggcgggcgcctgtagtcccagctagtcgggaggctgaggcaggagaatggcgtgaacccgggaggcagagcttgcagtgagcggagatcgtgccactgcactccaggctgggtgacagagcgagactccgtctcaaaaaaaaaaaaaaaaaaaaaaaaactatattaaaacatcacaaggatttatgaaagggagttaaataatcacattttgacttttggagagatcatagctgctcacaagactggaccctgggagaccaattaggaaaccatggcaataatccaagtgagagacaatcagaacttcaactaagaccgtgacagtgacatggaaaaaagagggaagcattttaatgatagatattaggaaacagagtctgcaagagcttttgacaattgggaaacagaaaagcccaggaatcaagtaggctacaccagaaatatccaaaggccaaatggggatactgtggctacatatatgttaaatattctatgttacactttaattattttaacttttaaaacttttaatttgtatggtagtattgatctaaatgtttttctttatcctacttctttaatattttaaattaaacctctggtgcgtaatattgagctataatatttactatattcattaagcctcaggcatacttttttacatttgccgtgtcagaaattggaatgcaccttatatttcttcttactgttaacatattaccagcaacacaaagcccatttcatgtttgggttttcccttatttcttaatccccatcccatctgcttcctttcacaggaaaccatttgtaatgtgtttgccgtacgttcttcagcatagatatagtcttgtaaaatatagtgtgggttttgtgtattttcagttccattaagggttttgtaaatcccatctctgtcctactttactcatccagccttgtttggggaccaatctatgtcacatatctggtttattgtttcatattgctatacagcatctcatagtgtgatttactgtattttattaatccattcttctggagatggatacacaggttgctttcaactccctaatgccatatacaccatccttgtatagatctttgcaataatttctcaggagtatatatccaggagaggaatacttgcctgtactttttaaatatatttcttcctcaaagagtattggaaaatttatttgactatgaatataaaaatatttaaaattattctcccattattgaataaatgggattgtggcaacaggctacctatgtgcataaaataacacgaatgtctattttactccttatgccaaaataaatcacagatggataagtattcaaacactaagaagaaatgaagtcatattaatactgggagaaataacatgggaaaattgaaaataaatctgtccatttttctaggttccctattatcatcctccttcacgcttgttcatctctctgcagtcaagtctcctcacacaactgccagatgattattttaaaacaactgaccaataatactcttgcactgttataaaaatctcagtttaaacattaacttgcactgcaatgcttcctgactacccagtctaaaataccctcccaggcaatgtcttctcaccctatttgaattatctggatagcttttattatttattattttcttccttatttatttcttgattttttttctcacacctctccagaaataaaagcttaacaaaattcacaatctttgttgtctaatttgtcactgttttctcaggacctagaatgtgcagggaatattaacagtgcatttgttgcataaataaataaaagggcatatacatatatatagagagagttttttggaacaggaagctttgtaatatcacagtttagaaatatttcataaggcattgagttgcattcttttaatacttgaacatatttctctgacttcagtgcaaacccacaaaggtagtatcggacatttaaccatcaagctgaagccaaacttatatttaacgagctaatatcaacatgttgtgccctatggggtaatgactgacatgtgcttaacaaatcgtcaccaccacagggtagggagatgattaggatcagttttctgccctaccatatcctcaatggctctcagttatttcttccgtgttttggagagaatatttctctactttgtttctttgactattttctttcaaaaataaaagaatctttttttctcattacattttatttgtaattgctgaagctacttaattttacattaattttcaatgtttcaaaataagttgtagtttatgaacaacaaaaaagctcactaagcttaatgacagtatttacactaatttgatgattggcttacttattttctgtaataaccaagaaaacagattagcttataaagcatataaggtggccaggtgcggtggctcatgccttgtaattccagcattttgggggacccaggtgagtaaattacttgaggtcaggattttgagaccagcctagccaacacggtgaaagcttgtctctactaaaaatacaaaaattagccaggcgtggtagcacttgcctgtattcccaactaattgggatgcagaggcaggagaatcgcttgaccctgggaggtggtggttgcagtgagaagagacagcaccagggcattcctgcctgggtgacagagtgagactccacgtcaaaaaataaataaataataaataaataaataataaaataaaatatataaggcagtgtataaatacatagatacatatgtgtgtgtgtgggtgtttgtgtgtgcctgtgtgtgcgtgtgtgcataatgatgattaattttatgtgtcaacttggctaggccatggtgccatagtatccactttttggtcaaacatcagtttagatgttgctatgaaggtaattttttagatgttattaacatttaaatcaggagacttagagtaaagaaaagtgccttccacaatgtgagtgagcttcatccaataactttaaggcttttagagaaaagactgaggtcctctaaaaagaaaagcattcagcctctaaactgccttccaattagagctgcagcattaacccttccctagatcttcagcagctggccatgcaaatatcagacatgccaacctgcacaatcccatgaaccaattccttaaagtgcctctctctctctgtctctcctctatctctctctctctatatatatactgttactctctctatatatatgtattgttactctggagaattctgactaatgcatgcacatatacaggcagatagatacataaaccataaacagatacatagaaagatacatggatagatagatatataataagaaaatatgtgagcaataattctttttttataaatttaactatgttagttgctaatttccagacttatatcctaaaatgtaaataatacattgaataaaccactttaatggttgcatattaacttataaaatagatttttgctaatattacatttttattgagaatatattcctatcaaaaatttgaatgagcaaagtgcattggttccatgtgtatttattttctacatataaaaattgaatttatatttatatttaaaaatattaaaattatctattatctatatttacattgaagttacaactctatgaatgataaattaatactttggaagtaatgaaagaaagctcctagaagaaatctgatattttgaactaacaatgtgagaaattcacattatctcaattaaagtattttattgatatttgggacatctaatgaccttctctccaagaccttgaggacagaaaaatgaattgtttctgaaaattaactgtaaattcattatgtaatggattggcatggtgctacaaagtcacttcaaagatgctgtccaagactgtcagatctggctgtaatctgttaaacacagtattaacatgtctggagaacgactgagcgaattgaaagtgggggtcgctgagaaggaaggtgaaaagaagagccatggaagcaatattaggcagagtcttcaagcagattctaaggaggagtaaacgctgatataaaaaactccactggaacaagcccagtattaaatatgccaccactgtgcatgtggatgctttgaactttctttgtgtaataaagcatgcaaatcacataactcataatccttaatatgtattgagttctcagctcacaaatacagtgcatagcacattacatacaatagtttatgtaagcttcaactcaactagatgagatgtgtactattgtctccatttcataaaaattatctccattttatgaaaattcacttgctaaaaactgcaaagttaatgagtaacagactaatagtcttaaaccactgtgtctgacttcagagcccatgctcgattactctgctaagctaatattttccagattcagattctaaattcaacaagttcagttacaattataattcaggtttacatttacttgttcaaagaaagaatgtgtgcttgatggagagtatatctcttcagactttgatgtggttctatttcttgtcacaaaataatagactgttatacatttataacttaatattcggttatatttgatttctcagtagctttcccaaatagataaaatataataactcaagaatagacaccttctattcatcagaaattttagttagcaccatgaatttagtaaatactattttgatcattagaaaatgcacttggtgaaaataagcataacactgaaagtaaaatgcaccaaaccttacacagcagtgatgcactcactctctgagttctcttggggcaaaacccagaatatgacctgaggcacattttctaatctttgtttcttccagttcattcaaagttgaaaattgttttcatctttattcagcattattttccagggttatcttctgaagtgttagttttattatatttaaaaatagaatttcctctgggaacacatggttttcttaaaatggtatttttttcacttttttatttcaatgatagagaagtgtaataggcatttatttatatcagttgggctagcaaaaacttgtatgattagaccaccttctccagtgttatatgggcaccataaaagttactatgagcctctgcaagcatacatgattttcattaagattattaagtggttagctcctgacaacttagggcactcacagggagcaattaactctttggctactgccatttagggcaggagcttggccagagtcaaagaatctgggctgcatagaggaaaatttattcatggagcagctaagcatagcttaacgtactcagggcttgttggccacccttccccagaaatgttttatttcttttggtcctttcctcttttttgttttccctaagttttttgttattgttttaaagatgctacagaaggggaaagtggaaccaagtaagtcaatacagttttgttttgttttttaacgcattaactcaatatttgttgaatgcctccaaatcaaggcttggtattaggttttagtaattccatggaaaaaggggcattgtgcttattccctatgctcacaagttattctctagttggttaaaatgcagaaaattatacaaattttgtctgtcatttatttatggcaactgcaaacatggaagtttcttcatggtttggcatttgagttcttgaatattgagtatagtcaggattaaatcaatatcaatgcccttttcctttctaaatagtaaaatgttgcaaacatttttgtttaaaagggccatttttaggccaattaaaactattaagttaaaaactgagaattatttttaaaaaatctgaattattaacaattgcaatttttgttgataataaaaacacactttatccactagtaatattgtatttccttaatcctgctaataatataaactgaatcattattacctaaatattaagttttaaataaaaacttgttagaattgataatataaatatagtatgaaaattaactgcaaagtaatatatatcaaaattaatggcaaaataatatatatcaatatgttgcatgcttcaatattcatttcatatgtattttagaaatcacatttaataattttaggcagaatgattgatagacatatactcatatgatatagatgatatgagtatatatatgagcatatatacacatgagtatatatatcaatagtttctaatattatgcaattaactttgaaaataacattaacctttaaggtaagcaatggtcccttattttaatattgtatactaagtaattacaaatagttcaacatacctgatttctgaaatatttaaataataaagatttttaagctcattaaagtcataagaattaaacagaactaataaatcttattgaaccataaatctcctaaataataagactggtagtgtattaataaggtaagagtgttggacctgtgaaacacctttacgttttctttttaaaaataaataatcacactacagctgttaaaaaatcatcatatctgatcagttgtaagaaaacttaaacaaccacgtacaaaggaaacactatcctcacagtgccattgaagaggaaaaaaatgttgatcattaacatgagaataaacatcacctccaacaaaactagtatgagtatctctagatttatggccaaaatcttttctaaacaaactgaaaaatcatacaatttcatttgcaattgacatttcatggccctatgtatatgctagcagacaatgggggaaaacctcaaaaatcgaaagcaatcataagtacttcatgactaaataaagattctctagcaatcccccaaatcctgtatctcaaaggaggtgaaaattatattatttgtatatccaaggaatataaagcacatgttgtttttgattcaaacagaatgaatatccttaagcaaatgacagagaaaatttagtgaaaatgttttatatataataagtaaaaataactggttaaagaaatgcttatgattataattagagatctttgtagttgtgttcagctaggcagtgtttttatctagtaatagaaaaataatttctaggtggaatcaagtataacttaccccaaccattagccaaggaggcttgcaaccctaggaggcttctgattacggttaatgtctggacatgcctagcgtgtatcactttgtttct

SEQ ID NO: 2616 - DNA, 244893 bp, Homo sapiens
cgatgactatcaatttaattataactttttgatatgtgatattatctgctcaaatgatacataaatacctgggtctattaatttcatctttacaaacagcttcatgttgacactcattttcttgatcatcagttgtattttccagatacatgttgccagcccatctgagaaaacatagataccgatattcctgactgtcttcttcactcaaacaactgcatccatttgcacaaatctatagcaacgaaagaagtaaaaatgttatgaattcccatcacttactacaatattacaattgtgacctgagagatcatgatagatgcctctctgtctactaagatgaaacctagggttaaggaaacagaaggtaactattggacaagggttcaaagcttggctggcacagcaattccctaaatttctagagctacaagaaaaaccacacccttgctaaactccgtaataggagctatcagtcaaattgtcatttcatttctaactctgatttacaaccaaggccaccataacccttatcagacagagaatcgccttacaaaacacttttctgataagcaattgtaggcctcaaaccagtttcagccagtttatacagacaggacataaactgtctttgtgtcctgtagttcactttttttatgtgaactgccaaattccacctcattttaaagctaaagccctgcttcaaagagaacatgggatgtatgttacatacatgtttactcattgaacatgtgcttgcctgtcccccataaatatgtattgctttccccacaaacttgctgaatatgtctgactctattttgaacacagaccttatgaggcacaaaaatcaccctgccctttaccacttctaggagagcaccctgggtccacatcagagatgaagttttcccagttatattattttgctctgtttcctcagccaaatttcatgttgaattgcgattctgactgttggaggtggggcctgatgggagatgattaaatcatgggggcagtttcccccttgctgttctcctgatactgagtgagttctcctgagatctggttgtgtaaaagtatataacacctctccctttactctctctcctgctgccatgtgaagaccatgcttgcttccccttcactttctgccatgattgtaagttttctcaggcctcccagccatgcctcctgtagagcctgtggaactgtgtgacaattaaacctcttttctttataaatcaccgagtctcaggtagttcttcatagcagtgtgagaattgactaatacacccagttagcgaactgatatcacaaataaactcttctttctactgtttagtctttttggtagtcttttggatgacataatcatttcaaagtttgaatttcaagctttcatttatttgttgaaataatatgtttctttagcaaaggttaaaaaaatcagttttgatttatgtcaaaatcatttttaatagtcaaattgtttatactcaaattgtgacagaaatatatatgtatgtgtaaatatatgtatgtatatatatgtattgaatatatgtacatttattacacaattttttaaaattccattttattttaaccaaatttttatagacattatttaaatagtaactgatgtgatggaaatagcattgtattgatagacagatccatggaaaatctatttgtggttttgctaaatacttttatccttcagtggtttacttgttttctcctttgaactgatagtaaagctttactggattccttattaaaagtaaattaaataatatctttcacacatgtttgtttaatattttcataaagttatgatgctatgttttattgaaaattataattatatttttaacagctttaaaaatcttccacagatatgcccagtggattcacctgatggttaggtaaactgtcagaagagaaatgcacttcttatggagtgcttaaacacaggtatatatttatatatttacatatacatatattcctaatttctacaagtaaattcaaatgacaatagaattttactatctttaaaatcatttctctgcatattttcacattttctttttggttttggttcatagccaacaagttattttccatctgtagcaacaaagattaggaatttggtttcatggtctgatcctttattgatatctaaatagatgaatgtttcatagagattcactctctgttgaattagaatcaaatgagaatctgtcttttcactttctacatagagctcaaaacaagtaagaaagtcaaatctactaggaagtagaatagttctttgacatgaacagataataaagtgttatttacacttgccccaagtctaaaatattacaactgaagctataagttttctctgtgtctgtatgtctatgtgtttgtaattcacaaaggctttcatttctgtttgagtatgtaatgattttctacatccagaggatattagttgtaaagttttttttcaattaaaggagcacttttataactggcttacaaatttaataaacactcgtataagaagcaacaaattctagcattttatgacactactttatttttctatctatctctaactctatatctacaggtagtttagcttcctgagatttgagactatattgaacataacttactgtgcttttctttaaaaaaagagaatattctcttttgttacctcagaaaagttaccaaagttagaaagttgacttggctataaagctatattttctagcttataagccgtattcaaaatttgttaatttttaaaatattctttatggaaaaatgcctaatgtattatttctgcaccttatatataattagaaaatatgaaacaccaaaacttcaaactacccattgtatttttaattattatatatttattacaaaataatacataatgaaatcttgaaagagagcaatattttaacaaggaatattagtatgaaatttggaaaacacagacttacttcatataactatgtgctttcccttttattttcaaaataattattactgggatttaagaaaatctgaaagaactaaagttgaataatgagtttttctcttggctatacctcaaaaaccacataacattttgtctaagggatgtgatatgaacacctaaattatatctaatgctctggttgaaatacttttattaaatggaaaagatggtgaattattttatgctgcagttatgtactatatctaaaaactattgcaagtaatttctaggactaaaaaataattttggatttcaacatgatttctcatctgttcaggtagtctagacatctactagaattttggttttctataaaatttacacataagaagtctctcagaaaaattagcaagagagtaaattatatcagtagacatatagaaacttgaatctgccttgtaaagcagaggaaagatttctcaactttgtgtatacagagaatcaaagatctgcttaaaggagtccattaatctttaaaaattttatacaaaaaattctattaaacattctatcaaaacattacatcaaacatgttaacaaattttggactgaataggggtcggcaaccctaactcctgtatttcacaggtcaactgtatatatattatgtacataaaatatataattaattattaaactttgattgcacaaaaacctcaatattacaaaatacacacaaattaaattagaagttttattctagatattttaaaatgtttacttgatgaaggaatgcaataaaatcatgattttgggcagtggaagatcttttcttcccaaaggaaacagaagtaaaacaaacagctggaaattccctttttgataattcattactagtaatgtatatacataacacaatattattaccccaaagtcacttcatctgtagagaaattaaccttcctgaaggatatttataacatacttacagaaaatgttctgcataggtaaataaacaactctagttaaataatgccagctatcatttcagggaatatcgtgtaattttctagaaataattttgtcatatccacattatattagtacatagggtcacttggcaaaggactctgtgggaaaaaattctgtaagatctaatatatgccctttatcttgccattttgacccttgttattaaatagataaataaagtgacttcagaggtgaaagtgacttttcttaatcatgatacgtagaaagctggatccttaaaataatatctgtcaaggtaaaaattgcaccaaagttagataggtaattaaattttattaaagactattgaaataggggagagaaactaaactcaattctccaaaaatagaatgcaggagaaattttaattgcgaacttgaactaataaaaaatgacagcagtcctcccttattgttggtttcgctttccatgatttcagtcaccacggttcaaaaatatgttagtatggtttagtaagatatcttgaaaaagagagaccatagtcacataacttttattatagtatactgttataattgttatatttttattagtaattgttgttaatctctttttgtgcctgatttataaattaaacttcatcataggtatgtatgtatagaaaaaaatacagtaaatacagggtttggtactattcacagtttcaggcatacactggggtcttggaaagtatccctgcaggtaagagggaagactgttatacttgatgtcactggagaagagtttgatcaatgaaatgtgtcaagcagattgagttattattgagtttgcaaagattttgctctgtgagtaggccttctgtagagtacacagggaagtaagagtactattttctttgatgtttacatttcagagacatggttccaaggtccttgatacagacatcccaggcatccttaaactggcaagaggttggaagaagatttatatacatttcaaaaaggcagataatttacaactgcaaattttttaaagtacatcctataagaaaaaaagagtgcaggggcctgtaggcaataagaaacctgtctgaagtttagtcaaggtgagggaaagaggaaggttgttttggctctatatttagctaactaaaagggaacagattttaaaaatcatatctggatgaattaaagttcaaatttatactggattaagacctagtcataaattctgaaataaaataaacttggtaaaaacctttcacatcccaaattttagtgctccatggactcttctactttgtttgaaattcaccttcccttcccagtaactcataataatatataatttcataacatttttgtagcatggttgtagaaaataagataaacttatttgtaattatgtgtttccattccagaagcatttgcatttaaaaggacctcactcagagaaggaacacattttaatacaaaaaaaattaaaacaacactcttggaatttctgtctttgatgatgaaaactaaaataaacctaatttcccatcataagtttcaaaatactgagaaaaagcaagactaacttactatttactctatgaaatacttgcttctggaacataagactgtgaaccaactaaaataagttatttacaaaaactaacagtttgcacataaagactcactttaaagattctcagtatattgtgccaccaatacgaagctttccttcataaactctaaccaatccccactaaataccctctacaactgactcaaggctctacaccaaataaataactttccacaacttctcccatctgatgcactactaagactctactaaggtgttgttttcccttattgaaagaagtctaaaataattagtttttctccatcaccagaatagtctggtggtcttttggagggtaaatagtgaataaatccaaagtttcacaaaatctcattaaaatgccctcactctcaaggctggatagcaaccaatgcactacgctgagaccactggatattctctccaactgtgaaagtgacataggtacagtatcaagtctaaactccaatatttttcatcaacttcacaaatgtcatgtttctgttgtttcttaagaataaaaaaaattcgaatatatacaaataggaaaactctccgtcttcatcactttttcaggtgagtctataagaggaagctcagctgggagaggaaagcgtgggttctataagtacatcattcaagtgttctaaataagcgatgagttcagatgatcacatcactctggtgttcctttgggcaacatttttattgtcaccttttaaaaaatcttctaaacagtcttagttgatttgaaattgattgatcttttgaattttctggagacatgatattgtacaaatgcttgctgacataagttttcacgggttcttctcagtcttttatacctggacaccacacattcctcccctcatattgtaagccatatacatatctctctaattggcataatttctcaaaggacaatgtgaaattgcagtgaccaccctggggaaattttgacatgaacaagattatttatttgacagatctaatagaacaaaaagggaaaaatcctcatgaggagattctctgtcctgtatatctaatagagagattactgtgtattatacaaaaccttctctttcattttcatgcttctgggattaagaagcactagatttttaattatatggctctgtggaattgtcaagtatgtgagttgtttaaactgtctataataatttgttcttatgtgtttgaaaataggtttttcttcatttaagcatctccaatgctgtgcagaagggagataatcaaactttgcaatcataattttacatctaccagaatctagataaacttcatttattcatttttcactttttctccttttctgttttgcttagaaaaaatagaaattaattgatcataaatatttttataacattctatattgccattctaggatgatttttcagatagtcgacattttacaatgaaaggaaacgattaactgtgctttatttacatgatttctcttcccaaattttaacaaatcaggaaaagcattcatgtgtatgggtaatattgttagtcttttagttgagaaaaacattgggctccacagagctttggcttaatcctaaagttctgatttttcaaaatacataaatactgaggtttgctcatttatattagtacatatgtatttatttattctaaagaggcttatttatttaaaaaggactcatgtaatttttaaataaatgacacttcagaaaaattagcctgatttaatttaactttaagagaaatattctataattatgtcctcaaattgtctgattacacaatctaaaattgatataatcgaaattttaataacagatataatttaaaagggttgaatcttgtgaattcttactaattttactacactgatgtattagaatgttttattgatgatactacaaatcataagaacttaaaatgattgtgtaagtttacaatttctaaatatttagtcaacattaagaacttacacagatatttaatcaaattagtcaaattattttggatgcctgaacaattaatcaaattaatcaaattattttggttgcctgaacaattcctaattaagaaaattataaaaatatagtctctaaatatagatttaaattacctctgtccttatagaatggaaataaggtgtgcaaatacagttgaaggatgtgtatttatatttattttgcctatgataaaagttgttaaagttatataaaatgtgtaatcataaagtaataaaatagccaaaatgatcttagattgctatatttgcgtattttcttgagtctaaagaaattgtctaatttaattaaagttggtgatttatattataaaaggatactgagaactagaaatacataaacaaaacaacaaatatgatttgcttgttcctgacaaaggtttacagttactgaattattaagtgtattataatatgtaactatttttaatatactgataaagctaaaagtcttaaagataaagctgtaatgtaatcatctatgtgtatagtgatgtatatgtgattggcaaaatatatatatatgtaagaacgtattaagcttacttcatatatttatgacttgtaaacatatatcaaaatatattttagggcatacttttagatgttctgtggtatttgaagtctttttgcctgtagttgtaatgcctctagatgaatttgaaggaaatagtgacttgtatcagtttttacaaggttgactcaatataaattgatacattaataaagaaaagggcttatgagtctttactgaaatgtatacaatatgcagaattaaaacatggctttcttaaaatgaccaaattaggatgtatcaagacaagataggttacaaatactttgttaattatcttttgggaaaattcttgaatcattttaacaaaaagttcctattcctaagttgtttaaaatgaagattcttaaatttttcttaattattgttacatattaaaaaatataatcttaatttgtataagacagtggtgaggggataaaaggagggcctctcttttattcttgccataggcctcacaatttttagtgatggaactgcctagagattagaaattattttcatttatttttatttattttattttttaagtagcttgctcgtgtaagagattagaaatctctcagagatttaaacatatccaaaagacaaatgcatttcattatgatctgtaagcaaaaaaagtggcataatcacaactgtatctgagaggctttagtcagcctgcaaattataacattaataaaaaacaagaagactaggaacaaaatgattcttcaaaatttttactttcccatattataaatgtatgacgtaaatataaatttccaagtagactgttgagaatttgtttacgaagttatatttaaactatgcaaactatatattttgaatatttaagaatctgtaacctaaacatttctaactttctaaaaatcagacaattacaagctaaagagaaaaatgaaaagcaactacataaaattaccttacctcttttgtgccttcatgtgggaaccaacatgaagaattattatcttcaggatcgttcacataggttgcatcttcagtgcagtttgcagccagaaagaaataggcatcaataaccccttggcacttttcgccttcagatcctttaaaaaaaaagagataaaaaattaaataaactcttacaaacttgaattcagaatgaattattaaggactgtggtcaaattacttgaaaagataaatttgacaacatctgccacaaaataagttcctgtatgcatatgatattgaatttgaagaagacctcaaagcccaacactctcattttaaacatgaactgagaaatacagcatcacaagaagaagaagagacagctcccaggccaattcattttttaaaataatcaaattttgactaaactgtaattaataattataagaaaggatggtagaacgataaaaagaacactgtcctataacaaaaataaaagcagagattgcaaaagagcagaagaaagaagtgacctatattcaagagaatgtgacctatattcaagaggaaaactaaaattttaaggcccagacctagaattctcagacaaggactttaaaatgattatattaaactttctgaaaaatcaacaggaaaagatgaataaaatagataattagataaggaattaggggatgagagattttgaaattgtaggaaaaaccaaacaaaaaaatggtaaatctcagaattgtagggaaaaaggagttaattaaactgggctgaaaacccattattggtcattaatagtggtaataaaagaacatagaagacctgatccaatctttttgtaaacatgactacatctcctagtaaacaaacaaaaaatatttgtcagaggacagtatttatctaaagaatcttttagcaaaatatctctggctttggattgcttatagtaaacaaatctaaactctagggactcgcaaggcatcatttcttggaaaatagaatgtaagctatgcattttacaactgagttgtaaattagaaatgattcataaactgacatctccctaccgtgtgaatatttcaccaagaaatctcacatattactggaaaaaaagaaggagctaggaaccaagcacaatatcccaaatctcttcaatcatatgtatgtaatttgactgtttataaatttaagattacagaaaattatggctatgttaataaaacaattaatggatgagattatcagatcaaacacaagagaagaaaagatcagtaaatttaatgataggtcaataaaaattctacctgtaacattctgagagtaattaactcaaacaggattatgctagctccatataattaattgatatgtgttcctccctctgtgtttttgtgcaaatttatgtagtattagaatgaatactttattgaaaatttggagaactttaatagaaggccatatatttcaagtatgcttttgtgggatgatttttaaaactattttattcagttatttaagaaattgtaggattatttagaattgaaatttatgatttgctcagtttttccaactagtatttttttagaaatttatccatttcatttaaattgtccaatttattagtataaagtttttcataatgatatatctgactaaacattaggatttaactcttaacgtcttccctctgcctcccaagacctcaaaaaaacagagaattaaaaaaataaataaaacaaacgttttaacccacaaaaaagagtgagaagatgaaaaaaaatgatacactgactaaattagcagaaaggctacagccaaaacacaaatgaggggatataattatgaaaaaaaaattggactagcagaaatactgagatgctctgggtttaaaaagcatctgagaatctgatactaaggtgggctctggaaacacgattagctgacactgagagtctctctcccaactcagtgatccagattattattctaactcctcactcagctttacaaacaaacaatttccgaggtttgttttcaggagttaaagaatctcaggagcgcctgccttaaggataccaagctccttgagggtcccctagcgaaagcctagttgccatcctgcaaccctgtcatagagctccagtcatcatggcccatccttgtatggtcagtttccagtcagccttcttagttcctctccgttaaatatgatcaccccacatttggcagaaagactccaaacgagagagaacaaatctttataaacagtatttacagaaaactgagacactaggcaaaaaagaagaaaattaaaacaaacaaaactataacatttttagagagagaagaaaagtcattttacccttattgaaaaaaaaaacaaaaaacaatgtccgaagtgtgtataatttaaaggatggaaaactgccctagattattacaaatatagtaaaacaaattaaaaattcaaactcattttgagatattcaattggaggaatggagtagaaaataaagcaatatgaaaagaaataggaaagagaaaagaaattatgagaaaacgaggggatcaatttaggagatgtgatacccaatttttggaattggggctacagaaaaaaacaggaaaaaggactttttaggggaaaaaatacagaaactacctaaaaatggaaagacccatgcttccaaatagaagagtttaacaagagacaacaagaacatactatgtaaacgtttcaacattgtgaaatttcagaacactgagcaaaaaacatggaaaagtgttccacagaaataaacacaaattatatataaagaagcacaaggttgtctactatacacatgattctacactgctgcatgcctttctttcaccttatcatgtatctcagtcctagatgagttctacattcatttccatatttatgtttactctttttcttaataaccaatgataccaggtataaaattacacctatattatttagcatgtggatgtattctcaatgatcagaaggttaggtcaaatggtatagaatttgtaatattgacggatattgcaaaactatcccacttagatattatagtgattttacagtattgccagcaatggatagtcattaaattgtccaattctaaaatttttaccaggctaagaggagaaaaattatatacttacagtgttttttaaatttgctttgattgcattatgaatagagcttagcattttccccacatatttagggatactctctgtgtcttcgtatgtaaactgggtgtttatattactgacttacctttcagctttttcagtttttccttcttaatttctaagttattgatatattctcgatcctaatctatcttttgtgaagtaaaatgtttgtgcagtgtttcttttgcattttgatttttatgtctttcataagcagatatttttacttgtcttgtagtgaaattcaccagtcttttctttctgacatcaacatttttagtattaactataaacatcttccccatccattttttttttttgtttttccctttgagtttttgtgggtaaatactaggtgtatatatttatgggttacatgagatattttgctacaggcatacaatgtatagcaatcacctcagggaaaatagtgtatccatcacttcgagcatttatcctttcttggtgttacagataacccaattatattcttttaattacttaaaaatgtacagtaaattattgttgcctgtagtcaccctgtggttctatcagatactagatcttactaattatatctaattatatttttgtacccattatctatccccacttccatccacctcactatccttccaaacctctggtaaccatcattctactctctatctgtaggagttccattattttaattttaagctcctacaaatacatgagaacatgtgaatttgtctttctgcgcctggcttatttcacttaacataatgacctctatctagttccatccatgttgttgcaaatgacaggatctcatttttttatatagctgaatagtattctatttagtaaatataccatatttcccttactcattcatctgttggtggacacccaggttgcttcaaaatcttggctattgtgaacagtgctgaagtaaacatggaagtgcagatatctcttcaatatacttatcccctttcatttgagtatatacctagcagtgggattgctggatcatatggcagttctatttttagtattttttaggaacctccaaactgttctccacagtgattgtactaatttacattcccaccaacagtgtacaagggttcccttttctatacattcctgctagcatttgttattgcctgtcctttgcactagggtgagatgacatctcattttagttatgatttgcatttatctgatgactaataatgttgagcacattttcatatgcctgtttgctatttgcatatcttcttttgagccacatctatttagatcttttttcccatttctaaaaatcatattattattttattcctgtagagttgtttgagctccttctgtattctggttattaatcccttgtcagacagatagtttgcaaatatgatataccattctgtgagttttgtctttgttgtttcctttcttctacagaagcattttaacttgctgtgagctcatttgtctattttttgtttgattactagtgcttgtggggtattactcaagaaatctttgcccagtccaatatgctggatagtttccccaatgttttcttttagtagtttcatagtttgaagtcttagatgcaagtctttaatccattttgatttgctttttgtatatggtgagagataggggtttagtttcattcttcccccatccaaatttacaaagcatttctccaacattctctaatatttttatactttctttttatgtattaaaacttgtatctatttcaatttaatccagagaatgtttaaaggtataaacaagtcgaattttttttcagatggctatccagttgttccatgttaattattaaatagtccctacttattctaataatcggagatggcagttttattatatgttatatattttttcatgttttggattcattttgagactttgtgttttgtcatatttgttgactaccaatgcggtggtgccatgcttttcattaatgaagctatgtaatctaatttaatatatggcagagctcattctatacaccacttgtccaaacaatgcacttttgcagagtacacttggctttatttgtcttttattccatgtgaacattaagaaataagatgtcaatttcatagaacacaaagataacaccattattttattaaaatctcaataaacctataaaataatatgaagagttgaaatctttaaaagttgtatgtccagtataatataagtttttcaggaggaaggttattattattttaagtttacagatgaaactgtatgtatcatacataaggttatgattatgtatgtatgatatacaacatgatattttgaagtatatacacattgcagaatgaccaaatctagctaattaacatatgcattacctcatatagttatcatgtttgtggtaagtacacttctgaaattataaaactcactggcaaaagtaaacacattgtaaaattcagaatactcaaatactgtatggtagtgtgtaaatcactaatacaattagtatgaaggttgaaagaaaaaactattaagaataatagtagctacagtgtaatatatctttagaattttctttcagattatgtatgcatgcgcctatactacagcaatatctaaagttttctccatgtagaagttgcatgtttttgttaattttagtccaatgcattttaacattttaattcttgtttgtaagaaatattttcttccttatgatttaattagcttgattctgtttattaaagttgtttatttctaattagtgacttaattaagagaattctctttcaaggcatgtaaaaatgctttaaaaacttactataagtgatatgaatgaaaaatactaaaccactttttttaatactcagatttttaaaaagccttcaactaaagattaaaactaaagtccctaaaatacttaatagatatataaatagcaggcatttgacaaaagaagacttgaaggtagaacaatatactaagaaaaatagattttgataaagattgctttgttgatacagcatttcctattttcacaaaaatcgtttaaaatttaagaagtaacgtataatgcataaattataattaatattctggaatgtcttctaccagaagatccattactttataaaggaaaaataaaactttcaaagtaaatatttgtttgcaatatcaactcacaaatgcaacaatcactatttatttaaaaaaaaagttcactagtacatgttaagtgttttaactctatgtttaacttggataagcaaactgaaataacgacatgcttcaagaagaaagagatttaaaagaatttctcttattttctttttttgtctaggattttatcttttcttaagcatgattcatattgtcttacttcacttcgcaactctttatccactctgtcagtagctcttttcctcaaacttaataatacacataatgaacatagatgatgacattgaaaagaaacagtgcatgtcagctctttctcaagatgtgcactgtcgaccaattgtccttgaaggggcttcttctaattaatcaccatcccttctctgtagagcaatcatattggcaagaattgattgggcgtgtaagacacttaatttagttgttagaaaaatcccttaattaaaataatcttcctgctggtaaaattaatgcaccccatgcaaaattaccagcatgattttaaagttcctcttcaattacattttatatttcgtgaggaagaagtaaaagaagatcttaatggcaattatcaaaagaaataagaaggaattttgcaatacataaaatgtataattctatttacatatgttttcatttattttaacttctattttgttttgaaaacttgagaagtttcactgctgaatcttcatattgaaattcaaaatgagtttaagtgttttacttaaacattcattcagtctgtgcattatcacactgtttcttttccattggaaagcccaagtcatttagattctcagatgtagcggtcacataattttaatttttgttataattagctatattcagtaagttctgtccagtaattcaggaaggaataatgattaaatatgcatacactgttttgaagataattgctttctgctaagttttccatgagtaattttaactttgtattacaccacccattttctaaaacatatatttgttattttactgccattcataaagttgactatatttgctcaaagctgatttatccatgagcaatttgacttactattactccttccattttccctcaaaaatacttctgccatttcatcattgtgaatatgttccctgtagcaatttatagttctcaaaagaagtttaatatttaaaaataaccaaacatatgaaagcattattcctactatgagataaaggaaaatgaagtgcaaaaacgatgcaagcactgaaatatgtgaactaatttggttgtaacagtagagagcatttctcaatctgcacactgaaagcatgtagggaacctcaaaaaatactctgtgtccatctcactacaattccagtttgattgttctgtaatgagagttcaccattagtatgtttcaagagctccttcagatgattctaatatgtggtcagggtttaaaaacaactgaactgacacaatccctaaatagtcctgaggttaattcctctaacctcaactatatttatttctttgtttcgtctgattgtgtcatttataaaatagtaagtattcataacagagtctctgaaagttccttttagcatcaacatagtataatcaacaatgctttgctctcttctaccacttttggtcttcagtgtgatctgattaatgaactgataactatttctgtcactaaaggttgttaactctacagtatactattttatgagcatggtgaaataaattatcatgttttctgtttaaaaggctaattgttagtttacttcaacactgttgtgatgtaatacaatgttagaaattcagctgctgttggttagctgttactcaaaaacagacacatcaaactgttaatttgctggttgtttgtaaactgaagtgccaaaatatcactgtcagaggaaatattctttaaaagaatgaaaataccatatagtcttaagaatgtaaatcaaatttgcatcagctaagttaaataatattagaaatgtaatcaaagaatgaaaattaagctcatcaaaatagattgcgatagaaattgaaactctataatataaacaaaaacatatatgggaacacaagtgctggaatgatttcatttcaagtgtgtaagacagaaaactaggagtcctgttgacaccttcatcacttgctatttccaattcataaacaagatcttccatttatttcaagcttccagcattatgactcaccttattactccaaccaactccctagcttttttccttctcttccatgtgtttctctacttgttataaacttatggaatgtgtcaaaacctatagtaattttctattccttttagaagagaaatcaaaatatctaacccagcattttagttctggctttaccccctccatggaattgttattagtcttttctcacagccccagacaggccttcaaagaagccatttcttctaatataatgtttttacaaatacaattccctcaacccagaattctctcttctccaacttctctgccatgacattattctctatatctctcttcaggggtcattttctcatggaaaccttttctggcaacccaactcaatatctcaattgcccagtttttttttctttttttctaaataggctcattgcttataagcattcatggaatgctacctgttttcataagagcattttgtttttaaataaaattacatagttatcactgtatttgtccattaaccactcccttccaacaaatggatttatgaaagtaggaaatagctctagtttacttcactattatctctcttgcaccaagtagatttcctaggatgtagttggtgttaaacacgtcagttaaaggaatacattagaaaataagagtattaattttatttttagtttatattacgttttgagatataaaatactttgtgtgtttagaaaatgaatacgtgactagcaaattttgaaatgattcaagcagattgaaaaaaattacataaatttgttacctgcaaatcccaattgccacacatattcaaattgagcaggacctttatcttggcaaataccatggaaggtgactccacagtagcagaggtgttgatgaattaggtaaacattcttcaaaaaccaacatggattttttgtgcaccctggaatgcatacatactgcaaaaaggaaacaaggaaaaatggtaaattcttttttgatatatttttcaatatatacatataacataaacagctaatttttaaaaccacagtgattatagaaaactttatgggacacactttttatacttctctttatttcttctatttctttatcttttctttctgtactatcttttgtcatatccatgttcaaaagcctatatgataatcttttagctttgactcactctcaatatacaacagtccctaatcttctgtttgatgggctataatacatctttcccctcacaaatttaaaatacctatggtataaattaagagatacaccatttaaaacacttataacggttgaattagcacaataaatgtcatggtgtgttcaaattagacttttgctatcatttgaaaatagttgaagataatcagggcatattgtctaataatatgatttgtttatggtaatctccagcatcttcaaatacaaaaatcatatatagttatatccacaattgaactaactaaatgtaaaccattttaggtcacattgaggtcatcactaagttttagtacatgctgcgctacttaggtattaggaagacatcaaccagcatgaaatttaagccctagagacaaactagggctatgtattctctttagagcatacccctcaattatttctacttctccacgttttttattaacaaatctcccttgaatttggcagagaaaaacacagctgagacatgcagtacaaggaatctgacagttccattaatgaaattactacactaagtaagcattgttctgtttcaagtcatggtggtctacctggatttgcaatcacaatttcctaattgcacaacaaccttaaagtatgagtcaacactaaatgtgaggaaaaaaaaaaattggcgaggcgtggtgcctcatgcctgtaatcctagcactttgggatgccaaggcgggcggattacctgaggtcaggagttcaagaccagcctggctaacagggtgaaaccctgtctctactaaaaatacaaaaaattagtcaggtgcagtggcgtgcgcctgtaatcccgcctactctggagactgaggcaggagaatcacttgaaccagggacgcagagattgcggtgagctgagctgagatcacaccactgcactccagcctgggctacagaataagactttgtctcaaaaaaaatgaaaaagaaagaaaaaaaagaaataatttaaaaaataattaccatttaattatattaaatgattaccaaaaaatacaattttatgatatatttccaagttgtgagatgatcaaaatctttaacccattacttttatactgagacatcaaatgttgaagtctacaaatggcattaaccaatcttcactgtcagtggagattgtctttattggatttgggtcctcattgtgatagaaaatatgaaggcctaatgaattctgaatatatgactgtacaaaataaacttagcagaatagtacattattcatattgataggatcctgtagagtcatttcttcacttaaaacttaacaaaacaatagacagtttttatctgtcatgtccctctcacccttccctctgagtccccaaagactgcatattgagtacagtgcacactgcttcagtgactggtctaccaaaatctaagaaatcaccactaaagacttattcatgtaactaaaaaccacctgtacccccaaaagtattgaaataaaaatttaaaaataatttcagaatatcctcttctggacactggcctaggaagagaactcatgactgagatctcaaagtacaagcaactaaaacaaaagtaaacaaataagacttgattaacctaaaatgcttctgcacagcaaaagaaataatcaataaagtgaacagacaaccttcagattgggagaaaatatttgcaaattatgcatccaacaggggactaaaatccagaatttataaggaactcaagcaactcaacaacttcaaaatacaaccaaataacccaattaaaaagtggacaagtgacatgaatagacatttttcaaaagaaaacatacaaatagccagcccacatatggaaaaatgctcaacatcaccaatcatcagagacatgcaaattaaaaccataatgagacatcatcttataccaatcagaatggccattattaaaaagtcaaaaaacaatagatgttggtgaagatgcagagaaatggaatgcttatgccctgctgataggaatgtaaattagtacaaccactgtggaaaatcgtatgggaatttctcagagaactaaaaacagaaatgtgatttgatccagcaattgcactaccggatatctgcgcaaaggaaaagaaatcattatataaaagagataccagcacaagtatgcttagattcattattcatgataccaaaaatgtgggatcaatctaagtgtccaccaattgatgactagataaagaaaattgtttatacacacatacacatacatatacatacacacaatggaatactatttagcaataacaaagaataaaatcatgtcttctgcggcaaaaaaataacaaaacagcaacaacaaaaactaagttcgaattaagtcctgtctaaggtattttgttttgtctgcaattgtttttgttcttgtttgtttgttttttaaactaagaatatcagaggaagttggatcaaggatacgaatccctgtttctgccactcaggagctaaggaaccatttaaaaatgagacattaagtattctgtaacaaccttgagagagatgagctgataaggagcaatgagagatgccaggaaaaatgacacaaataatatgaatccctgctcacaggggtgctgtggtattcttcctactactttaacctgaagaccaaatttgacttctggcttttcttaatgaaaaaaacaaagtcacccaggatatatttcaatgggtgcctgaacaatttatctgtacttatacccttctatactgaataaggacactatgaagatattataactttagataaaatttggatttagagggagttatttgtgattgcagctcttaatacctttttaaaattattgcaacaccagtacattatcctctaacataacaacctgaatgttaagagcagttaatttaaaagagcaatttatttaagccatatgtagaggctaggagtgttgtcatataggtctatctctgattctgacctctcatttataccttgtgtgttcatgtgaggatgctgacacacacacacatttcacagcaccaacatgaaaatagatgtacaatataacttttaaagcaagttaatataagtaaagtatgatggtgagatggaagagtggaagcactttttgcataaaacatttaacttaatggcctttgggaggaattagatgcatcaccgctgtattacaactgagccattaatcttgaagcttcatcagtattaacttggttcactttcatcatgttgttgagaggctcatcatttctgtagaggttcaacagaaaagccttctgagcagtgtacaagttctttttgtatatttacaaaagctttattcagtttgttaacttcttaatcattcataatgtttatcttcttaagaagattagtggtaactggtgttgctttgattttagtcttaaagtgttttttggcttgctatatgaaatacattcctggcctttgctctcttaatttgttcttgtccatcgtctataatacgcatgtgcaccttcttaagcttcaagtgatgcaatctattgagtgaataaactaaatgtttgtctttaaattgctctgacctttctagaagccaagggaaaaggggaaacattaaaatataccacagctgtttttattgattaattttatactggtagattcattttggtttattggatgaaccagatttccagttgatattcctaaggaacaattgttatatggtggataatataaaacaaatgacaatactttggtaatactattatgaaaaaatatttattatatagaccaggagtctgcaaagtattctcttaagtactatgttttacaagtaagatgatttttaactaaatcaacttcctgtttttgagtatgaagttcaaaaatgctgccaataaaagaaaagtaattatttcaaattcacagtgaaatggcgactaatgtaatgctcattgcttgctaaaacactattttttttcgtttttgtaaacttaaataaaaagacaattaagtgagtcaaacgttatttgtatgaccagataggtgtctttgtggaattcagttattttaatgtgacctctcttttaaaatgaagttaactttcagtagaatgatgaccttctctgttaagatatcttaagtttcacagcgacctcaggtactacggtaatattaactttggcccatcaatcttatttagaacaaaagagattaaaaattagttagtttacatggaagtgttcacttagtttgattttttaaatttatttaaattaatatttggaactgatgctttaaaataatcccattttaaatactatttcccatttaattcatagattaggtgacaaatatttaacagaaaattttctgtggtctgggaatttatatcaaaatttatacacttcaaactttacctctgaaatagaagtatgattatcttcatttaaataagttcacttattatggtatggcgaatttaaggtgatcaacttaactgtttgcctgggactttctgtttttaaaagctaaaagtcttatgtctactgaactactcattcctaggcaaactgggatggtttcttttcctaagcgttgattataaactcaaagctttatttctgaaattaaggaggatgagtagtagagctgtatttggcatgccatgagagagagaaatgatcctctgttgctgtaggtttctgaagtgtgtgtgtgtgtgtgtgtgtgtgtgtgtgtgtgtgtgttgggagaaggggggatttagttaccatagaaaaacccaacttaacatgcttatcagaagtttcctccacctataggtgagactaaactcattatcaaatatattaaattagaccttatactataaaatgtatagctcatatttctataagaaaataaaaattacattaattgcagtaaacaataggtgtttataagttgctaataacaatatacatgaaaaatagcaatgtgttaatctatcctgtacttgacagcccactcgatgtataaaaactgaaaagaggaatcaattcagcatttgatctatttcttcttttagtgagttgaatgccaaggtttggaaatacacaaacatgcctttggaagcaaacatctatcttacttttgacagtgaactaattaaatggtacatattagacaactaaacttgaactgactttgaacctcaataagcttgtgagaggagtaattctggtaagcaaacagtgaaattaagacaaagatgaaatggtttcacaatgacagtaaaaagaaacaagagaatcaagaaattgtctataaaaaggaaagtaatctatttcttgtatctcatgtcacatcagaaataagcaaattttgcagtatcaaagttttgtgatttttatttgattgacacaaaatacatattcataacaattttataaccttaaccaactgatttgtcatttcatgtgccaaatatattcaatgttgctttccttaaggcttttctattttataagggaaaactaattttgattgctagtatgaagaggattttaaaacaactttagatgctgatttcttatttcagcagcaacctttcttaggaaagataatgatttccattagaaatcttgcttttcatgatgtattaagcattgtaaacttctctttcttaaagaaactatatcatgaaattatggcatatacctagaattacagcatctatattccctggtgattctatttatatttatttaaagcatttgctagtttttagaaaccatacagaaaaatgaaaagaaattccttcatataggcagatattaatagtgggaaaacctcacctctctctctttctcttttttcttagtatttgtatatgtggccattttaccacatatgtgaattcattgttcaaatgggttcaaaagcattaactcattctattcatttcatcatttttttcagtagcctggatagaatatttgtatattcatttccatacttcagataaggaaataaaaattatagaatttttttcaactcacacacctcaattctcacaggtctaagacataaaacctttatacttaggtttcaaatctcatcaattgttactttattttaaaatttattctctattccccaataaaaatattttcaatggaagttttaattgacacataagaactattattgttaaaaattggaagtatataaccttataattctgatgttttattgtttttatgacgccaccttcttgctttgacatcacttattcacttatccttctgaagtttaagtactaataaattattaacagattatttctaaaatatcttattctatccaatttaaagaaatgtaatgatctttcaaaaagcaatgatgaatttacataaattaatgttcaatttccactcatagtcaaaaccttctatggaaaattaataaagtaaaatcaatagtaattatattatttaaataaaaaaattagcattattattcctctagctcttctaggtagcacctaaatttaggaactgtatccaaaaaacatagaataatgcaaaatgaaaaacaaagctggcctattttggctctctggggaccaagggaaatctgattttaacagaaaattctcaagtagtttgggaaattatataagatcattttctggtctcctattattactttaacatttttccataaatcacagtagttgctgacaactccgtgaccatactatattctagagaaatgtgaaaattcaacaaatattttctgaaatataactcttctccaactgttatgctaaaaagagacaaaaagtttaaattacggcatccttgctctcactgagctcacagtctaatgtgtgtttacagtcattccaagaaatcccatttagtgtagtcactgctatgtagaaagacagtattgcaaacaatgggaacagaaaggaagaagtagtcgacataatcacaaatgttgtgaggtagtttcattctggatgaaggcatgtattgggatagacatgaaataggaaatgcaatcttttccatatttccatctatatttctacatataaaattgtgactggagttcaaggaatggtaggtgaccataaattattgaatatctgtacttttacccaaggtattataattaatttctaaatttcctttagaaataccatcattctcagcaaactatcgcaaggacaaaaaaacaaacaccgcatgttctcactcataggtgggaattgtacaatgagaacacatgaacacaggaaggggaacatcacacaccggggcctgttgtgaggtggggagtgggggaggaaggatagcatttggaggtatacttaatgttaaatgacgagttactgggtgcagcacaccaacatggcacatgtatacatatgtaactaacctgcacgttgtgaacatgtaccctaaaacttaaagtataataaaaaaaaagaaatactcatatatggatatgtgaatgatcaatttaatttaatgacttgtgaggtgactgacaggaatttctttctctttttttttctttccttccttctttcgttcgttcgttccttttttttttggtctgtgtctctctctatcgcccaggctggaatgcagtagtgctatctctgcccactgcaacaacctccacctcctgggctcaagtcatctgcccatgtcagcctcctgagtagctgggactgcagacatgcaccaccatgactggctatttacatattttgtagaaatggggttttgctatgttgctcaggttggtctccagctcatgaggtcaagtgatctgtccatttcagcctcccaacatgctgggattacaggcatgcaccaccatgctcatcctgaaagtaatttcttagactacagtgattcattatctaatgtttccctccaaaaataacacagataacacaaagcaaaacaactaaagcctcttattttctaattatgagaaaatgactgaagaaattgagcaaatactggaatttttcatgattgtgaagaaatgtacactattctaaaacacatacgagtaactaatttattattcacaatctgtagtatctcataaaagtgcaccatagctaatggccagagaacctgttcttcccatattttcatttatttccttttaaagatttctttgattttcaaaagtattactacaagaacaaaaatgtggctacctaattcatcaccaagtatttgattttctcattttaagacatgataatcactattattcaagatcacttctttattcaataggtatttattgtaagtatgctctggggagttattaaccacatatggcacaaataaagtaaaagaatgaaattgtcccagttctcttagatataactttaaaatgaacacaaataaacaaatgaaaatctcacaattcctaaaggcaatacattctagaacatcgttactccaagatgctgcaagttgagtatgtcatttaaacacacatagatatattttactatttgggagtaaagtaaaattgacatatatgtatttatgtgcatgtgtatatatatgtgtgtgcgtgtttgtataaatgtatatacacatgcatatacattacatatatgcatatatgtatgtatacacattacacattattatatatatacatatatgtacgtatacatttatatatatgcctatatatgtaatgtatatgcatgtgtatatatgtaatatttttactacaagtgcttaaagattttcttcttaggagacagtttcttccccttcttaaatatatacattttctttaaaaatttctacattagtattttatatcactgtagacaaagtgtaatattctccagtgctatactgttctctgattctgatgtatttattttttctcaaggactttcatttttaaactttataaatacagtgtctcttattaaactcttatcattgctttaaattcaaaaaaagaaaattagaaaagttatgggaaatctttagagaatgaaatcacccttttcttttcaacaggaaagcaagcagtctcaaagaaccatgaaaatgatctgattgcatttagtcctaaatcaactttcagctgctgaggtaaaaatgcctttgccatgacattacacctttgtagttgtctctcacatactacatagacttgcatgccaaatgtcattcaacttcaggaatgaatgtgatcatcagggctacaaaagaagataaatgattatcttactcatttaaaatgatattaaaactctttttttttgcagttaaatcttccttttgctcttataggctacataacatctatttatttcattcttctatcaaacaaatgactgtagaaaaccaaaatccctattttcctttcccagctaattgctaatgcaaacttcttataatagtggcataatattaaataaacaatcaattaagcaattaaatatatagctttaggttcaagataaccaacattgactctactcattttttgttacagttatatttaatcatttcagaagaaaaataactcctttaagtatatgtcattttgtttccacaacattgtaaatgttatgattgatgttgtttttcatggcgtagacagacatacttgataacgttgccatctcaggaagagtacatctttaacaggctaaaagtgactttaatattctttttaattttcataattagttaaaaactttgataattgacgatttaactcttttaatacaagtcaagtttatttagtagcatttatttagataacttcaatctatcagtagtttgcattttgtaatttaactaaaacttagattaaatatatgtgtcacatattttttccaattgtagaagtgtatgtgaactaaattttccctcaaaataccttattataattttttaatatcatttttgtataatcaaattttaccccactgatttcagtttataaattcagaaaatgactttaaatatattcttgcatttgattttctctattttaatttaattatcttttttattgtgctacaataatatcttaattattggggctttataattaattttttcacctggtattccaagtacttctttggtattttttcaaagtttccctatatatttttaaatttgtttttccaaataaactcttggatgttttttcttaaatatcccttatatgtaaattattaaataacatctgatacatcacatcatttgattttgtctttgtgaatttttgaaactgtagggtaatatgatttttctcaggctttgactaaaaaataaaatcaactaaatgttttttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagggcaatttttctgccttccctggaagaaagttagtaccatataaagaaacaaatatatctttcttcatagagattacatttcagcctaatctagtcttctagtcaataaaaataatgtttgaagaactatgttgtaaactgggaagccagatggcaataattgtcaagaaaaaaaaaacacagaaagtggagatgacacatatgggctggatgagagtatgggagtgtggctggttctccttctccatgagttctgcatccatggattcaaccaactgtggctgaaaatattttttaagacaaatgatggtggcctctgtatgaaacacacagactcctttttcttgtcattattcctttcaaaatacagtataacaacatagcatttactttgtgttaggtattacaagtaatctatagataatgtaaagtatatgggaggatgtagactggttatatgaaaacactatgtccttttatataagagactggagcatccatgaagtatccaagtgggtggaggtccctagtaccaacactccacggatacctagggaggactgtatataacattttagattgggtttctacagaaggacaaaccgaggatgtaacatttgagaaaatacctacacagaatgaagaaactgatgaataataaatgtgggtgaaaatttgggtgtaaatgctcacaaaaaaggcctcaagcaggaatatgcctgagttcttatgggaacttccaggatgatatcaatgttattgtagagcaaaccaggagaagtatgataatattgagcctctggttaaaagcttacctgctttcctctctgcaaagtttaattatgtgagccttcaaattcctctctctctctctccctctctctctctctctctctctctctctctctctgtgtgtgtgtgtgtgtgtgtgtgtgtgtgtgtgtgtaatgggggaagtggggacaaggagagagggacagacagaatgagagagagagacagagacagagagagattttctttagattttcaattgttgcaactaaaatttaaaacttttaatcctacccgaatgcaaattgtactcatatggaattctaattcgagctttacttcttccagcgtgagtttacataagtcactcttgttgaggataattgtaaaaaaaaaaaaaagcaaaactgatttaactggaggatagaaatagaagacagaaataaagcagatggtgaagttaaagtagattagttttaaattttgtgtttttttctttgttctctaatgaagccttataggagatttaaaaaaaataagataaaacataaacagaatccttatatatacacttctgagccagttgcaaaagaagagaatcaaaggagctttgtataaagctccgatgctattttctttgatataacaaacaacactcgataactttaagtcataacattaggaagttatacaatatttgaatagacacaaaccagaaagtgcatttctaactatatgtattaaaataaaataaatgaaaataaatgtgtcagtaaattactgaaactctaaggaaaagaatgcctgaatcattgcagtaaggcataataaatagtatttaattgcatagtacctgtattttacaattataatgtgcataatatcaaacatttttaaatgtattggatgccatttatttatataaacatgaaaataactataggatttttttttgccatgagctcttaatctcttcaatagtttatacatatgtggtggtgattagaaacctaacactctcaattgtaaagcaacaattgttttatcattgaggccatttatattattaatattgagaatgcaattgacattgtgaatgtgcttgattagatattcctcatcacaatttcaataaggaagttcgccatccttatgccacttcaattataaagaaaatgaattgaaaatagagaaatttaactcataatgaagagcatgacttagaattaataaggttctgacctacagggtttttttatctcctcatattttccagcctattttattaatatcagcttcctaatcttaatgttactatgaagaatgctttattcttcataaaatttcattaaatgcatattaaaaaagaaatatatttttgttctctttttaattttagtctaatcccattaacaagagtaaaccactattaaatttgttggtttattttcttatagcttatttaatacacatctgcacaaatacaaatttcatcctggcccaactggccatcaaaactctgattaaacttggtcttaagttaaatcctcatactaacagagccactctgtgaattccaaatccattcttccacatgtttctctttggatccttgcttcggtgtccctgtctgtttcaatttatccctgggccaggtaggtcacaggctttggaaattttaatgtttccatcaaaccaaatcaaatatgctaagaaaatttcatgttaaatgctaaatgagaatggggatggatgacatcaaataccacatcaccttttgccatctaaatggctcccctcccttatgctttctgctgcttgggaaagcctctgctcctgatatataatattttctagtgtctgtaacactctgggaggtaaaatcaatttctgagggagcagtcctggaatgacttctaacattttcagcacctcagaaaacacataaaaattaattttttacaagtggataaatacatacaaatatctaaaaccaaataatagaatgatacaggtgcttttcacaaaacattttaacttgagcattttcaatatgattaataaccttcaaaaacaaggccaaatggattcatcttttattatatggatacactatactttttaatattcttgttgtttaatttgattaattttcctttacaataaataatattataatgaacattttatatgcatgttttatataatcttttaaatttactttagatatttctagatactgaattattaccggttgaaaaatttcaggcacatactgctgaactgccattcagtggacttattacaagtcatattttccctggatacatgtgaacatactgtctcaattttcctttgtgatacagaaatataaactgcgtatgcttttatgttctgtgatatgaaaatatcaaatgatatcttcatagtgccttaaataatatttcattaattttttgacagtttggattaccaactgtagtaagatggctgaataggaacagctccactctgcagctctcagcaagactaacacagaaggcaggtgatttctaatttctgtatttccaactgaggtaccctgttcatctcattgggactggttaggcagtgagtgcggcccaccaagggtgagcagaagcagggtggggcattgcctcacctaggaagtgtgagtttacataaggggtcagggacctccctaccctagctaagggaagccatgagggtttgtgccatgagggactgggctatctggcccagatactacacttttcccatggtttttgcaatccgcagaccaggagattccctcgtgtgtctacattccccgggccctgggtttcaagcacaaaactgggaggctgttggggcagacactgagctacctgcggagtttttttttttttcgtaccccactgatacctggaactccagtgaaagagaaccatttactcccctggaaagtgggctgaagccagggagcaaagcggtctggctcagctggtcccactcccttaagtccagcaagctaagaaccactggcttgaaattctcactgccatcacagcagtctgaagtcgacctgggatcatcaaacttggtggggatggggtatccgcctttactgaggcttgagtaggagagtttcccctgacccttctaaagactgggcggaacgcatcacagcacagcaaagctgctatagccagactgccttgctagattcctcttcactgggtagggcatctccgaaagaaaggcagctgccccagtcaggggattataaataaaactcccacctccctaggacagagaacctgggggaagggccggctgtggtcgcagcttcagtggacttaagcattcctgcctgtcagctctgaaaagagcagtggatctcccagcacagcgctccagctctgctaagggatagactgcctcctcaagtgggttccctgacccctgtgcctcctgactgtgagagacctcccaacagaggtcgacagacacctcgtatgggagagctctggctggcatctggtgggtgcccctctgggacgaagcttccagaggagggaacaggcagcaatcttttctgttcttcagcctctgctggtgatacccaagcaaacagggtctgcagtggacctccagcaaactgcagcagacctgcagaagaggggcctgaccatcagaagaaaaaccaacaaacagcaagcaataacatcaaagtcaataaaaaggatccccacacacagaaaccccatcaaaaggtcatcagcctcaaaggtcaaaggtagataaatccatggagatgaggaaaaaccagcaaaacaatgctgaaaattccaaaaaccagaatgcttcttctcctccaaatgatcacgactcctctccagcaagggcacaaaactggacagagaatgagtttgatgaactgacagaagtaggcttcagaaagtgggtaataacaaactcctctgagctaaaggaagcaatgcaaggaagctaagaaccttgacaaaaggatacaggaattgctaactagaataaccagtttagagaagaacataaatgaccggatggagctgaaaaacacagcatgagaactttgtgaagcatacacaagtatcaatagctgagttgctcaagcagaagaaaggatatcagagattgaagatcaacttaatgaaataaagcgtgaagacaagattacaacaaacagaatgaaaaagaacgaacaaagcctcaaagaaatatgggaccatatgggaagaccaaaggtatgattgactggggtcccttaaagtcatggggagaatggaagcaagttggaaaacacttcaggatattatccaggagaacttccccaacctagcaagacaggccagcattcaaatccagaaatacagagaatgccactaagatactccttgagaatagcaaccccaagacaaataattctcagattctccaaggttgaaacaaaggaaaaaatgttaagggcagccagagagaaagttcagattacctacaaagggtagcccatcagattaacagtgggtctctctgcacaaaccctacaagccagaaaagagtggtgcccaatagtcaacaatcttaaagaaaagattttgcaaaccagaatttcatatccagccaaactaagtttcataagtggaggagaaataaaatcctttacagacaagcaaacgctgaaggattttgtgaccaccaggcttgacttacaagaactcctgaagggagtactaaatatagaaaggaaaaactgataccagccactgcaaaaacatactaaaatataaagaccaacgaaactaagaagaaactgcatcaactaatgtgcaaaatgaccagctagcatcataatgacaggatcaaattcacacataccaatattaacattaaatgtaaatgggctaaatgccccaattcaaagacacagaatggcaagttggatagagtcaagacccattggtgcactgcattcagaagacccatctcatacgcaaagacatgtataggctcaaaataaagggatggaggactatttaccaacaaatggaaagcaaaaaaagcaggggttgcagtcctagtctctgataaaacagacgttaaaccaagaaatatcaaaaaagacaaagaagggcattacataatggtaaagggatcaatgcaacaagaagagctaattatcctaaatatatatgcacccaatacaaaagtgcccagattcataaaaataaattcttagaggcctacaaagagacgtagactccctcacagtaatagtgggagactttaacactccactgtcaatattagacagatcaatgagacagaaaattaacaaggatattcaggacttgaactcacctctggaccaagcagccctagtagatatctacagaactgtccacatcaaatcaacagaatatacatttttatcagcatcacatagcacttactctaaaatcaaccacataattggaagtaaaacactcctcaacaaatgcaaaagaatggatgcaaatgtaaaaaaacagcctcttagaccacagtgtaatcaaattaaaactcaggattaagaaagttactcaaaaccacacaattttgtggaaactgaacaacttgctcctcaatgactcttgggtaagtaacaaaaataaggcagaaacaacaaagttctttgaaaccaatgaaaacagacaacgtaccagaatctctgggagagagctaaagcactatttacagggaaatttatagcaccagatgcccacatcagaaagcaggaaagatctaaaattgacaccctaacatcacaattaaaagaaatagagaagcaagagcaaacaaattcaaaagctagcagaagacaagaaataagtaagatcagagcagaaccgaaggagataaaggcatgaaaaacccttcaaaaaatcattgaatcaaggagctgttcttttgaaaagattaaaaaaatagatagaccactagccagtctaaaaaaggagaaaagagagaaaaatcaaacagacacaataaaaaatgataaaggggatatcaacaccgatcccacagaaataaaaactaccaacagagaatactataagcacctctatgcaaaaacaaaacaaaacaaaaactagaaaatctagaagaaatggataaattcctggacatatacatcctcccaggaggaagaaaatccgtaactaaaccacgaagaagtcaaatcgtgaatagaccaataaaaagttctgaaattgaggcattaattaataccctaccaaccaaaaaaagccaaggaccagacgaattcacagctgaattctaccagaggtacaaataggagctgggaccattccttctgaaactattctaaacaatagatagacaaatgcgatctaattaaactaaagagcttctgcacagcaaaggaaactatcatcagagtgaacaggcaacctgcagaatgggagaaaagttctgcaatctatccatctgacaaagggctaatatccagaatgtacaaagaacttaaacaaatttacaagacaaaaacaatcaacctcatcaaaaagtgtgtgaaggatatgaacaggcacttctccaaaagaagacatttatgcagtcaacaaacatatgaaaaaaagctcatcatcactggtcattagagaaatgcaaatcaaaactacaatgagataccatctcatggcagttataatgacgatcattaaatgtcaggaatcaacagatgctggagaggatgtggagaaataggaacgcttttacactgttggtgggagtgtaaattagttcaatcattgtagaagacagtgtggcgattcctcaaggatctggaactagaaataacatttgacccagcaatcccattactgggtatatatccaaaggattataattcattctactataaagacacatgcacacaaaagtttattgtggcactgttcacaatagcaaagacttggaaccaacccaaatgcccatcaatgatagactggataaagaaaatgtggcaaatatacaccatggaatactatgcattcataaaaaaggatgagttaatgttctttgcagggacatggatgaagatggaaaccatcattctcagcaaactaacacaggaacataataccgaacaccacatgttctcactcataagtgggagttgaacaatgagaacacatggagacagggaggggaacatcacacaccggggcctgtcagggggtgggggactagtggagggataacattaggagaaatatataatgtagatgacaggttgatgggtgcagcaaaacaccatgtcacatgtatacttatgtaacaaacctgcacattctgcacatgtaccccagaatttaatgtacaataataaaaaagataaacaagaaaaaataaataaataaaataaaacagaaaaaaaagagagggactcctccctaactcattttatgagtccagcatcatcctgattccaaaacctggaagagacacaatgagaaaataaaatttcaggccaatatcactgatgaacttcgacgtgaaaatcctcaataaaatactggcaaatggaatccagcagcacatcaaaaagcttatccaccacgaccaatttggctttatccatgggatgcaaagatagttcaacatatgcaaatcaataaacacaatccatcacataaacagaaccaatgacaaaagccacatgattatcccaatagatgcagaaaaggccttcgacgaaattcaacaccgcttcatgctaaaaactctcaataaactaggtgttggtggaacatatatcaaaataataagggctatttatgacaaacccatagccaatatcatattgaatgggcaaaagctgaaagcattccctttgaaaaccgacacaagacaaggatgccctctctcaccactcctgttcaacataatgttggaagttctggctagagcaatcaagcaagagaaagaaataaagggtattcaaataggaagagagaaagtcaagttgtgtctgtttgcagaatacatgattgtatatttagaaaaccccatcgtctcagtccaacaactccttaagctgatatgcaacttcagcaaagtctcaggatacaatatcaatgtgcaaaaatcacaagcattcctatacaccattaacagacaagcagagaggcaaattatgagtgaactcccattgagaattgctacaaagagaataaaatacctaggaatacaatttacaagagatgtgaaggacctcttcaaggagaactacaaaccactgctcaaggaaataagagatgacacaaacaaatggaaaaaaacattccatgctcatggacaggaaaaatcaatattgtgaaaatggccatactgcccaaagaaatttatagattcaatgctattcccatcaatcttccatcgactttcttcacagaactagaaaaaaatactttaaatttcatatgcaacaaaaaaaaggccatatttccaagacagtcctaagcaaaaagaacaaagctggaggcatcatgctacctaacttcaaactatactgcaaggctacacagtaaccaaaacagcatggtactggcatcaaaatagatatatagaccaatggaacacaacaaaggattcagaagtaacaccacacatctacaagcatctgagctttgacaaacatgacaaaaacaagcaatggggaaagaattccctatttaataaatggttttgggaaaactggctagccatatgcagaaaactgaaactggacctcttccttacaccttatacaaaaattaactaaaggtggattaaagacgtaaatgtaaaatttaaaaccataaaaaccctagaagaaaacctaggcaataccattcaggacataggcatgggcaagtacttcatgactaaaacaccaaaagcaattgcaacaaaagccaaaattgacaaatgggatctaatcaaaatgaagagcttctgctcagcaaaagaaactgtcctcagagtgaacaggcaacctacagaatgggagaaaaattttgcaaactatccatctgacaaagggctaatacccagaatctacaaggaagttaaacaaatttacaagaaaaaaacaacctcatcaaaaaatgggcaaagtttatcaacagacacccatcaaaagaagtcatttatgcagccagcaaacatataaaaaaaagctcatcatcactggtcattagagaaatgcaaatccaaaccacaacgagataccatctcatgccagttagaatgatgatcattaaaacgtggaaataatagatgctggcgaggatgcggagaaataggaatgcatttacacttttggtgggagtgtaaattagttcaaccattgtggaagacagtgtggtgattcctcaaggatatagaactagaaataccatttgacccagcaatcccattactaagtatatacccaaatgattataaatcattctactataaagaagcatgcacacgtatgtttattgcagcactatttacaacagcaaagacttgggaccaacccaaatgcccatcaatgataggctggataaagaaactgtggcacatatacaccatggaatattatgcaatcataaaaaagaatgagttcatgtcctttgcagagatgtggatgaagctggaaaccatcatcctcagcaaagcaacataggaacagaaaagcaaacaccacatgttctcactcataagtgggagttgaacagtgtgaacacatggagatagggagggaaatatcacacaccgaggcctgtcgggcagagtggcaggaaggagagggagtgtattaggacaaatacctaatgcatgtggggcttaaaacctgtatgacgggttgataggtgccgcaaaccaccatagtacatgtataccaatgtaacgaacgtttacattcagtacatctatcccagaacttaaagcaaaataaaattaaatttaaaaatttgagacagtttgaacatttaaaatgtgtatttacctttattttcatttatatctaaagattatctatacaatatattttctaattttatttgttctttccctttaaaaattaacaatataactcacatatagttttgcatgaagaaacaaatacaccccaccatgaaagaggatttattaatttcttaattttaagaattttaaaaatcagaattttatgatttctgattttaagttttaaggtctgttttacataaaagtaaggtaggcatcaactggtttctggttagtatttctctcaattttttccatcattttgtttcaataaagacattttatttcatattatctcatgtgaacagtacatacctctattatgattatgtttatttctaatataaatttaggtgggtaatcactggttattgttgtctttttaaaaattactttgatgcacagaagtttttaaacttaattaagttcaataaaccaattaatttgtgccctatctaacaaagtttagtctaatacatggtcatgaagaacctcatcctttggtgtttttttttttttttttttgctccattttattctcaagaagttttataaatttctctttaactctcaggtttatgcttcatgtcaaattaattattgtgtggtttgacgtaggggatatggactcactttttttccatgtgtgttgtgataagatgttcctttgttagttaaattatcttagtgtttctgagggaattcaacagaaatttccccgtggatctatctttgaagtctcctttcctctgtgtgtgtgtgtgtgtgtgtgtgtgtgtgtgtgtgtgtgtgtgtgctcttctagttcatccttatgctatgtattagtcaaggttctctagggggacagaactaataggatagatttatatgaaaaggggagtttattaaggagtattaactcatactatcacagggtcccacagtaggctgtctgcaagctgaggagcaaggaagccagtctgagtcccaaagcaaagaacttggagtccaatgttcgagagcaggaagtatccagcacagaacaaagatgtaggctgggaggctaagcctgtctagcctatttatgtttttctgcctgctttatattttggctgtgctggcagatgattagatggtgcccacctagattaagggtgggtctcccttccccagcccaccaactcaaatgttaatctcctttgacaacaccctcacagacacacccagggtcaatacttgacatccttgaatccaatcaagttgaccctcagtattaagcatcacatgctagtaccacattgccttgatactctagcttgaaagtaactcttgaaatcaggttggtaaaatccttcagatttgctgttatttttgattgcttagctatttgaagtcctttgacgtttcatatcagttttataatcagcttacccatttctacaaaacatttgttaatatcagtaagaagaaaggacatcataaaatattaatttttctatttcataaatattttataactttatttatagggcatattccatttccctctaatcttttttttagttttcagcatagagatcttagccacattttgttaaatgttttctgaagtgttttgagacaattataatcatactttatttcacttttatagtattaatttttagtgtcatgtcttaattagttgttgccatattacagaagcactattggtttctaaaaagttataatgaatcctggaattttgccatatttaacttcttagttctactttttaatttttatagcattccaatgaatagtaatgaggaatgcttatcaaaaccataccattttatttattctatcttcatgttgtatttatttttcttgtcttatttctcaaaaaaattattttttgaaaaaaaaaagctttgcagaaacattggaagttccctttgtactctccctgatttcattctcccatctacctccctatagtttgcctttcagataaagctggtgtgtgtaatcctcaagtttataaaattttaaaattcaatatttttatatttgtaagtattaatacatatagctattgtctattcattttaactagtttttataattccattgtgagactacaccatgatgaatttgtccgttctcttatttaccaggtttagtttcagatttgaagtgaaaattcctgtgtatgtctctctcagtaaatatctgataatttctctaatagacatacctacaagtaacattgctaggttgtggaatatcccttaccatgtgtagtacagacattttgtatttgtaaagtaatttcaaaaactattcactaaaaaagcatattttgtggaccctaacaatcaaccactagactgattttatttctcatctagttaaagagcttaaagtattagtaactggggttttatatactaagaagtatatcaccaggcctcaattagctttatacttactttataataaaaacacctcctagaacatttattaattccctcccaacataattcttataaattaaaacccctattgctaagctttacataactcacatttaaatatagatataaggatatgtttctctggctaagattaataagagcatttgaaatatagactaactgagtctattgtattttgaagggctaacttatgttgccatgtattaaattacttactttgaatcttccaattatattgaaacaccattcttcattcagacagttgatgctgagcagtttacagtggtcaattgctttctcacagtttttttcagtaaatcctgatatacagctgtaaatacatcagtgtaaattagaaaaattataatttaaatgttttcagaaaagcctattaacattattccaaaaggaataaggctttgtttaaattatatggtattattaatcattttttaatacatacctgtgatcttagccaaaaagctcctatttatgtatttggaaagaattacagtaaactacattttcaatgtatgctcttaatgatctcttttgggaatttaagaataaaataaactttggcctaaactgatacttaacaatacagtatatgttttggaaaactagtgaaatatgaagaaaaaacatgacaaatgtgattttttaatgtttagtagagccagtatatactgatgatgtgctagcaggagttaatgatgactacatgaatttgagacaggatagagtgccagtggatgataacggtctagttatagttgggctacttataggacttctgtttgttagttgtcatttttaaaattgtttttcaaacaatctatattccagtctactgtatttcattaactgcaatctataagttgctaaagaacacacactggtgttctggcttccactgccctcacttctaattaatttgtaggaaacagtcctgtgccttaaatcatatttagtaaactttctattataaaataaatgggaccccaaatgaaagaatgttttttctaatgtaaacaccaaatattttaagaccaaaaatatgacttctcatgactttaagttggtagaagctgatttattaatgaagtgaatttaactatgtatttattattttaaatctgttataagaacacaaaataatttcataaaagggatcaaaggccatgttggcacaatttcactgaaatagcatcaataaaatgctttagtaatttacctttcctatagtttgaggcacacagctttgcattttcatcttgcagaattaaattatttctccattcatatcagaaataatcatccactttttttcagcacccaccatatgccagtcactaggctaattacttttacacaattttcttaagttctcattcaattattgtaagttgtgaaatacattattatttatcacttttataaatgaggaaacatacccatggaaattacattagttgctttggccatattacttacaaattttacagtggttaataaaattaagtttgtcctaactttaagtgcattattttactctgctattccatagatgaagacctttatgtattttactctactactccacagatagtaagatatatgtactttacgtctctcattctgaggggctagctagatatccagaaatcactccaaataccaacttaatgaaaggtagcaacccttcctattgaggatgagcatgtaatagcatagagaagaagagaagagctttagcatatcctaaaagttgatgagtttcaattttccttttgagttggaatggactgaattggccaagagcagttaaagacacatgtgactttcgggcttactttgtgttgcagtttccaaagagcaggatcaggtctatgaattgaagaaccaatattcagccactaagaagaatcagacccaaatggtgttgaatgaacactgggcagcagcaactctgagaaagtgtttctaaacagagcaggttttattgatccaaaaaaaaaaaaaaggccaaagattttctactctcagtacacactaggtaagagaccccccaaatactatctgcaatgtgtggctcagagaggtttgacccaaaggcggaggactaatgtgtactaggcttaatacctggatgataaaataatctgcacaacaaatccccatgacccaagtttacctatgtaagaaacatgcgcttgtatccctgaactttaaagttttttttttcaaaaagggaaaactttcctactgagtttcaggcaatcatctccaatcccccactcccagtgatggcttgaaatctaagaagcacttccaagtcttactcataagaaaaatgtcatcctatcaactcagcctgctgtcaaggaaaaagaaagtttcaatagtagccttgacatttaagaatgtaaaacagagaaaacaaaagcaaagtaaacaaaagcaaactctggaacaacatggacctttttaataaatgtgtttacaaaagtgcattaacttctgttgaaatgctcagagagacttatagctaactaatttgagctactctaggtgtccagcagccattttagtcagaggccaattgttttaaatacagggggagagaaaaggaagacctttcagattaccgtgtttctaaaatgtccaatttatagtttgtttttatgtaaaactattttgagactttagggtaagggtaacctcaggattgtgatggaaatatttaaggtgtcattttagtggtaaaatgggaaatgatacataggaaagcagcgaggatctgtgaagatacatgaaagggaaggaaaaaaaataatgaaaataaaatataatagtggaaaagaggagacaaaaacaatactcttatcctcttttactttttccttcctaaaatgatttcttaccactgatttaaatatctttctattattaggtttccttttgccaataaagccaacattcattagttaattagctttatttcttggacatagcattccaaacttgtccagtgacctatggaatgcacactactgattttaatgagaagtgtcaggcactgttgggaacacagcatgaatagagtagggacagcaatatcagaacaaaattccatcaccagcattttggtaaatgttttatgtaatacagaactactagtatttataactgctatttatttttaaagttaatttataagataaaaatcagtgaaacaatatttactacattttaaataggtttcaaaatgtattttttcaaaatattaagaaaagcccataaatttaatataattaaaaataaaatgttcaatattttactaacagtaaaaattattactgtattaaaataataatttcataaagcaaaaaattagaaaaaatattttttaaagagttaacttcaaattggaagtatacttttgcttaaagttttctagctgctgaaatagctttttcaaattctatactattctagtaaatggaaaggagatagttataaactaacttcagatagttttctctgctgtggtaacttgaaatactctcatcacttgtttgtaaacttggaatcaacttttgatacatttttttccaggaaatgaacagttatatttgtaatttttataatgtttaagttgtaatttttgtcttaaagcattgtagttcacatttgtctctttggtttcatcatgcatacatggggattctgatggaaagttacttgtatcagtttcaatgctgtcattgaacctattccgctacttgggcaaaaaaccctttgaagtaaattaagatttattcttataatagaatctttgcaatactattgcatgcttacatactgtgacttgtgtgggcatagacaaatgtccagacctatggactacttcatatgatgaatttatcttttaagcataaactgagcaacaaggtcactgcctggatttcaggaagcaaataattcagatgtaaaagtgatttaaagatgaaaataagaatcttagacaaaaccatctgtatttgataattaaaattaacatgctatacctctatcctagaatatagaaagctagtattaaacctattaaaacagcaactcctctgccttattatacattagtttatggggaagggagagaaaattataaatacatgagtatagtgacagatagggagaggtgctatataattaataaattaaaaccgataaaagtggagggagaaattgagaagaggtatttcaaggctgtgtcaggatcaacaggaaagacatctttgaggagataatatttgagtgaatggctgaaggaagtgtacaaattgctactgtgctgtctgggaaatgtgcacttcagaaaagggaaaggcaaataccaaggattgaagcaagaggtccttgagatattcaggaaacatctcaaagaccaaagtggtgacttagtaggagatggtggcagagagataggcaggaggaaaatatggctcaccttgtaagcatttaaaatactttaggttttattaatgcacgggaaccccctgaatggcattggcagaggaataacatgattttaaaacatatatattcttttttgtggataaaaaatgataaacaagcaaactattttacagttactttacctgtaactttcagcatctaaaataatcacaatctgttttctagtttctcaggtcaaaaactatagagccaatatatttgttctttttctttctcattcaatccgctctaaagaaacattgtattgactccatcttaaatatacatccacaatccaaccccttcttattatgccctctctccaattctaatctaagtcactgtcctacccagtttactatactgtaattactataatagcttattaacaggtctctttgcatgtgcccttgtgtctgtacagtttcctttcaaaacaacagtcacacaacaatttaaaaatataaaccaaataaagtaactcatttgccagcaacactgcaatacttgccattgtacttagagtgaaaatgaaggactttacaaaggcattcatgatctaaagctgccccagattctggtttctcttctaacttcatttctgctacttcccttgctttctccagagcagttagactggactcatgcatggatagggcctgaataggccaaggattttgcaataggtactccctctgccatgaacactcttcccttagacagctgcacattccctcgcatcattcaaatctccgccaaaatattagcttttttgatgagacttccattcactatttgacatgtacctgaatgaaggttcaaaacaatgaggtcaagagggaggctattgaaatgttccagctgagaatttggcttgaacaagggtgttaacattcctaatgataaaagtgttcatatccatgatatgtagttatgggagggtttaaaggatttgttgatggacaagacgtgtcaaaagagagaaaagaagaaatcaaagagtaatgtaaatgaatactggcagaaaagaagctttgttcagggctcagtaatcaattatgaatttggaatacattaagtttgagcttctatattagatatatataaaatggacaagagtttaacggtaggatgagaattaaacaggtttggtgttttcaggtcaatggaacatagaaaaagagaatcaaggaatttgaaagtggatgtgtaagtatgttttttaaaagaaaatggggacctgcagggggtactagacacaggaatgtcaatgtagtcatataattggaggtcctgttgcttttttaaaaatttatgaaattttgtcattacagtacatgagtgagtgaacttgaaatacaggaagtggggatcagagagtgaaagaatttaaattaaaggtatttcagggtgtgcaattacaggcatgataacttataggataagaccatgggagatggactgaggtgaaggagagggggaaattagcaaaataattatcaaaaaatttaaacaaccaaagtgagtggatttccaagagggataccaaagttatcaaaaaatatgaccacagtggtgataaagaaaaggtcagcaaactagatgctaaaacatttagtaaaggataagcagaaactgagagaaaagctactagaaaaggagccagggagagggggagggggagagagagtcagagagagagagaggatacagctgctggctagggttttcagaaggagaagggaaaaaatggtttggatatggcaacaagggcaacgctgtctatacacttcactgcttgtggtacacaactgtagaagaatgaatagtgaccaactcagaaggctacaagaaaaactgtcctcaggtttcagtgagaaaaaaaaaagaaagtgtagaaaaaatattgtgggctgggcatggtggcttatatctgtaatcccagcactttgggaggctgaggcaggaggatcgcttgactccaagagttccagaccagcctgggcaacatagtaagaccccatatccacaatttctttttttcaaaaaattagccaggtgaatagccccagctactcggttacttgggaggctgagatgagaggattgcttgagcccaggaggttgagactgacatgagcttggttcacaacactacatgccagcctgggtgaaaacatgagaccccgtctctaaaaaataaaaaaataaagaaaaaaaaatacattgtggatacttggaaaatattctgtggacaaaatgagatacagagggcacagtggaagaatactggatattaacaaatattggaggttgtgcaaagcattatggggctaaggttcctttaatcaggtatgccaggaagacttaaagatttcatgatgttaattcaaattttatctgcacatgtctgtacttattattttttatatggaaattaatacattgaaggaaggaagaaagtttatactgatgagaacatatgttcttaaatgaggcatttagggggccagattacaggatacctcctgtcccctataacaatattgcagaatgtaaagttgtactaatagtagcaaaagctactcttgatgagaaaatggcaacaatgtcctagatatttttaatagttatatagtttatgaccagaaactgaagttaaaaactatatttaaactttaaaaaacttttccctatgttaaatttcagaatgattgattcaaaaaaaccccattgtctcagcccaaaacctccttaagctgacaagcaacttcagcaaagtctcaggatgcaaaatcaatgtacaaaaatcacaagcattcttatacaccaacaacaggcaaacagagagccaaatcatgggtgaactcccattcacaattgcttcaaagagaataaaatacctaggattccaacttacaagggatgtgaaggacctcttcaaggagaactacaaaccaccgctcaaggaaataaaagaggatacaaacaaatggaagaatattccatgctcatgggtaggaagaatcaatatcatgaaaatggccatactgcccaaggtaatttacagattcaatgccatccccatcaagctaccaatgactttctttacagaattggaaaaaactactttaaagttcatatggaaccaaaaaagagcccgcattgccaagtcaatcctaagccaaaagaacaaagctggaggcatcacgctacctgacttcaaactatactacaaggctatagtaaccaaaacagcatggtactggtaccaaaacagagatatagatcaatggaacagaacagagccctcagaaataacgccgcatatctacaactatctgatctttgacaaacctgagagaaacaagcaatggggaaaggattccctatttaataaatggtgctggggaaactggctagccatatggagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaagcaacaaaatgggagaaaattttcgcaatctactcatctgacaaagggctaatatccagaatctacaatgaactcaaacaaatttacaagaaaacaacaaacaaccccatcaaaaagtgggagaaggatatgaaaagacacttctcaaaagaagacatttgtgcaggcaaaagacacatgaaaaaatgctcaccatcactggccatcagagaaatgcaaatcaaaaccacaatgagataccatctcacaccagttagaatggcaatcattaaaaagtcaggaaacaacaggtaatggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggaatataaatcatgctgctataaagacacatgcacacatatgtttattgcggcattattcacaatagcaaagacttggaactaacccaaatgtccaacaatgatagactggattaagaaaatgtgtcacatatacaccatggaatactatgcagccataaaaaatgatgagttcatgtcctttgtagagacatggatgaaattggaaatcatcattctcagtaaactatggcaagaacaaaaaaccaaacaccacatgttctcactcataggtgggaattgaacaatgagaacacatggacacaggaaggggaacatcacactctggggactgttgtggggtggggggacgggggagggatagcattgggagatatacctaatgctagatgatgagttagtgggtgcagcgcaccagcatggcacatgtatacatacgtaactaacctgtacattgtgcacatgtaccctaaaacttaaaatataatttaaaaaaattagccttataaatgtgactattgatttcaagcaaagaaaaatatagcagcccagcttttgagataattaactccaaaagattaagctttcctgttgaaaattattgagtgaccaagtggaagcattccattaattaatacattcctcatgcaaatatgtgattgctattttaaaaatcatttttcaaaattaataagaaaatataattttattatatgttgaaatatgtcaacctatgcatttctgcaaatgcagtgtcttatttcatagtcacagtgcatacttagttagttatatttgtgacataaactgaaaaccttagttatatttgtgacataaactgaaaaccttaactttacccatgactgatgtggtgagatttatcacaagccaaataaaataaatgctgaagctgacttggggatgggggtgggggaagttatgttaatacatcaaattgaaatttaagtagtgtaagttataataatctaaatccagtgagtagaaaacaaaaaaaaacacaataagctgagaatataaaagagaatatcattatcgttgaaatatctcagaattttggaggagaaaataaaaggcttagaaagcaaaattctctatatcacaacatttctgatttttaaaaacatagtattcatatttctctaatatttagtcagtggcatattttacaaagttttctcccaattaatttggttaaatagttgattttcagacttgaaaaatttttatgagaaagacaccagctggtttaacaaaactttatttcctggctcatttcctcattttactctaaatagtaaaaatttgatcctcctgatatgttgagaatattggagtcattgcattcagtaaaaattagtgtgtgtgtatgtgcgcacgtgtgtgtgtgtgtgtgtgcaaaatggcagtattaataatgtagttcatgataatcttcaaagccattaagtgattttggtgaataaacactttctactctacaaaagtgggaagtatggtggagaattcagaaacctacatgtcaggtcacaatgactttcccttctctactcatgaacctccatccaagaggtgatcagagaccctaggaagcatcagtggagctgtgtcctgtagcgccgtggacactgccacctgtgtaagtgaagtgcagcacagagtcctgtagctgtagcactgcctttggagaaatttccaaatgtctatcgagctctgtgagctcctgagagaacccagcactattaactttatgccaacactcacaatcaacccactatgatctacctttgaggccattaaaattaatccctttttaccattacctcagatatcccaggaagccagtggtttccaagtcatccctcactgtgtggttcttttcccccaagcagctctgtacacttctttcatattcttcttaggaatctctttcctttgactgtaaactctcaagtggtggttattctttctccctcttctctcacagcccaatgtctacatgttgtatagttgtcttcatcttttcctcatgtcccgtcctcttccttaaaagctttacttatttcaagatgatgccatcaaaccatgctacccatatcttctcctgtcatagtcatagccaaccttcctgagcatcccctctaattctttaacatttaacctctgacatgttatatctttctctaatgtaatcccaaccttactttatttgtttgtctgtctgttttgagacagagtttcgctcttgtggcccaggccggagtgcaatggcgcgatcttagctcaccgcaacctctgcctcccagattctattgattctcctgcctcagcctcccaagtagctaggattaaaggcatgcgccaccatgcccggctaattttgtatttttagtagagatggggtttctccatgttggtcaagctggtcttgaactcccaacctcaggtgatcctcccgtctcagcctcccaaagtgctgggattacaggcgtgagccactgcgcccagcaatctcaaccttactttgctatttttttccaactttatcgaagcataattgacaaagttgtacaaatttaaagtgtaaagtgtgataatgacttggtatattatatagtgtgaaatgattatccttagttaacatatctgtcaccttgcacagttatcatttgtatatgtgggggatagcaggtaagatctattctcttagcaaatttcaagtatgcaatgcctcatttttagctatagtcattaccttgaacattaattccccagaagttattcatctttttcgtctttatttttttattgataaatactgtttgtacatatttatgagatacacgtgatgttttgtttcatgctgagaatgtgtgataatcaagtcagatttagggcatccatcacttcaagtatttactatttctatgtcttggaaacatttcaagttctcccttctaactctactgaaatatacaatattataaccctttgaacaccccccatttctctcaaccccaattgcctgaaaaccagtattctgtttctatgactttgacttttaaaaattttacatattagttagatgatacagtgtttgtctttatctggctgattcatttcacttagcataatgccctcaacattcatccatgctgccgcagatgacaaaatttccttctttatgtggctgtgtaatattacatgcatacacatgcaaacacatcacatcctctttatcacaatagccaaggcatggagaacacctaagtgccttcattatttcaatatctgcaaagtttatttatttgcaacattagcatctcctaggagcatactgtctcaactcaaagatctgaatcttccctctaactctacaatctactcctactctagtatgctctatactaccataatatataactacatcatcttctcaatgttaacttacataatcttaatgttaagtattttatattctatgcacggcctcatttctctttctaatttactccttgtagtccttttctcccccaacgtttattccatcccacaatccattgaccctaccaatcttcagtgtctgtcatccccatcatactctctgttgcctccttgtgtgaattagattacaccttttacttctataatcactaattgcatacacccttaaatcactctttcccctccattgtcatagcctgataaagctcgaccctactttaattcaacaccctagctatttctgacgggtatatgagtaaattacacttggtttgagattgacacatattattgtaggctgaacttactttaaatccatgttcgctaacttcaaggagatgctgtagcatatcagtaatactctattttcctcatactcacttggattactatttcattagacatttttgcttatttcacttgagtaacagagccatcagaagacactttccaaatgattcaacaaccacacattcaaagcaacctattctattttttcttctattacaattcatttaacatctgccatcctatctaagctaactcttctgcttgtgccctatatcccaacccatttctactactatctaaatataaactattttgaactttccttagttgccagtttattagcttctctaataattgtctgtatttttatcatcctaactcatggagtccttttaaatctcatgttctaatccattaactccctcaaatatgagtgtcccaagtctcagtcgaaaaccttctcatgttcctatctgggttcaatgtgaggtaatttcattgagtttcctgttgtatttttattttttctaagctaacctcttttatttatttatttattttacatttagagactacaagtgcagttttttgtttgtttgcttgttttttgttattttaacatgggtatattacatagcggtgaagtctgggcttttagtgtacccataacccgaatagtgaacattttacccaatagttcatatttcattcttacaccctctcccaccatcccaccttttagagtctccaatatctattattttaccctgtatgtcaatgtgtacccattgtctagtttccacttataagtgaaaagattaggttttttactttctggttccgagtcatttcacttatgataatggtctccagttccatccgtgctactgcaaagacatgattttattattttgggtggctaagttgtatttcatggtgtgtgtgtgtgtgtgtgtgtgtgtgtgtgtgtgtgtgtgtgtgtgtatcatgtttttaatccagtcatccattgatggacacttaggctgattccatgactttgctattgtgaattgtactgtgataaacatatgagtgcaggtgctattttgatataatgattccttttcttttggctagatatccagtagtagcattgctggataaaatggtaattctatttttagctctttgagaaatcttcatactgttttctatagagatgtactaatttatttttctatcaacagtgtgtaagcatacccttctctctgcatccttgccaacatctgttgtttcttgactttttagtaataaccattctgactggtgtaaaatggcatctcactgtggttttaatttgtatttatctgatgattaaagatgttgagcattttttatatgttttttggctgcttttatatcttcttttaaaaaatatttgttcatgccttttgctgactttttagtggggttatttgattttttccttgcagaggtgtttgagtttcttgtagattctgaatactagccttttgatgtatgttttccttgaaaatgtttctcctattctatagtttgtctgtttactctggtgacttaaaattatactaaaaggttatagtaaccaaaacagcatggtattgatatataaaaatagacacatagattaatgaaacagaatagagaaccacatacctacaacaaattgatctttgaaaaagtcaacaaaaatatacattggggaaagaacatcctattcaataaatagtgctgggaaaaataaagaattatatgcagaagaataaaactagacccctatcttttaccatattcaaaaattaactcaagttagattaaaaacttaagacctgtcattttaaaaatcctagaaaaaaaaactaggagaaactcttccagacattggcctaggcaaagaattaatgactaagttctcaaaaggaaatgcaacaaaacaaaaatagacaaaaattgaatataattaaactaaaaggtttctgcacagcaagtttcctggttttaaatgtcatgtctctggcactggcttccaaatttatatatttagcccgatagcttctctaaaatggaaacatacttgatatctacttcaatatctctacttggctctattaggtgtcttgtctaacatgttcaaaactgacatcttgttttacactcctgccaaccaggcccttctttctacagatttttccattttggaaatggtattagaaaactgttaaggtttatttcccaacctttcaattgagcaaacaaccttagagttacccttgacttatttctgttacctcacatctaatccttcagcaaaagattgaactattcttagaaatatattccagatctgatccttaattaccaccatcgcgagtcatcttgatggcagtgtcagtcaccaccaactctgggctacatactcatagtagctttctagctggtctcccttcccttgggaacatacacctacactctatttaataaaattgagtcagagtgatcatttaaagcagtatctgcctactggaatgtaagtttctaatgaaaagagctttttttctttttaatttgtttggccttttttatggttgcagaagagttttacttagagtaggaaagtttctgaaaaatatataaatattctttaaattaaacaaattagtcatttcatgtcaccgcccaagtcaagaccttccatttcaatcagtaagatccaaaatcattattataaacaaattatataatgaatcaaataaattagttagaaaatattctatacatagcatagtaaaataatttagaaatacagacatgaataaaacacattcttcttgaatatcttacagtagagtagaatttcttagtaattcaaaatcattttcatagtcagcaatattacagaaatatttgattttcttttagtagataactaataattgagtgagcaataaaactacttgtatggctgaagattaaccatttaaaatatgtgagcaatctaactcagtggtttgtaaagaagttcagtatatttacgtggaaagttttcagttgtaaataacataatcctaactcaaacagactaaaccaatgcagggaattattggctcatattgttaaactgtctataggtagttctttcttcataaacaatttgatcattgttctggctctccttttaatcctttcagctctatatctgttttggctttgtctccttgctggacttcatggttgcaaaatgacctccagttgcccaattacatgctgcaatacaatttcttagtgttactgtagagtgtgactttcatttccctttaaaacctctagtaggagtttcagtgttaatcttaagtgcagactttcttccaaatggttcaagtatcaacatgcaaaagtgccaaatataccttgaaaaaatttacctgctagggccaaacaagcaagtagggggtaaaaaagttatttcacttttgtagacggaaagcagtaatgctggagaagagtgagaggaattctctaggaattcctagtatttggatggctaaaccaccacccaaatactggtcaagtatcctttttaaaatatttgtttctttttttgcagttgctgtatttcacaaactccattttattttcaaataattttccaaagtattcacataaacaatcaaaccattcttctataatttaagagagtcaccaaagttgtattctatctgtctgatacctccaagacatcaattattccttttcctttcctatcagactctacttgtgtgctacctgctcccagcattgccacttttgatactttacaactccttctgctcataataataacatttttatgctaacttcccatagacacctaaagctttcagtcttctaggtggtaaggaattttctgatttttaactactggagaaaattaatttctttctaactgtattgctttaagttactaggtaccaaataaaaatttccataaccaatgtttcactgtctttctcagggaggtaattttgtttcagtttctctctcatctacccatataaatttagatctatagcatatgttcaggtagggaaactaatatcatcataatcactctattcttctcctttccacatttgactccttttcaccttgacacattttttttctcccaaattcagaagagtaaaacttcagtagaagagtagttaaactagttggaaggtataagacaatttccctcattgaagctgtttaaggccaagctcatcttgactaatagttctcaaagtatggtgtctccagatcaggacaatcagcatcacttacgacttgattggaaatgtacatttgcaatcctcatcccagatctattaaattataaacactagagacaaggaacaaccatttgtactttagctcttcaagaagttctaatttcaaagtgttagagtcactgacctaggaaaacatacctcataagttagtaacacacagataaatccttaacataaaagcactgaagtcaagtcgtttttatttttattattatattcactgatattctttgactcatatgagaacagaaaaatagatttcaagattaatttcctgtcatttttttcaacttcatacttaattaatatttattatatctctattatttcacctgagtcagagttagcaatttttttttaatcagtcagttttatgtttggggaggagatgtatttgtttttttttttaagttgatcacttttctaagtacattcactaatctactagcacattgaggcatagaaatagaattgtaaattaaaagtaaatatttttaaagggatagtattcaggtttattgatgaattaatatacaattgaaggcatgcaaaaatttgacagaatggattacagttttcaatatcttgatataatgataaggtttattgtcagttcttttgaaaaagtcacatttcaaaaggttaatttaaaaaaaatctttaaatttggattcctttgaaatagattaaagtatcatacagtgtgaagtggatgcatattctaagtttcttttcagtgtgttccaaggctattctgtaccccacatgttaattttctgcctttatgaatattctaaaattttgaggctacttactgcttttcaataatgcccaacagaatttacttgaagcagtcagataaaagtcaggcaagtgtgaagagtataaattgtatttcttaatgatgtgagaaaatgtctataaagctatttaaaattgactaaattatacacccagattcttgggtcacttctgccatttataaatgagtaatctgtggcaaattattacttaaagaaagaatgaattcctaaaagtctgcctaaagaccctaactaatatctatctgctgaggtttgtgaaacacaggaagaaatattctattattttaaaatatttcaatattatatatgtataacaaaaataatactatggagacatatctctctcttttctttctagatcttcaattattatttgattatattaaaacctccattattaaacaaagtattttttaataaccgtatacctaaattatgcttgagaatttctcaatttctcaaatatttattttaaattaataccacaacaattaacccaaaacatgcaaaaaaaatttactttaacttcaaatagaatattatataccattaagtaaaagttagggttaaaaccagaacatcattatatttttgttcacatgatttaaaaatccatgtactttgtattaaaaataaacagaaaattaattatacctgcaaggataatctttctcacatttcttacatgtagcattattcctcaaaggaaatgactcacatgatgtttgaatgctcttacaaagcaaatctgtaaatattggtgaacagatgcacataacatcctaggaaagattaaaaaaatatttttacaaagtattatggatatttcaaaggtaatgaatgggttcttacctggagaagggttaaaattattttcatgaacttggagtagaaattatctgtcagcaatgtggcagattctattttccaaaatgtcacaacaccatctcccatctcacacactcttcctgctatgtgaaatcaaagctcctctattaagagttagcaactatattcccttcctcttgaatgtaagcaagattgtgatcatggagacaatgatgctttaaaggccatatagattctatctaattatcttagaatgcttgctctttgaacccagccaccatgctctcaggaagcgcaggccacatggagaaatcatgtttaggattgtggctaataggcccagttctgggccaagctaacagccaacatttactaccagacatatgaataagaaaaccttcaagatgaagtccaagtctagacactttccgatggcaacctcagagggactctaaacaatatcctagctgagacaagtcagctcacagtaccataagagataataataaaataattattttaagccaccaagttttggggtgactatgcatagaaaataaaccattggcacctgaaacaagtccatgcatccatgggcaggtaaaaataaaatgaaattaaatttgctgggcaaaagttaatttcacctgcattcaaaatacaacctaatcatcatatttcttcctcttgctgtcctccttattttttcctctcttttttctttgttatccttatcatcatcatcattaccatcattttcattatcatatttatctgaacaacaagatttattaagattccaaggtaaaaagcccgtatacttaaaattgatgatttttttattctcattgaatccaatcaaaatttatttaatttaacccaaaactaacgttgaaagaggtatatagcttgcccaacctcatacatggtagcagtacaaatgataacatgtacaattttccaagtaatttatctacaaaataattcttctaatgaataatagagaatattaaataatgagaatattaaatagagaatataaataatgaataatagagaagaaaaatagaattaaagtacttctatgaattaatagttaagcatacatccactaaaagtcgcttcttatattaagattcttttaactagtaaagttataacatgtgttcaattgttcattattgtcaactttaaaagcaaaacattttaaacgatactattaatagttcttgatagattattgtattagttttctatttatataacaactttttatttaaatagcaaattcttacaaacttagtagcttgaagcaacaacaacaacaaaaaatcattatcttagagttccagaggtcataagtctgaaaagtttcagaaggctaaaaccaagatgtctgctgtgtcccttctgtaggctctacaggaaaatgttcccctgacttttctagcttattctagaggatgcattcattttttcatttatggtcccttcctccatctttaaaaccagcctcattacatcatcaaatccccctttgactctgattcttccatctctctcttccactttaaaggacccttgtgattacactggatccacccaaataatccaagataacatcagctgattagcagcctttgttccatctgcaatcttaatttcctcttgctgggtaacataacacatgcacatattcccaggattagtgcatggacatttttatttattttatttttattttattttttggtggaggatgaggggcatacatagtctgcttactacaataatagtttccttgatttttagaagaagcatgtattattgctctttgcccttgtatctccaaatatttgggtctagtatatggtacattggtaacaaatctttgtatattgtagaagaaatatcaggtggagtaaaaaatgttcttctataaacttttatctgtatattatgttctatataatataactaattcttctcagcaaaagttcagcaatttttttgataaaatggacaattctccaggggaaaaaaaattccttttcagagtgttagtaacaaaaagtttaggaggttggaaaaataatctcttaaggttctttaaagaattaatgacaaatatgaatctaaaatgaaaagacagtaatttgtgagaagagctaatgaaatatttcctactcttatttatttaaatgttaaattgaaaagttaaagtaaaacaatattgaataactaaaagatgaaaaaaagcaataagtagaaatgaagagtgtacaaatttatattcttttaaaagggaaaatactgatggaagagcaaagttttttcctatataaataggaaaaattaaaataagtagaccgttcttgttcgtctgagtttaacaattaaactaccttaataaggattctaattatttattcttttcaaattgcttggtaatagtaaaaaaaatttaaaaccactcacttatatgttagattgagacttacatttgatattttgatgcagtcagtaccattctgacatggtactaatgaaaactcactgacatcagtttcaccattttggctggaagatccttttgggcattcataagtataagcagaactgctatttgggcaaattcctcttttccaaaaaagcagagaaacacaaggttttgctgacacctcacagaatggaccttaaaaaaatcacacacaagaaaaaaaaagaaaaggaaggaaggaaagaagaaatgagcatagatatgtagcaaaacattctagaaaatttctctagagtttatgaaatatttttatttaacaaatgtattgcagtgtaagttatatattataaaattcattcattgcaattctacagtaacttttgcaaatgtatagagctactcaagcatcatcacaatacagttttagcacaattccattacccaaagaagagctcttttgtagtcaatctttgtacccaagcccagttccaggcatttcattagaaaggtatgatggagtatttggtcttttgcgactggcttcttttgcatagcaattttttttaaagaattttcacgttgtatcatatatcagtagttggtactttatattgctaaagagtaattcacaatatatacattttgttaatccattcatccttcagtggacatctgttttcagtttttggttctcatgaatcatgaattcatatacaattattcgaaggaatatgctttttttatatttcttgaaaagaatcccaggagtggaattgctggattttatggaaaattcatgtttaatattttaggaaactgctaaactgtttttcaaagtagctgtgccattttaacattcccaccagtgatgtgtcagatttatgtttctccacattcttgccaacatttgatattgtccgttttctttattatagtcattctagtaaatgtacaatggtatctcactgaggcttaaattttcattcactaatgactaattatttttagcatcttctggtatgtgtattaatcatttgtatatcttcaaaaatgaaatgtctttttaaatctattaactatttttaaattgtgttatcagctttcttatgattgagagcattttttgagtgagttctttgtatatattgaataaaagtcctttatgatatacgtgatttggctttccattttctcacttgttgacatttggatagcaaaagtttttatttcatgaaatccaatttttctacttttcctttaattaagtccattttgtcatttttatgtcatatattttggtatcatataattggtgtctaataatattttgcctaacccaaggtcatgaagacattttaatatattttataattttagctcctatgtttagattcctaatccatttgagtttattttttatatggtgtgggataacgacttagcttatatgtttcacatatacacatacaattgttatgacacttttttcttttaagactgtccttccctcatttctttgtttgtttgtttaaaaactgttaaaactgacctattatatgcctttttatgtgcaataaagttgcacatagatatgcaagaaagttgatttctggcatatctatttttttcctgatttatatgcctttttatgtgcaataacccattgaccagataaatacataatgcatatagctatatagtaggttttgaaattgggtagtcattcaacctttccatctttttttccaaaaatatttttggctatgctatggattctttttatagtttcctataaatttttctatgagcttgtcaatttctacacagaagcctgctggaatattataggaattttattaaatcaatagataaaattgggaaaaatttccatcccaacaagattgaattccaatcgatgaatatgcaatgtatctccatttctttggctattcttgcatttctctcagcattgttgcatagctttatgttaaagtcttgcatttatttgttaaattcatatctaagcattttgaaggtcatgtaactagacttgctttcttaattttatttttgaattttatttttattcatttatttttttcagtcatagtctcgctgtgttgcccaggctggagtgcagtggcatgatctcagctcatcacaacctccagctcctgcattcaagtgattctcctgcctcaacctcccaagtagctgggactacaggcatgcatcaccatgcccagataatttttgtatttttagtagagatggggtttcattatgttggccaggctggtctcgaactcctgacctcatgatctgcccgtctcggcctcccaaagtgctgggattacaggcgtgagccactatgcccggccttgaagtattgtttttaatatacagaaaggcaaattacttgtatatgttagcttgtagtctgaaaacggtataaacccatttactagtgctagtagttctttggggggattccttaggattttctacatattagatcatgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgctttttatcaggctgagggattgtgtttctatttctaatttgttgagagtttttataatgaataggtgttagattttgtgatatgtttttcctgcaactattgagatgattatgtaggctttgtcctttattatattaatatggtatattacattaattgactttcagatatcaaacttatcttgaatcctggggaaaaaatcgtactttatcaggatagaaaaaaatatgtttatatgtgattggattcaatttgcttatattttggtggagattttctatctttattcataagtgatattggtctttagttttcttgtggcagctttgtctttggttttggtatgagggtaatactggcctgatagcatgacttcaaaagtgttcctttctcttctcttttttccttttctcttcttttaagagattagtgccagttatcgaggattggtactaatctcttaaatatctggcaggtctatatgaattttccatttcttcttgagtcactgttagtaatttacatatatttaagaatttattcatttcctctaagtcgtcacatttgttggcctaatgttgttcataatatctccttataatcttttaaagtttgagcggtcattaatgagtcctcacttccaatgcttattttatttacttgtgtctttccttgtattttttccttgttcattccgactaaagatttgtccatttcgttttcctcaaaaatcaatttttttgtttcattgattttctctaagaagttttaatgatttctgtgcaaatcttactgtcctcttttgtttgtatgctttgcatttaatgtggtttttttccatttatttaaggctgaagcttaaaatattgatttgagagttctttttctggtgtagaaacttggaactataagcactgttataagtacttaagcacagtataagcactgttttagctaagcactgtcttagctacatttcataatttttcatatggttccatgttatttttttcttctttactctcaggttatttcagaaatatgttgtttataataatttccagatatgtgaagatttctagaaacaattctgttgttaatttctaattagttttgtgagggttgaggaacatatatgatatgatttgtattcctttagatttattaagactaattttcttgccatgcctatttgtcaatacactatcaacagcagagttgtacagtgaggtttggcacttgaagggatgtgaaagcaagtgcctctttaaacttgatttcctaggcaagtcacttgcctccccttagtccccaccctactaagattatgcaaatagagttaacaaactagtattattaaggcccaagcctggggtacccactgcagcttgtatagaacttggatcagcaggtgtttcacttcacagttaacaaatacttgtcaatctgttcaatgtgctgtcattaggcacaccatagtgacattaaaacgtaactgcagtagtaggctgacaggccttgccatctctgtgaacttctagattttgaaaacaaattttactcttttactcctcttaccttgagtaaggctttggacaattgatacatgttagaaaaaactgaaaagggagacatctgactcctagctaaaaatgatatacgtggactttgaaaattaaggtattcgtacttcaagtttataaccattttcatccaaatcactatatagtgcaagagtttttagtaaacaacatatttattgaaaaatttcttatatccaactcatttattactatgtgaagaggagcatcaagaaatacttatctacaaaatattaagttacttagtgacaacttactagccagaaaacactgcttagattatataatattaactcatttggattttggattgtgtcagtttgtaaaacagacagtcataaaggcagtataaaatgttcagtgaccacaccattgacattattatttgaaaacaactcaacctttaatttgtggatatttattaatatataagcatttattttgatcatacaaagagtaaatatgtatttctccatgttatgatacattaacataatgttttccttttaaataatcaaatattgatatttgattagatgtttagtggtacttaattagacataaatattatttgaaattatagtaaaacattgtttgaatgatactaccttataagtatgtaattcttggcatttccatagtgcttacatccataaagatttgataaaattcttaaaacaaaacctgaaatttatagaggtctattcttacccagttttattttagttgacacattgtaatggtacatatttattgagtataatttgacattttgaaacatacccatgtggtataatgatccaatcgggatagttagtatatctatcacctcatgcctttatcatttattcgtggcaagaacattcaaaaccatctcttctagccgttttgtaatatatagcaccttacttaagcatagtcactctgtgcaatcaaacagcaatacttcttcttcttatctcattgtactttgtacctgttgacaaacctctacccattttccctcttccttcccctccccagtctctagtaaccactgtcctacttctatgatactagctttttttttttttttttagatttcacttatgagtgagatcatgaagtttttgcagtttttgtgtttctgtgtctggcctatttcaattaacatgatgtatatctccaaaaggaattgaagtcagtataccaaagagatatttttaccccctgtttattgcagcatgatttataatagccaaaaaatggaatcaacctaagtgttcaacaatggaagaatggataaagaaaatgttaactatatacaaaatagtatactattcagccatataaaataattaaattctgctatttgtgagaaggatggaaatggtggatattatgttaagtaaaataaatgagttttatattttcattttattttatttaaaagaaactaatttttctagatgttaagcaatttgccacatgtcacacatctggttaattaatggaagattgataattttaaaaactgcataccacctaatcccataataattccatgctcttttcacagcaatacttgcccagattaattctgtacaaaaaatagaagactcaaataccatttgattgttagtactagaccaatatttctactctcagataaaatgttgttcaacatcacatgttgaatataaaaatatacaaaaacaaatgcattttatttggcttcttccagaaacaaacaaaattctcccaatgtataaatatatcctgtgtgtatatttgtcatggcagtttccaaagtaatccattgggtaacatagtaaacagtgaaatgtgtgatttttcacatttcattttgaaatagtaatagattcatagaaaattacaaagttaataccaggaaatcctgagtatgtttacatcttatgtaactataacactatatcaaactagaaaattggcattagcataatatttgggtatagttctatgtcatttcatcacatgtgtagattgaggtaatcaccactataaaaatgtgaaccattccatgattacaaagatctctctcatgctaccccgttataatcttacccacttctctgccctctaccatttcctgatcactgacaaccatcgattttctccatctctatagttgaactattttgataatgttctttaaatgaaaccatacaatatgtaactttttggaattgtcttttttgtccctcttgttataatgcccttgagatacattaaagctcttatgtgcaccaatacgtctttttttttttttcggttaattggtaaatagtagtatctggtatgaatgtaccacagtttgtttaaccattcacttattgaaggacacttttattgtttccagtttttcactattacaaattgctagggactgaaaatttgtgtcccccacatattatgttgaaacctaatcctcaatacaatagatttggggtgggaattttgggatgtaattagattatgacagtggagctctcatgtataagattagtacccttataataatcagatagcttgctatccctctctcagctctttaccatgtgaggatacaacaaaaagacagccattgacaaaccatgaagtgtgccttaccaggcaacagatcttctgagaccttgatctctattgcccagccttcaggactgtgataaataaatgtttaagccacttaatctgtgttaatttgttatagtagcctaaactgactaagacacaaataaagctaccacgaatattaatatataggcttcagtgtgaaagtaaatttttatcctactaggatttgctgggtcatatggttaaggcatgtatagtttttaaagaaactgtcaaattgttttccaaagtggctgtactagtttacattttccacagcaatgtataagagatttagttactcctcatatgcaccagcatttcgtgttatcatttttttattttagctattttaataggtatgtagcaacatattattgtggccttaatttgcatttatctcatggtcagtgacattgaacatcttttcatgtacttatttgctatccttatagcttcttcagtgaattttctccttgtattttttgtctattatttattgagatttttggattttcatggtattgagttttgagatgactttctgttatctatatatgagtcctttgtcatatatgtggtttgcaagcctatcacttgtcttttaatcttcttaacatggtatttctagaaaaaaatagtttatttttatgaacactgatttatctatttagtttttcttttatgagttgtgcttttagtgccatatctaagagctcttgcagtgatccatcctcataagcttgaccccaagatttcaaaatggggagaactgctttttctgaggtgaaagcattttgttgtgcacattttaagatgtgattttctgtgccttggatttttaatttacctgatcccatcacttctcaatttccccagaatccctgaataaaaagtctgataatggtctccatgttatgcttcagaaacaccatatttgtttattttaatggaatgtttgatgaaaagaaaatgatcatatatgcctagacccccaaattaagatatcagactttttcttatgtaaaatattcttcatcacagctatgaagcaattaaaataatactttaattaatttagaataatgtgtctattgacactgattatatgtcaagaaatattctatatacttggattatagcaatgtacaaaatagattttgacctcatgaagtcatgaatttacaaggaaatagaacacatttaaaatacatataatcaattaattatatagtacatttactagtaataaatgatgttaagaaaaataaatcagtaaaaggatttctaagaagagtacttaagagagggggcacattgtgcagcctcaaagatgcaaggaatatctaagatttatagaaataatggaatgagtcctgtggataggttgtttaagagcaaagtgggccaggtgctgtggctcacacctataatcccagcactttgggaggctgaggcgcaccgatcatgaggtcaggagttcgagaccagcctggccaatatggtgaaacccgtctctactaaaatacaaaaattagccagacatggtggcaggcacctgtaacccctgctactcggaaggctgaggcagaagaattgctagaacccaggaggcagagcttgcagtgagccgagattgcgccactgcactccagtatgggcgacagagggagactttgtcttaaaaaaaaaaggaataatgtgaacaccaacttcccacatcttgttgtatttacatttttcagttcagataatgttctaaaataatatattatataaggatttgtgtatataatttgttgccttcatttaaatataagctctacttgggcaggtaattctgtttgttttgttggctgatttattacaagcaaatagaatgctgctaccccacaatagattctcaataaatatttggtgaaaaaacaagtaaatgaataaataaagagcatatcaacagagaaaacagcaaatgcaaagactttgagttgagagcatgcttaggtattcaagaaacagaacgaaagctaagagactgagtcaacaattgtatgggtatggagatgagctcagacgaggatgtaataaactatttcaggaattctggcatttactgcttttagattctatggaaagattatggagcattttgttctaaatagtggcatgatttcacattttcaaaatatttcttcacaagtagcctgtagatgtccaagaaggaaagcagagagacaagattttagactactgcagtattgcagtaatggaattatagagactggattaggatgctagtgaagaagacagtgagaaaaaaatcatgctctaaatatattttgaaagtacagtcatctacatttgttgatggatttaaagtgaaggaaaaggaaaaggaagatttaatcttttttttttatgtaagtaaccagaaagaaaggattaatcttttctaagataaggaaaaagaatttaagggaagaaatcagaatcacttttagatatgttaatttcaagatatttattacacatccaagtgaggttggtttataggcagttaattagagtgatctgcagtttccggggtgaggtcataagtgaagataaatatttgagatttgcctgtatgaggatagtatttaaagccaagagaacaggtatgatcctttagggaaaaaatggagagagagatgacaacactgatatttaatgttactatagcagagttgtgctatcaatgtatagaatgtgcacttcagtgtatagaaaatataaagatgggaaggtacctgaaaagttattaagaaagaacaaccaaggaagggggaatgtaggagaaacaagagtgtgatgttttaaaaatacaaaatttgtcaaatactgcaaatggtttataaaagatgaagaattagactgaattaattaaagattaaatttagcaatggcgatttaataaacattagtagaactgtttctatggtatagtggggataaacattagttgcataggttcaagaggaaatgagaagaataaaaatggaaagaggtagtatataattcctggcaattcaaaggatggtcccttaaccagtagaatcaagatttcacctggtatctcattagaaatgcactccagaccaactgaaggcaaatccaatttaaccaagagtcccacatgattcatatgtaaataaaaatttgtgaagcattgatccaaatatctcttctgagttgtatgaagtacagtggtatgaagtagcaactagggaggtcttagaggttgtcaggtcatatttgtgaacagatgggatgcttaactagagaaagaaaattgataatgaatgcaataaaggggacagattctagattaatgtctataggtaaggtagagtgacacatggaatcccgcccaccggtaaagggattatcaggtaagagacatcaatataacaggagaaaagacaaaaatagatgggcaaagaatcaagttaactggtggcatccaggcagagcctggagatctctttttctgattgtttctgctgtttactaaaatatgaagcaaagacaaaaatgaagtctaatgaaaggggtggaagtttgagcaaggaagagacgtaataaatggttgcttagcatattgagagaaaaaaatgcacacattagaaaaacctatcaaaatttatgggcagtgtctacgaactccttgcaattagtgaatatatgagaccaggtagcatggttccatgtatattttactgcaaacaaattaataagtagagataaatttaacaggtttgtaattttgcagggggttacaacgcgaggagagaggaacaagaaattgagaatgtgaaaaagtggtagtaatgacacaccatataatttaattgcacaagaagagaaaggcatcacaaggaggaaataatgaaagtatggtaaaggctcaatagtctttgttgtttgagggaatgaaaaaccaacagaatttggaatcctagaaggaacaaatttgaaaaatgagacagggttatattcttggagtagaatgcttaaaagtttatctaaatacaaaaaatacatagtgtgggtttgctataagagtacagtacatttttcatagtaatagtaagtgtggcataaataaggagccatttattaaaagatgttcatgataaagaaacaattctccaagtgtaagttattatcatttttatctcaaaaaagtctctatctctctctcatacacacacatgtacaaacatacagacataacccaaataatttgaagtaaaatatttaagcagcaacgctattaaaattatctaagtaatttttattttagtagaaatcataatggggcttctataaaacaaactagctctgctatcctaacaatgtgcatatatccataaaaaaatcacaatgaataaaagattattttagaccattatgttttattacaatttcagtaaattcttttggtcagtcctctgatgaagtgtcaaaaatttccgaagcaattctgtgtaaaataacgcactgcagttagttgagtattttattcactcaagttcgttttagtctactttcctgtaagaatgaagctattatactcttaggataggcaacacaaagacatcaccaagtaggatgataatttgcctttcatttctatggggagagaaagaaatggttgctaggagctctgttcaagaacttgaaaagtgacagaagaaataaatacaagaaaattgaagaaagacagctaacttgtttacctatgtttgattacatttttaagagtttgccaagacaaagaattgctccaaaataagaaagaacatttaatgaaaatactcagttattcatccatggtaaaagtaattatgtaaaaagttgctagtttggcatttcagataaacaaaataattattttaagttattcattgtaaagctgtagtagtattcattgtagtagtattcattgtaaagttgtagtaaaattgcaatctaaacatgtacaaaaattcacacaaataaatttatagtggtcaaaaataccaataacaaaatataatttatcaaaaaaaatcagagaattaacctccaaaaacacattgagcctaatttaccttaacaaataccatttaagtaaagttattatcttgttattaattcagttttggccatgcaggatatgaaagtttagcagttaaaagtactgactttgctaagtttctaatgtgtgactctcaccactcagctcttccacttaaattactaggattgagcacacaacctattgcaaggagattaaaacccaatatattcctccattgtatggatctgcaattttttttctctaaagaagcagatagtaattattttgggctttgtgggccatcaggtctcttggattattcaactctgctcttgtagtatgaaagcaaagattacacataaatgcataagaatgattgttatattgcttttcatctatgtctttaataaaccacacagtgctttaagccctttatatgtaataatgcagcaacttttataaagtagatattgtcgttatgcctattataagcaaggtgactgaggcacaaggaggatagtctagaaacattccatctctacattattcgtcagaaacttcgaggaatggctgccagaagcccaaaatgcaatactggatttaagaaagtacctaaaaacatgtaaatcatgcatagaataccaacaacaaaaagcacatggggagcaaatagatatggcccctaaaataaatccattcacatctcttaatttgaagaagcaggagactgaaataaagagggctcccagagcactgaattatgatatgagaatggtgtggtagaattcaaaacagactgtgaggtataatttttggaaaaatatgcatatgttacatatcctgttgtgcaattttaggttaggctacatgggactacgttgtacataccagcctaagttcctatttaataaattcaagtattcctagtagaaaaactacatttccagttagaaaagtaattttgagcaacacaatcaaaatgatgtaaacaaaaagtaatacagagaagacctgtcaaatggtatttctggttctagatccttgaggaattgccatattgtcttccacaatggttgaactaatttacatttccaataacactgtaaaagcattcctattattctgctataaggacacatgcacacatatgtttatttcagcactatttacaatagcaaagacatggaaccaaaccaaatgcccatcaatgataggctggataaagaaaatgtggtacataaacaccatgaaatattatgcagccataaaaaggaatgagatcatgtcctttgtcctttgcagggacatagatgaagctgaaagccatcatccttagcaaactaacacaggagcaggaaaccaaacaccacatgttttcacttataagtgggagttgaacattgagaacacatggaaacagagacctgttgggggttggtaggtgaggggagggaacgtagaggatgggtcaataggtgcagcaaaccatcatgacaaacgtatacctgtgtaacaaaccttcacgttctgcacatgtatcccatttttttagaagaaataaagagaaaaaatctgtcatgaatactaaaagtatggtctcaagccacaataagcgaacctccaattgtggttggacagtgaagcctctctacatctaattttattttcatgtttcatcaaagccttaaagctttgatcaggggcttgcctaatctctggctgaaagcacctcaacccctaataccatgcagatttagtcatttctctgggagaatgagaaaataaaccaggtatatgaagagttaatattcaaaagaaaagttgaaaaataaggcagtcatttttttttcaggagcagagctattggaaggtgaataaaatataaatgtataacttacggatgtataaacccaaacacgaggctttaaaaaacaaataaagcaatcagtcctttagtagttcttatttaaaaagtgagagaacatatctacacctcattaagaatattaaaatagaaattttataatttgattatatgtgttttaaaagactgaaaatacaagagaatgattaacaattctgttctagtagaattgcaatctaaacatgtacaaaaattcacacaaataaatttatagtggttgaaaacaccaataacaaaatataatttatcaaaaaaaaatcagagaattaacctccaaaaacacattgagcctaaattttgattctttaaaacctgtgtaatctgtacaattttgttcattatgttctagaacagctccattcaagagaaacagaatatttcacatgcgattttaaattttctagtcatcacattttaaaaaataaagcaagtaatattcattttaataatatgtaatgtacctcaatatatccaaaataaaattatcataacacattatcaatataaaacattattaacattatattttaaattttgtttatactaagtttttgaaaaccaaagtggtaaagtgcatacaggcatatcctggagctattgcaggtaggtttccagatcactacaataaagtcaatatcaatctgaagcaagtcacacaaatgttttggcttcccaatgcatatgaaagttatgtttacactatattataatctattaagtgtgcaataacttcatatctgaggaaaacaatgtacatgccttaatttgcaaatactctattgccagaaaatgctaacaatcatccatgctttcagcaaatcctaatatttttgctgatggaattctttcctcaatgttcatggtcactgatggatcagggtggtggttgctaaagattggagaagctgtgataatttcttaaaataagacaacaagctttcatttcatgaaatatttctctgtagcatgcaatgccatttgagagcattttgcccacaatagaacttttttcagaattaaagttggtcctcgcaaaccctgcacttggttttaccaaccaaatttatgtaatattctaaatcttttgttgtaacttcaacaatgttcacagcatcctcaccaggagtagattatatttgaagaaaccactttctttgctcattcgtaagaaacaatcttcatccattaaagttgtatcacgaaatggcagcaattcattcacctctttaggctccacttttcattctagtgttcttgctatttccactacatttgcagttgcttcttctactgttgttttaaaccactcaaagtcacccatgaaggttggaattactacctccaaattcctgttattgttgacattttgatctcctctaatgaatcacaaatattcttaatggcatctagaatggtgaattctttccagaaagctttcaattgactttgcttagatccatcagaggaatcactgtctatggaagctatagccttacaaaaagcatttcttaaataaaaagacttgaaagtaaaaatattcttttattggtgggctacaaaagggatgccatgttagcagttatgaaaacaatatttatctccttgtataactccatcagatctcttgggtgatcagttgcattgtcactgagcagtaatatcttgaaaggaatattttttttttcctgagcagcaggtcacaatggtgggcttaaaatattcactaaactatgctgtaaacaggtgtgtggtcattcagactttgttcatccatttctagagggcaggcagagtaaatttagcatctttcttaaggaacctaggatttttggaatggaagatgagcattggcttcaactaaaattcaccagctgcattaacccctagcaagagaagcagtctgttctttgaaggtttaaagtcagcattgacttttcctctctagctgtgaaagtcctaggtggcactatcttctgatactaggctgtttttttttcacattgaaaatatgttgtttggtataacaaccttcatcaataatcttagctagatcaggaattcctgcttcacattgcactattatgttatggaagtagcttttttccataaatttcatgagtctatctctgctagattcaaacttttcttctataccttcctcacctctctcagcctttatagattgaagagagctagagtcttgctctggattaggttttggcttgaggaaatgttgtggctggtttggtcttctattcagaccactaacattttcttcatatcaacaataaggctctttaggtttcttaactttcatgtacttactatagtagcactcttaatttccttcaagaattgttcctttgcattcacaacttggctaactgttaggagcacaaggcctagcttctgggctatctgagctttccacatgatttcctcattaagcttctttctacaaacatacatgtctcatttgaattgagagatgtgtgacttttcctttcactgaaacacttagaggccattgtagggctattaattggtctaatttcaatattgttgtgtttcagggactgtggagacatgagaagagggggagagaaagcagaacggtcagttggaagcaatcagaaccacacgacatttatctactaagttttccgtattatatcgatgcagttggtggtgttccaaagcaattacaatagtaacatcaaagatcaatgatcacagagccccatgtagatataacaataaaaaagtttgaaatattgtgagaattaccaaaaggtgacagagacacaaagtgagcacatggtgttagaaaaactggtgctgatagatcggcttgactcaggattgccacaaactttcaatttgtagaaattgaagtatctgtgaagcacattacagcaaggcacaagaaaacaatgtatgtctgtattttatgcttatagcatatttaactttgaaataactaaatttcaagtgctcaatagccacatggcttgtggttctatactgagtagcacatttttagagcatggaaaataaataaagcttccaatctaatctcaagaagttattgtaacttgatacaaatacttacaatgtaccatatttaattctagtcccatgactgactaaagttggaagaatcttaaaagaaatatgagcaattacattttattagtattgacatgtagcaataaacagaaccaaattggatccactttaatactgaaaattttagaaaatctgtgaatatagtaagttacattcatactcaataggaaagaaatttaataagaaaaatacacttcacatagaaaaaatgcaaatgcccaataaacatgcaaagcttttatatcatcaataaacataaaattaaacaaaaaaactgctgctacctaattgccagagtggctgaaataaacatctgtgacccacagagtaatgtgttcatatgaagcaacaggaaatatcctacacatctaacaggagggtaagttggaacaatcactttggaaacaatgtgttatcatttaataacatttaacaaatacataaatcaggaccaaaaagcctctctctatatagagagacatatatatatatacatatatacacacatatgtatatatgtatgtttatgtgtacatcctacaaaggaacaacagacaagtgcaagaaagcttatggtagcatcattcataataactccaaacttaaaattacctaaattctgtccatcatcattataacatatatataattttgatatgttcattcagtcaaaaagcacatgacaatagaaataattgctaaaactaaacacaacatgatcacacaaacatcctataaatagaaaaaggataaagagaatagagaatatactgcataatcctcacccacataaaaattaaatgagggaaaacaaaactaaaatttaaaaattcagattggtttttatcgttggggcatatttactgagaagggggaggagtaaatatctgagaacgctggcaacattttatttcttgatctatgtcacatgtatgtgggattttgctttgtgagaattttgtattcaaaatgttaaattattcaatttaaaaatacatgtaattaaaccatgcataaaattaaaaggcaggtaatttgttaaaatgtaatgtgtgtgatgggcagatgttcttcagtgtttttagctgtttgcttgtgtcactgggagtcaaatgttagccaatgtcagaatcacagggtcagctttttagaacagatcctgggacctagcttccaaaacttctgattcagcgggtctacattaggtatcataaattgagaatttttattgccatgttcccaggtgattctgatgctgctgatacagaaccacacattataaacctctggcttttgctatgcccattgaaatatacttccctccatcctcacagtcacctagctaacccacttttacattcaccctaggcccaactcaagcaaggccacataattaggttaccctctcctcccaaacctactattatcttcagggagcccgcttctattctttcataatattttcctgagaaatttacttaagatattttatctctctgtctagtcttctaattgccctgctataagtgacattctctagggtttactttatccctgagagtgtttatttaattatatttgttgaataaataaatcccatccattgacttttcaattcctttcagttgtcaatttctcttttaggttcctatgtgtcttgcctttagccccctatttcaaagtctaactttaatcctagctttcttgggaacaccttccttccaggtttctaaggtgtaatgaatttaacgtgaaatttgtgtcctggcagcctccttcatcattaactcagccaaagactgccaacatttttctatacattcgaagttttacttgcttctttcttggtagggtgcactgtccttcttactaagttgccagaagattaacaatccataatctccctttcattatgttccctagcaattttatttctatttttttctttcttttcctcatataaccttgctcttaagatttttctgatggtctgtgaattatcttattattttctttagtcttactctccacaaaaatactttatggaaaatgaatatttatcctatgtccttcactttgtggctttggaaataatgcttcctttgttacttcctttctctcttcctttcacggccattgaaacctatttttaatacacagtattaaataaatgcattcatcctcttgtgcttgaaaatatattacagattttccatgtttaatgaaaggcatctgttttatattacatcaaatctaactcattttaccaatcagtacacaattatatttttaagaagtgaggttttgagagtaggtatcctaagtttataaatgctttggtattttgctgctacctcagaaatatttaaatattctggtatccagatgatgtgtgttacattaactgaggcatgtaccggttaatggatctctcacctctgtctgaagatggaagaaatagtatgccttcaataaccctcaaacctagaagctattattaataaaaagcagggagattttctctgcattccaacctcaagtgcatatgaactattactctatattttctgcccaaatgaaatttactccgggaaggcaaataataaatgaagctagagattgtttttcttgtttggtgtctctgtgtctaagggtgttattgcagacatttataatgaataaaaattgaatggctaatataattatatgtgcaattcagtaccaaagcgctcctttgaccaactatcttggtcagctgaaaagcctttagctgtataaatgtatatttgattacaaaggtaatgttgaatattgtggttagttattctttcaacagggaaggaaaatattatttttgtatatgaataatgatggtaaagggtacattaaaatacttgaattacaaactaatctgtctctagatgtgttctccatgatcatgaagagaattaatatagtcaattttaaatagatatagtaaacgtgcaaaacaagtaaaatttggaaatgtgttttctggttcaagactgtggcttccatatacacttgttttctttatgtttttagagcatattaaaatggtaccattaaattactcacatattgaggaaagctaaagaatcaatagactcagattgcaaagaggctgagtaggtaatttaattgtttttgcttttcataattgttggggaggctatcttgctttataaaacaagattaacttcaataatatctatgtgttttagaggtgaaaacaatgtctaaagcatttatgttaaacttggttggatttgacttcttcttatgaggttatccttccattagaaatttaaacagtgagcagaggctaagaatccttttattactcataaaattttggctttgatggacaagtgtttatagttcatggcgagggaccagtcttttaaagcattttcatctttgccaaagtctcttcctggatttaactggtcatctcagcaggtattggagcactttatggctttatgatgacgaattttttctctctagaagtgatggcagaaattttaggtgtttttcagctgtatttatccaccaaactcaagtgcatgtaaccaaactgaagactacagaacaaagacttcttaataagtcaaacagaagaattccattttaagttttagaaagagggtctcactctgtcccataagctagagtgtagtggcacaatcatagcccactgcagcctcaaactcctgggctaagtgatcccacagcctcatcctcaaaagtatctaagactagaggtgtatgccacctcacccagctgatttttatttttgtattttttggaggtgggttcttgctacgttgcttaggctggtttcaaacttacggcctcaagggatcctaccttggcctcctaaagtgatgagattacttaaggcataagccactacagatagccaaaattctattttattattattaacttttcatttcctgtgctgaaacaaattgctctccacctgttgttggctactaaataaaatacaggggtaaccttgcatttagtggctctgatgtatggatatacataaataaatatattttattattatctttaatgtctaaaaaaacactgaatgaatgagattgtcccactttggataagaggcaatgtggtaaaatgtctgctagacctaagcagattaattttctgatcctatattctttggagcatgttttcctaaataaagttgcctgctgaatcacctccactttttaaattgccctgttctttttgtctatcaaagctgattttataaaagctaattaggaagaacagagataatatgatgaataaatcgtagggttgtgagacttttcttttactatatacccttctacactattttcctttttaatcataggcaaggaatttacaatacatattgtaatgtaaaaattttgttttaggagtttcaacagatgttaataagttataaaccttaatttagtaatttacatgactaaatatgtaacatctaaaaatgaatcttttgtttacatacatggaaatgttgtggcttgatttaaactttatggatttttaattattagaagttcttaatattaatgtagttaaatacataaatattttcttttaggtttaattttggaatgtgtgtgttgtatatctgtatgtttttaaggaaatatttcccatagcgaagccatagtcttctctattataaccttaaataaaatttgtaaagtttagccccctgaagctttttctttaaatggtgtagggtaacccttactctagttccaccttcataagtagtcttgatatctgccaggggatttcacttcactttttcttcaggagcatcatagttattctttggccttccattcaaattttgtaatcattttagcacatttcttggaaaattcttttggaatattaattaaaattatagatcaagttgaaaattaattgagatgatgaagagtctccttgtgcatgaatatgctatttccctcaatgcatttacacgtttaaatttttcaaaatacagatatgcattgactatctcatgttagatttgtttcatagttaatatgtatttttggttaatattataaaatatttctctttaaattgtgttttcaatagcctattaatgtaattataaacacatattttaaaaataaatatgtacataaaaaatagaattatttttttcattacaggggtagaataagaattacttcgaagataggcagcatatttgagtcaacataaaatatgctctcatcaattgcagacatgcaacagtaaaaggggcaccattatggtgtagaagtaccccactgaatgctgaattatatcattcagtattaactcaccatctgtaataaaaattgcaaaagaaattcatacagatttgaaataatcaaaatagtataaaatgcaatatatgatttattatattcaggatataattcatgacatactaaggagagaaagcaggagattcaaaattatatatttaggatgcttccacatatagatgatatcaagaacatgatatataattacaaaagtatacatgatacattctatggtatgaaagtacaaataaagaaaatttcattttattagtaataaaatgtaaatttaaaatattaacacgttatacataataagtgaaatttgatgttcaacttagcaaatatttttttaatttttggaatgatatcaactactgctggtgagagtgatgtacaatggcctcttttatacagcaataatggaattacaaacttgctcatcaattctcaaagggaatttcttagtatgcttatgttcattattttgaacattgacccagttattctatgtctgaaaatttattctaaaatacaaatatatactcaaagatctagatttatatgacagtattttttaataaaagcaatgttaaaaagtgaatatatacatagaatggttaaataaatacattgaaatgataaaaggctaagtagtcattaaatttcataataattacatcaaacacttgtattgcgctaattatgtgccaatcattgctattcatttttacgtatattaactcatttaaatatcacatatttttctatgaaatagtcactgtcattaaactcatttttttttttagcaatattgaggttaagtaactatccaagctggaattgtatgccaaatctatgctgttttttgattctccttcttctcaagccattaacagacaagataatggactgaccacttcgacgcataaaattctccttcccttaaactccacccatgccctcaggtcttcaataaaataatacaaaatatagataatcttacatcatattgggaactgaaaatcactgaggaattttttttaaatataatgtaagttggatcaaattgcagtaaaactatcaaaaactgtcaaatgcatcaaagaaacactgtgcttcattgctaataaatcccccacatgaggcaccaatatgaaattgtggcctataaataaaagatgttctgagccgggcgtggtggctcatgcctataatcctggcactttgggaggccgaggcaggcagatcacctgaggtcgggagttcgagaccagcctgacaaacatggagaaacactctctactaaaaatacaaaattagccgggcatggtggcacatgcctgaaatcccagctactcgggaggctgaggcagaagaattgcttgaacccaggaggcgggggttgtagtgagtggagatgcaccattacactactgcctgggcaacaagagcaaaatcatctcaaaaaaaaaaaaaatgttctggcacaacacttgtagcaacagttaactggaagagaaattaccaggggccagtgcatggtgtgcaactagaaatatactatgtggaatctccctttaataatcactaatcctcaaacgtattataaagccgcttactcttccagcctctgggattcttccacttggatataaaaaattgaaaccaaaacaaaacaaaacagtgaggcagagttattcaattcattttccagcaggcaaagaaatgaagctaaatactaacagcttcatttcttatagccttatagctaaagagaaagctaaatactaatatctgagccctaccatagtggcttcattgtccgtatacagtagtatcaagcacactctaatatccttacttcattggttccaaacccaatttgctaatttatgttggtaacaccaaccctccagattacacactataaacaaagtgatattgggacttgactatacaataaaacaagcaaaagagaataaaatgtattatctatggagaaacattgagaatgattttttttttcttatttatgatgagtttccaaaaacagatacacaaataatttcaggctaatgaaaatgtcttggaaaataaatgaagaaaataacacttgatagagaagagatacttttaattattgtaatgacaataatagtcaatgttttataataatacttttagtaatacttttagtttactacgccaagcagtgttccaatacctttacatggatagctgttttaatcctcataataacctatcagatagtagcattattattcccattacagattagtgaagcataggaaagatgagtaatttgctcaaattcacactgctacaaatgataaactcttgtgtctgaaccaggggttgagaggtagagcaagatggcagaatagaaggctccatcaatcttcccccctcttcagggacacaaagttaacaactatctacaaaggaaaaacacgtcacaataaccaaaatcaggtgagcactcatagtatccttttttaacttcatatcactgaaagaagcactgaactcagtgctgttctgttagagcagaaagaaaaaccagaccgaacaccgaactcatctgacacctgcccacaaatggagcatttaaacaaccctagccagaggtgaaccactaatcccagcagtcctgacttgagtgcccacaaacctcacactgaggtccaaaatgccggtctctgagtaaacttgaaaggcataaggcataagtttctaggccatagggactgcaactcataggcaagtcctagcactgaactaagctgatacagttgacttgtggggaacgtgacatacaaagacaccagctggggcagctaagggaatgctggcattacccctcccctagacccaggctaaccctaaccctttccttctgcttgagcagaggagagaaaagagtggggaggactttatcttgcatctttgatcttgatcagccacaggataggacactggtcagagtcatgaggcccctgttccaggccctagctgccagatggcatttctaggcacatcctgggccagaaaggaacctgctgacttgcaggaaaggatccagtcctggcagcattcattacctgctaactgaagagcccttgcgtcctgaaaaaccagcagtaatacccaggtgctatgtggagggccttgggtgagcctctgagacttgctgtcctcaggtgagatgcagcacattaccaaccttggtggccatgggggaaaaacatccttcttgaggaaagcagaggaaaaagaagagggaactttgtcttacactttagatacgagtactgccacagtcaggcagagcaccaagtgggcacttaagaatcttctacactactactttcaatttgccttttctaccaccactccagattgtggacaagatcactaacaaccatcttacttcagaatccgttgtgaactctttcaccatttttgttaattgacctgtcagcaaagcagcatttaaagtgtgggtcataacctccttttgagaaacaccttttcctttactccttaatatcaccatcctgtatcttgggttggtacttctcaatgccctttgtgtcagtgtctctttgtcacatacttcactttcactttaattgctggtattcctccttattctgttctgaagatagttgtcttctattcagcttttttcctttggtggatactaccagatcccaggaagtcaactaatatgtatataatatttatgacaataaaataaataatatattatttgtaatttactattctctcttctggggagctttccttctttaaatatgttgaaaacactacattatttatcataaatatttgttcattatatatgacagtaacattattaggtggaaatattatgtgttggaaaaaattgctcaaattatattcatgatcaccggctgttctaaaatcaattttattaggtaatatctgtgtcacattatctctaaatttccgtaattttcataatgaaaatgaagaataaaatcaaactaagttttaaaatgtgagctagtaattttagttataatgtttattttaacattaaactcatgaataaataacaaaattaaatgcaattcatcattctttgaacatttctgaatttttgaagatcaaatataaatctttcacaaggcttgtatttgacaatgttgagcaactatctctggtgggaggttgttattgtacattttaaaaataatttagaataccaaaaacaattcctcactagattccttctggaaaccaagaaaatatccaataataatggcattctctaaacccagttaattaaaatcttatgatccataaaagtaagataaatattactcatatttgtagatagaacattagaggattgttgctgtattttcagagtaagggtaaagattaatcttttcataagtcaggattgcaatagctgttttataaatagggtttttggaagttaattatttatatgaaacataaaattattgtgtcagatgcttttctagggactggagataaaataatgaacaaaacagataaccatatatcacctccttgaacttaaattctggtgggagaacacagaaaaataagtacatacataggtacatacgtacacacaaaacctatgattatgtaataaccattataatttataataatttagatgcagacgagtattacgaaaaaaatgaaacaaaagagggtggggttgctcaggtatgggtatagggttcatttttaaataatgtggtaaggaaatgcctaactttgcagaacaagaaggagcccaagatgactgtgaaagaatgagaggagtacagacgtgggagagtgggagaccaggtccaaaaggaaaggaggtcagacaatttaggtccttatagggcattttgaaggctcctcttcttagtgatataaaagcttctacacagaaggggatttagcaaactgacatgctctgacccacatttgagcagaattgttctccctgctgttggaggtaaaaggcagaagctgacactgacatggcagcaatgaaatgggtgagaagtggtcagattttaaatgtattttgtaggtaagagcaacaaacttttctgagggattaagtaagaatgtaagagaaaggagaagtcaagaaaaaaaaagactgcaaggtttttgtttgttttttaaccttggccaactgggaagatagactggtaattaagggaggaatgggagggggtggatatcacgtgtttgttttgtgcaattaagttacagtgttgaatttaagatacatcaatatataataggtaccattaaggaaacacatcaagtgggcagttagatacaaaactatggagtccataggaaaagtctattgagccttttcaggttatggattgtttttaaatatataaaactagacaagaatacaaaggaaatgaagatagcaaagacatggaagccaatatgtagtgtcctggagtccaagtgaagacggtactttaaagggcaaggaaggatcaattttatgacaatcactagctcttctagaatgtcagtcacttcatctgcaattggaggcattggaacatgacctgatggactccattcattccgggtcttaacattttgtgggactcaccagggtacatgatttaaaaaaaacagaatgcttcaacaagattatattttcatggtcatctcttttcagtgctttaaatttgtgattaagagaatgtttgagattaatcatggaaataattaaatcatgtctaaactcattatatgagagatgaaagtaataacacccagccaagtttagtggctgtgaaacatttaaaatttggggtcagcctacagactcttagggacagatttagtacgttattcagaaggcaaaatagaaatatttcgggagttgttaataatttgatagctttataagattatttgttaataaaaatggtactagaatgaaccaagtaatgactttaacatttgaatatgcacttactttttattttacttgatcacgatttggctctttaattaatttcatttacttttaatctttcttttggcccagaggaaaaattaacaagttgaaatgccatgtttgggtttaatttgagaatgagatttgaaatatgaaatatacctcttcttcaaatcacttctgtggcttaaagaatgacaaagacctctatttcctaccacatcagtcacagctcttcctaagcatcacactttcaacagaaatacagctgacctcataatcatcccagataaaccattttttattttccctgatcttcagtgaacattttaaaaaggcagagtgattggagagcaatgtggaggagtgaatagtgcagcatagtgctgagagccctcaagaactaagctttgctaagaatgtggaccttgttgaagacgtaagtcattatccagagatgaagagaagcaccaagtattgtgacataaaattttgcagaaggaagaggcaatattaaaacaacaacaacaggttatatcagggacattttcctaggtttgcataattttttttttttttttgagacggagtctcgctctgttgcccaggctggagtgcagtggtgcaatctcggctcactgcaagctctgcctcccacgttcacgccattctcctgcctcagcctcccgagtagctgggactacaggcgcccgccaccacgcccagctaaatttttgtatttttagcagagacggggtttcaccatgttagccaggacggtttcgatctcctcaccttgtgatcggcccgccttggcctccaaagtgttgagattacaggcatgagccaccgcgcccggccacaaaaatttttaaataaggaaaattttaaaattgtcacttcaacttaaatgtttcatctatgagaggctgcatagcgcctaaaatctctcatcatacttcttctcctgaaagatgcatttaatgctagaaacattgacatatgctactctttatatctaaaatgttcccttaatatgaaaatgtattaatattttaaggcttaatttatactgctacttctctgtgaagacctgtttgtctcatttcaattaaatatctctttcttttcgtacctttattatctaattatctctactattcctagtattcttaatatttattatacataggctcttggggacagaaggactagtattctgcatagcttgtattttgcattattactgggttagtatattaaataattaatagatgagtaaattaatatcacacatctaaagtcaccagattttatgttaaataagatattttctatctgatttaagaaaaaaaattgaaagacaaattactgtacctattgggtttcattaattggttacagagttataaaataacctcaaaaaacaacatgtttaaaatgttacctatataattaaatgttgaccttgtgggacagtagatgaaagtatcaatgtaatattaattatttatgatgataaagcctttatgagacttaaaggaatttctgtaagtcaaagattataacagttcacatgttatgatttgctatttagtagttctattttcacaaattttctaataaaattttgttttatatatatgaatacaaatacatattatttaacaatagatgtctttttatgggctgattatcacaaaaacttaaaaggaaatgattatgtaagcatgtttacagtctcttatggaattactaagtaaaaagagagagattaaattgttaactttaaagttaacaattttaactgggtgaagggcccatggaatcctcctttattattttctacaagtgcatgtgaatctacaattatctctaaatgaaaaaaaccttaatagaaatattttcacacttactaaggactgaattgtgtccttgtcaaaattcatttggtgaagtcccagcccccaccccaataattcagaaagtaactgtatttttacatagggcctttaatgatataattaaggtaaatgaggacatgtgggtgggccctaatccaatatgattagtgtccttataagtaaaggagattaggacatagaggcacagagggaagaccatgtgaggacacaagatggccatttaaaagccgaaaacagagaggcctatgaagaaacaaccctgctgacactttaatctctaacttctagtctccggaaatgtgaaaatattaaattttagtttttaagccatccagtacatggcccttttttttacgattgtcctaacaaatcaatataacactaaacagagcattttattttaaaatacatataaccaaaagtagaagaaaagtctaatagcaaagaaaactatcaatgtaattggccatattagcagatggaatgagacaaaatcatggctcatctttttggatgctggaataaatatttaataaaattccacatacttttgaagattaaatgccagagcatttggaatgaaagggaaatctctaaatctgacaatggctacttactaacaaccaacaacagacattatttttttcatcatttttaagggtgaaacattacaaatgttttatttgaaaatgagaagcaagagaaggtagactgcaatcagcacatctattcaaagccatatgaaaggactcggccagagcaatgtgacaagaagaaaaaagaagaaaaaaaaatgatgttttgattgtctattcagtgcttcccagcatttttcatttcaggggaaacacagaaattgctaaaggaaccagatcaatatcttccctcacttgtaaaccatttgtgacacagcagtattctgctgcaaatggttgagaaccctgttctatattgtaaatcaacatagtgacaatctttcagaaaaagtattcatctagattgctgagaaaatatcaatatacaaaatagataaatgtcctatataccttcaataaataattagaaaagatgttcaagatatgtatgaagataattataaatctttcttgaaataaaaaatatctgaatagatataaagaatggttgaaattttaatattttatttaaagaaaccattctcccaaaaataatttacaaattcaggaaatttctaatcaaaacttacaacttaatacacaaaaacggagtcaagaatggccaagacaattctgtagcaagcataaagggaaagcaggttttaacaggtatgtaaagtaaaaattagaaatctacagtaagtaataaagtatagtattttggtgtaagctggctgattggtagcagaatagaaagtctgtatataaaaggaaaacttaatttattatgtttctctttttctttatactacagaaaatgttgcagatgattccactgaatttatgcaactctgctgttttactaaaatggctcataatgtgaaatttatttcaaaataataaagcaatatcctaacaactgcagttatgggtgtgctcagtgtcaaaaattaattacaggattaaagagagaaaaacatatattagtgttttttaatggtaacatgagattaaaagctgttttctattaggatacttgcaaattcatgcatgaacattaactcttagatgatagttgaaatatagaaagaaaaagggaattttgggatttcttcagtatgcagttttttcatggaaatcagtttctttcattgttatcgccacaattataatgggaaattgagaaaataaagatactaatttagattggttaccatatgatatttaagtacagaacttactttacccacataataacatatggacatgttaatataacttaaaattttaaagagtacttcatgtatgcttctttaagaactgtatagaagaatcttctttaagaaacttggcatccaaaactgttacaaaaatattttcaagtggggaagattcatttttattcctattataatggcttagagattttgatatctcctttatgcaaacgtttgataaaacagtctctggcattatgctttttgtcactttcaaacacctccaaatttaaacattcatattttgggttttatttcagtttttctttttttcaattatactttaagttctagggtacatatgcacaacgtgcaggtttgttacatatgtaaacatgtgccatgttggtgtgctgcacccattaactcatcatttacattaggtatatctcctaatgctatccctctcccctccccccaccccacgacaggcctcagtgtgtgatgttccctgccctgtgtccaagtgttcttattgttcaattcccacctacgagtgagaacatgtagtgtttggttttttgtctttgcaatagtttgctgagaatgatggtttccagcttcatccatgtccctacaaaggacatgaactcatcctttcttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttataatcctttgggtatatacccagtaacgggatggctgggtcaaatggtatttctaattctagatccttgaggaatcgccatactgtcttctacaatggttgaactagtttacagtcccaccaacagtgtaaaagtgttcctatttctccacatcctctctagcacctgttgtttcctgactttttaatgatcgccattctaactggtgtgagatgctatctcattgtggttttgatttgcatttctctgatggccagtgatgatgagcatttttttcatgtgtctgttggctgcataaatgttttcttttgagaagtgtctgttcatatcctttgcccactttttgatggggttgtttttttcttgtaagtttgtttcagttctttgtagattctggatattagccctttgtcagatgagtagattgcaaaaattttctcccattttctaggttgcctgttcactctgatggtagtttcttttgctgtgcagaagctctttagtttaattagatcccatttgtcaattttggcttttgttaccattgcttttggtgatttagacatgaagtccttgtccatgcctatgtcctgaatggtactgcctaggttttcttctagggtttttatggttttaggtctaacatttaagtctttaatccatcttgaattaatttttgtataaggtgtaaggaagggatccagtttcagctttccacatatggctagccagttttccctgcaccatttattaaatagggaatcattttcccatttcttgtttttgtcaggtttgtcaaattcagatggttgtagatgtgtggtattatttctgagggctgtgttctgttccattggtctatatctctgttttggtaacagtaccaagctgttttggttactgtagccttgcagtatagtcaggtagagtgatatctccagctttgttcttttggcttaggattgacttggcaatgcaggctcttttttggttccatatgaactttaaagtagtttttttccaattctgtggagaaactcattggtagcttgatggggatggtattgagtctttaaattaccttgggcagcatggccatttttcatgatattgattcgtcctatccatgagcatggaatgttcttccatttgtttgtgtcctcttttatttcgttgagcactggtttgtagttctccttgaagaggtcctccacatcccttgtaagttggattcctaggtattttattctctttgaagcaattgtgaatgggagttcactcatgatttggctctctgtttttctgttattggtgtataagaatgcttatgacttttgcacattgattttgtatcctgagactttgctgaagttgcttatcaggttaaggacatttgctcttatgtgtgtcctcacaatttcaaccccaatcatgcccagttctcattcctgtatttcaatttaattaaactcaacaaacattcatagacataaaactataacatgaaaagtactgtaatggatctatctttaaacagcagctgataaaagacaaatgagtgaacagttcataatggccagatgaaaccaaagataaaaggtgacagtggagggcaaataagtgcttgtcaagcagactaggaggaggaggtgtttcagacaaataaaacagcattggaaaggttaaacagctgttttagtgcatagagttttcagagaaaaaattaagtgattcaaaaaggataaatcacataattgtgaaagtcaatggaacaaatggataaatacagatgagcttaaaataaaggtgaagttaaagttgcagtggctttttaagcaattgttcaagcatgcattttactctataccagtgatacgtaaacaatgctcactggacagggccttctatgcataaatagttccaagatgaacaggagtgagaaacatttgatagattcaataccatatgtctacttgaaactgtcttgaaaacttacaatgcatgttagtttataaacaaccttcaataaaaaaaaaaaaattaaaaccccaaaaacaaaaccaaaaacccccttgactttaatttaatacattttctaaattttatgaaaatgaaaattttcctcatttggaagacccattataatatcaagaaaaaaatcccagagaatagagtttgagaaacatattaataggacgtgcaagctggtgatatcttttactttactgctcacaagtaatttttgcttgtctttaatgagtcttccccacatttcctccataaacatcctcataaagctgaccatgtaaagctaattttttttgtactcacaccatatacttctacactggaaggtgtttgggatgtagcatatagtatcgttgagaaatttttttgatatggctaataacattaatttatattaatgtctgcttcaccaggaatacagttttagtaacctgacttaattcctttgtgtagaaaaaaaatatgtgtatatatatatatatagatttatattatatatttatattatatatgtttatgtataatatatatataaacagtatatatataaaaaacagtgtctgtatatgtatataaatatatatatttaaacagtgtatatatatatctatatatattaaactgtgtgtgtgtttggcacatcataggaactaaatatatgcttcagaaaaataataagattaattaattaaactcattaatgacttgatttgtcatgttttgtgaatcatggagcaataagaaatgtgtgtattttgctgataatattttttgctacaaaccatttttattagtatttattttcaatgtttaatatcaacatagcataatactaaattttatgaaattcactcattgcacattatgtctcttcaggatttaaatttttatattttgtatcatctcaatatttatatttttaagaacttttactttttaatatttttgcactatattttgacactatatgtgttagttttagatctgttctatttacgaatgttcatgaacagattttcccattttctaaaactcttatttgaaaatgcattatgaaagaattgtattttagaaatcatgactcctctgatatggaatgacaaaatctttccaggacttataaaaaattcactaaacagttaggtctttcagctgttctatgtgttgacagacggttgcagatcaaaactgtgcatcaaaaagattatgttaatataattacagtggaaaatattctgaggaacacaggaacttttccttagcaccatttaaatgtgctaaggaaataggtaaagtaagcaaagtcaacctacaaaataggtaaagtaagcaaagtcaacctaaaaacacagaactgtagaacttgaagggactaaatatatatctacttcaaattctcctgctttcagaggaggacactgagaaccagagaaatgaattgacctttgcaaggacattcagaagtactattttctaaatcctgctcagacatatcaaggaatgacacaggaagttcaaggccaaagtcatatctgaagccgttaaatttgcttgcttgaaaaactaaatgtcatttcttcatagaggccttctggagatctttttcttttttgtgacatgattcattcccaaaaatatgactgtactgtaactgaaagcctggtttatttacttcatacaccccgttagaatttatagtaattttatttaaattgtgttgcttttagaccattgaattatttgtgttttcttctttaaaaaatatgactataatttttctaataattagagttcttcatatatgaaaatttctagctcagcatttcttagtgactcctgaaatacctgatgctttatttcctatctaaatatctatatcttatagtcaatattcagtacttggtctcacctcaggactattgattttgattattgggtttgaattatatgggcttagaattctaaattttgaatattcttatgcattctaaagtttaagaacttagaaattttattatttattttatggtaaggcaattttattacttcatactgctgtaaactactgtttttcataaattttaaaaatgaataggccaggcacagtggttcatgcctgtaatcccagcactttgggaggtcaggggggcagatcacgaggtcaggagattgagaccatcctggctaacatagtgaaaccccgtctctactaaaactataaaaaaattagcagggcttagtggagcatgcatatagtcccaggtatctgggtgtctgaggcaggagaattgtttgaacccaggaggtggaggttgcagtgagtcaagattgtgccactgcactccaggctgggtgacagagcgagactccatctcaaaaaataaaaataaaaaataaaaaattaaaaaaaaatatatagacacacacacatgcatatgtgtatatgtacatatatacatacatatacacatacatatgtacatatatacatacatatacacatacatatgtacatatatgtatatatacatgcacatacatatgtacatatatgtatatacgtatatacatgcacatacatatgtacatatatgtatatatacatatgtgcgtatatgtatatatgtacacatatctgtaaatatacacacatatatacacagacatacgggagcatgcatatatgtgatatgtatgtgtctatacatacatgcatatgcatatacatatatgtggatcatatatgtacacatcatacatatatgtacacatcatacacatatatgagcacatatgtgcacatcatatacatatgtgcgcacatatatgtatgcatcatatacacatgtatgtgaacatatagacatatgtgtatacatatatgcaaacatatagacatgtatgcatgcatatatgcatacatgtgtgtacacatatagacatatatgcatacatgtatgtacacatatagacatatatgcatacatgtatgtacacatatagacatatatgcatacatgtatgtacacatatagccatatatgtacatatatgtacacatatagccatatgtacatatacgccatacacatgcacatatatacacatatgcgcatatacttatatgtatagacacatgtatgtatatacatatacttatggacacatgatacgcatacatgtatacacacatatgtgtatatacacatatacatatacatcatatacacatatacacacatataaacatgtgtagaggcacatatatgtgtctatacacatatacgtatacatcatatacacacatacacatatatacacatatgtgcatatacacatatatacacatacgtgcatatacacatatatacacatacgtgcatatacacatatattcatatatagttacatatacattatgtacacatatatgtagtaatattcccttactgttaagaatattaatcaaatataagtctaaattaaatgaaaaaaatctaagttaatcctcatgttagttcctatacctttttctttatatccataagatcagaagaacactttaaataattaacctaagctggatggaacaagtaataataatagtaataatagactttaataataattattaaagcatggttcaatggttaaaagtaaggtccctgtgtctgtgtctgaaatctaaagactgcagttttattagaaggacattaattatatgcatattactgaaaattgctgtcaaggaaacagagtagtcaatttccttaacccacatattcccattgtacactagagtcactattcttcaatatagtctcaaaatatatatttttactaatttcaggcactattttttaaaagcttatcttcaataaatcttcccatactaaattttggctttgtggattctaaagacaacaacacagtgctaacttttgactttaaacaagtacaggatgggactcaaagtcttctagtttaaagttgatgtaattgatttattctcccctccttcacaagaaagtttatataaaaagaacataaacaagtggtgcttactttgccacaaggcctactaatacagggagaccaggatgctgggcagcttagcggaaaggtcagtctttggagagggttggattgtaatcctttaaggcacctataaactatgtgactttaggccaattataaagtatttctaatcctccttttaaatattgggttttgttgttctataaaataaaaagaataataccaggtaaacattctgctaggcagtctaccttaggtcttctatgttaggagcttctattctagccaagattaacatttagtataaatattattagttgcaattatgacattttcttctatagagcctaacaggtcatctttacaaattcctttatttcacagaaaagtaatgaactatatcaactatttgattatatttatacttagatgctagaagcaggaccaatatattgcgcttccatttctcaatgatgtattcaattaattcatgctttttcagtcttcactagcttgttacctgtctacacctaagaccttatcttgtttctattttaacatccaaatactttatgcatagcatttgtttctcgattaatctgacaaaagatctctagaataaatgctgcattaacaaatgaaagtgaatttaatgcctgccaagttagtacctgaaaaaaaaaaaggtcttttaaactccttggatagttttgattgttaatgttttgataattatttttatggttatttaagtgttcctagtatgacaagccaaaggtctaggttcatcaatccaccatgattgaatatttcttataactttttgtactaggtggaaaatgatcacttttattaatcctgtgtactgatcacataaaaatagctaaggcttgctttgctcaggcctatagtttaacttaatttattagggaagtataatagtattcatctttaacaactaaactataaagttctcctaagagaaaatcagagcaataaatattttgaataaaattttaccacttttttttaaacaaaaaagcataaaattaaatttgcctgctaatttatattttaacttgttaaacttgtagccctttttggatctaatgatttcctccttcatgtgattttaggtttattcaaacttacttttgattatgaaaaaatttacctgacagccaaagcatacattcaaacagatagcaaaatcattggttaataagatgtgtactaagacacagtctcaacagtgcagaaataaaccaaaaaggtattcttttaaaatatttgcctttatatagaaataatatatcatgttttcatatttaaccgtcatggaaaatcttgaattcagttctactttattgatgttctctgaacttcctttttaagagttaatattttagaaacaagttaatatgtactgaatgtttaaattcctaaactatttgtttccataattttatgatatataattttccacataaaatttcccaattagcttataatatcaataagattcatgtttactactcataatttaggagaaataaaatttgaactaaaagtagtagagtttgaaaattttcatagtataaataacatggttttaacccagaggtttttttaatcaatcatagcgaaatattttcaaaaactcagtgactttgcctaatgtcaattagtggacccaattgatcacttgttttatcatatatgtagcaaatttatagtttatcatttgtccaaagggtgttaagacacaagagataatacatcaatattgagtaataaacacagaaacagtagttttagaaaaaacaataaaatgttaatacttttaatgaagccattaatttttttggcaaaatcaccttcaataattatagctaattaatactttttcatcaagtaaaattttaccagatagtgtgtttaaactatattaacttcaaagagaaaactgtcagaactaaaagtatttttaagcctgaaagtttaaatgatataaatgtttttaaatgctttgatttgaagaggtacaatcctctgttttcatgactttgattcattgctgtgtacacagaattaaactcaagataatactgagagttgtgctagctgttaagttcacagtgattaatggcaagacaagatatcaggcatctaagagttgagaaagtattaacttgagagaaagctgaaaaagccagagggaaataagtcacagtaacgaaaagcaaagaaaaagcaaaacattgttcttgattgtactttgatacattcctgaattcatcctaaattgtcaaaagacatgttaaagcagtgttcatgggatctaaatctaaactggcctatgaaataaataactaatatattattacataaaaattaagaaacataaaatattacaagcaaattttctgtttttgagtacaaaatgtaagaaatattaattcttaaaactttatgagaaaaacagaaggcacagaaaaaaagccattctaataatttatacagttttcatataatattagttatcaattattaaagacttctcacataacagacatcgtcttagatgattgtatagcctatcttaatcctcataacataatcaccagtatgtgagaggaagtgtctccttttaaattttatatattttgtaagctaaaattcagaaagattcagtacttttttaaaggttgcacagaagtaagactttaaatacagttcagatcagtaattaaactttgttttattcatttgcttaatcatctgtcttccccaatgttgcaatatttgtgagggtaggtaccaatattggcttttctacttctaatttccagcaattttcacagaacctgactctctttctttctctctctgtgtgtgtgtatatatatgtgtgtgtatatatatatataaatatatgtatatagttatatatataaatatatgtatataattatatatataattagaattataaatttactgtactgagtcataaatctttcataatttttttagtgtatatgtgtgatatttctttcaaaacaagagcactttcccagatcaaacattgtaacatgtatttctatgtatttatttttttgcatagatttactcactttttcatgtgctctttgtatttttttatttgacattaattgggcacttaatgaacacatagatttcaatgtgctagagtctccatatgtaaagatgaataagaactgattcattgtctgaaggcagcagcatgcaaacaacattaaatcagacaaacaggtgcacacattgtattagtggaatggtttgtgttttgcagatgcagagagataaataactaatgaatcatgagggagctagggaacactttgctaaggaagccacctgtgggctgaaactgggaaaagtagttagttgtctagcttcatgttggcagagaatggaagaaaggaaaagcatttcaggaaaaggaaacaatgtacaaagacccaggttaaagaagataggatgctcagtttgcctgtgatgtagtgtgtgaattagaatgaaatgaatgtaagctagcagaaatacagtcaagtcagattacgatgaagtgttgttcagcagaaatactactggcaatttggacaaatttttctttgttcagacaaattatttgagggaagttaaacatcacttgccctatccactaaattccaagtactccctagtatttgcaaaaagctgatacaaacacaactcacccatttctcccatcacttttccaagtgcctccatcaggaattgtaatctcacacatacacacactgcacggcattaagggccaacgtgaagtactgaggaatttggacaatattcaatgacaaatgaagataaagaagttagatgactaacatgattgtattatgctttataattttccaattttaattccttaatatgattagcccaaactgtaagaggaaagctgaaatcattcttaaaactgtgaaaagttttattaaaattcattgagattgcagttatgaaatgtgctaattttcaggttaggacaacttaacacttgtccattactgcttcattgacatgaaactgcattagaacatgtccttattctattaacacttttttatggccttcaaagataaacacaataggatattttgttcattggcacacacactcatatacatacacagtcacatagacttgtatacactgctttactgctttataaagctcttacaaacatatttttgaagagtaagtttttgacttctttgaaataatttttttctatctttttaacaatttggcaatatcaaatgcaatgtttttggtaattttattatgaaaacaaaaagcaacttaagacttgatgaaaatagtggtcaaagcaaataaacacagtttatgtttcagccaaattattgcattcaagaaggctgtgttcacaatgtatgattcttttcaacatgattacataatcttatctgtaagcaatacagcatgccattctagttagaaacaacagttctgatttaatgttaggtttgtgaatttggttctcaccttaagaaactaacacccacatccatatgcaatgcttaatttgcttccactttattcactttctttcataagctatggaccgagcacaaaaataacctagtccaaaagattcttggggccatctgctctgttttgccttctgaggcttctgttgttttcctttactaaagaatggtttccttgatgttctcaattacctattgttttgctgatggttatcttggctctcttcctgtaagaaattcaagaattgtctccagctgcctatagcatagacggccagtcatatgacatttcccttattgggatgcatataagacaggtgaagaactttctaattaaaatatttgagttgtcaattcatagaagaaaataatttcttaggagatttttctgcaatttttataattaaaagaatgcattgggttgttatctttctcaaaccttataaatttctattgaaatctgtacaattgaaaacaaaagaacaacactgagattaaggttagtatacattgttgcctataattattaagtattggaaatagaaagctactagtagctgaatggaatttcattttggtcagattcaattgtgagacaaaatcaaacaaaatcaaacaattcattcaagtacacaaagatgattttggtatctcattttaaagcaaaggcaagaaaaataagccttacgaagaaaggaccttgttcatttcctccctttactttcctcagaatattttgtttcctttttttcctctcattttccaccttctgttcttcaattctactcttctctgttttaaagtaatttcttcctttagctgggcctctcaactttttatcttcctggtttttattacaacctctctaggacctcttcctcattttagatgctaattagcacttactaattgaaattttaaaagctgagtattttaaacactttagcacatcaaaaaattctgtgatcataggcagatttcaaaatagtttagtgtgtaaaacagaagatactagagactgctgccttttaaagaaagtgtgaaaaacaagatatgtgtctaaattttacacttattttaacattgcatgtctaattctgacattcttacacagtttgaaaacaaaccaggtttttgttgggttctggcttgtgtgattactgtcatcagaatcctagcctattcatttcttcagatacaacacagttatcacagattttatagcatttttttctagattctgccacgtctgttccatgctttctacagaaaatcagctatgaataaatgtaactttatcctaggtacagggggaaaagcagtcattcttatgaagtgcaattttatatataattatttttaaaagttacattgtatttacgagatgttacagattggattctctgggaatcagatgttgagacagagtttaatgtatggaatcaagggggaaagaaagtagtcctgacagaggtagaagtggatttccatatggtgaccagaaacttagctgacccagtgatttatgaagctaaaaatgaccaatcagagttgttttgcttgaagtggaagtggcctaggcctttatatccctccctctttcagtcacagatatgcagatgtgctctgctctggaaatgggtgtgaccttgagcagggcagcttctcaactcaggcaatcccttaaggggctgaagctttcctgccacttacactcctaagaccagtggcaataggatactccctgcgaaatgtgggtgacccatctccacatccaacacctaagaaacatttaacatccctagacttatgctgaagaattttgttttaaaatattgatgccttgttagctcatcattaatatgaaaatttctgagaaactcaaaactcacccttttttggtatcacccattttattcacacataatttatctcccttttaacttttattcatgggtcagagatactgctgtatatacatgctttgtactcacatagttcttttaatttttgctttatttttcctttggcatacttataattataaactactggtattagtgttgttatcacttattcttcacttatctttgctattttctagattaatagaatttttctattctattaatctagatttctagattaatagaaagacaatgcatgcagataagtagtgtagccaattctaagttggagcctttaattgtggcacaaagtagagaaagataataaagactcatgtttgtagtgtttactaatagcacatttggggataaatgagaaaataccattaatttgtttatttacacccctcacacacaattttgaccatgctttcatttgtttaattcaaagaatttatgtatttactacctcaatcaaaatgcattatttgacactctagtaacgactcagatgcccctttagcatctaataattcttctttcaatgtaaatgctcaataaataaatatctgaaagatacacaatcacagatccttaagagttctttagggatatacagtattgtcaaatactttagggatacatagtactttagagatacacagtattgtcacattttaaactcacataacttggatttgtcattagcttaaagagtttgctcaaatacaataaaaaataaagttagcaaacataaagtcatttgagtatgaaacacactgtttttttaattgctacttccacagtgaaaacttctcattataattagcacttcttaaatataggcactgatctatactttttatttctttttattaaatgcatattccaacattttatctttataaatattgattccaaattaaagtgtctaattttttaaaaaatgtattcaatggtatgttattaatgaacaactgttatttgaacaattcatttaaaataaataattttatatcttttgccttgttaaatgttttaaaggaaaattaatttttaatttgaaaactattcatagaaactttgagaagttttactaatcttaatttttaatatgcttaaatgcaactattagtagaatttaataataatttaattaaattagttaatatatgtcatacacttgtaatagtaccttatgacctcacacttagtgtgaaatggaggtcagctcttattaatagcaagaagtaaacaaataactagggtataataaaactttctaatagtaagattatcagcctaaaatttaagggatatttttatcatttttatagaaaacaatgtattttgattttaataaaacatgaaaaacattttaaagaaagaagtaagaacatggaaagatttttttttttacaaaattaaatattttctgaattaaataagatgttctaatattgagccagatttatctgcttaaaataattaagttttttagtgtgtatcagacatatgtatagaagccactaaggtaggattaattaaattatagcttgcaatgtattacctcattcgagataataatatgtaattagttgacttcactgggaattttcaatttatattcctaataaaaaatattatgtaattgaaaccaacatctgcctaaaatcaaaatgtcatttagaagatttgcagactactgctaaagtcaatggacattgtccctaaggaagttctcaaagaagtgttgtagtaaagagctttctgtgcattattccagcctgagggaactatgttagcaagtatcttacagtccaagatattggtcttcttatatatgggcaagtaataaatcactgtacttgcatatgtcatgtacgtggcccatatcaacaatcagagaagatgtaaatttgttgaatacaaatatgaacaaacatccattgaccaacaaactgtaacaggcaatcaatctgataatgagaaatccaaaagaagactttcttttaaagaaagacatgaaggacattagatcacagacaagctccgtaaggttctcaaaaaacaaattcatctacaaagcacagggaagcatttataagtacacagcctgaagttgattacttgtttgttcatatttttcaaaataaatggtctaatataccctaaaagaacaaattttcacagacatatgtgtggttggtatgtatgggcaggtttattgttcgaagtccatatacaaacatagcgtgtatttaactatttatgtatttaacttctatactgttttcaagcaaactgtactgtctaattgcaccatgtatagaggagtaggctaggacatttagatagcatttggcattttattccaaattctaggaggaacaccaataatctcagcttatgtatttaaaaattagaactgattttaaaactcaaatttatttaaaaaatatttgttttcttaattgacacattgtaattgtacatatttatgaggtacactttgaggtttcaatacatatctatgctgcataatgacccaatcagggtagttagtgtatctgtcacttctgtgcatttatcctttctttgtgatgagaacattcaaaagtctatcttctagctattttgtaatatacaatattaaactgtaaaccatagtcaccctactgtgaaatagaacaccaaaatttattctttctatctaattgtatctattgaccaagctctcctcaacctctcctctcccctcccccctacagtctctggtaaccattgttctactctaagcttctaagatatcaacttcttttattttagataccaggtatgagtgagatcatgcaatagttgtctgtctgtgtctggcttctttcacttaacatgatgtcctgcaggttcattcatgttaccacaaacaacagaatttcattctttttgatggctagatagtattccactgagtataaacaccgtattttcttcatccattcgtcccttgttggacttttaggttgattctatatcttggaaattataaattgtgctgtaataagtatgaaagtgcagatatctctttgaatactgatgtcattttctttggatacataaccactgggggattgttggatcatatggtagttctatttttcattttttgaggaacttctatacttctttccataatgtctctactagattacaatgtgtgtaagtgttcccttttccccacatccttgtcaacacttgttttctttagtctttttgataataaccattctaactagagtaaagtggtatttcattgtggttttgatttgcatttccctgatgactagtaatgttggatatattttatatacctgttgatcacttgtcttcttttgagaaatgtatattaagtttttttgcccattgctaaatcagattatttgttcttttgctgttaaatttcttatatattctgaatataaatcctttgttagatgtataatttgcacatattttctctcatttgtaggttgtttcttcaacttggctaatagtttccttttctgtgtaaatgcatgttagtttgatgtaatcaaattagcctatttttgcttttgttgcctgtgctttagaggttttatttaaaaaaaaaaaatccttgcccagcccaaagttgtaaagcatttctcctgttttctaatagtttcatattttcagattttacatataaatatttgattcatattgagttgattttgtatatggtgagagtttggggtctagtatcattcttcttcatgtaaatatccaattttcctggcatcatttgttgaagggattgtcttttcctcaatgtgtgttcttcttacctttgttgaaaatcagttcactgtagatgtgtgaatttatttctgggatccctattgtgttccattgattcatgtatctgtttttatgccagtaccatgctcttttggttactttagttttgtagtgtatgttgaagtaaggtagcccgatttctctagctttgtgatatttgcttagggttgctttggctatttagcgtctttttgtggttccatataaattttagaattatttttcttttgtgaagaatgttactggtattttgatagagattgtaataaatgcataggttgcttagggtagtacagccacataacaataccaattcttcccatttgtaaacatgggattatgtccgtttatttctgtcctctttgatttcttttataaaaattttatacttttcagtttagagatctttctccttcttggttaagttgattcttacatatcttattttttatagctgttgcaaatgaaattgctttcttgaattctttttcagatagttcactcttagtgtatacacatactactaatttttgtatgatgattttacatcctgaaactttactgaatttattagttccaacagtttttcttgatagaatctttaaggttttctataaagaattttaagatagaaactaaaaacaattttaaaggtgaacaaaataaagagttggatgactgaaaagataaaattcacaaatctttaactaaactaaaaaaaacgagagaagactcaaataagtaaaatcaggtgaaaaatgcatcattacaactgacaccacagaaatacaaaaggagatgtgagagtattaagaacaactatatgccaacaaattagataacatagaaaaaattgatatgtttctggatacgtacactctgctaagattaaattttgtagaaatacaaaatctgaacagaacaaaaattagtaagaaaattgaatcggtaacaaaaagtcttccatcaaagagaagctcagggtctaatgggttcactgctgaattctaccaaaaatttaaagaagaattaatagtaattttcctcaacctattccaaataattgaacagaatgaaatacttccaaattaattttacaagagtagcactactttgattttaataccggacaaggatgcaggaaagacggaaggaaggaaggaaggaaggggaaagaaagaaagagagagagaaagaaaaagaaagaaagaaggaaggaaggaagggaagaaagaaagaaagagaaagaaagaaagaaggaaagagagagagatgcaagctacaggccatatctctgagggacacagatacaaaaaatttcagcaatatcctaaaaaattcaatcccacagtacactaaaaagaacaggccgggcgaggtagctcacacccgtaaccctagcactttgggaagctgaggcaggcgaatcacgaggtcaggagagcgagaccattctggccaacatggtgaaaccccgtctctactaaaaaatacaaaaattagctgggcgtggtggagtgccggtagtcccagctactcaggaggctgaggcgggagaaccacttgaacctgagaggcggaggttgcagtgagtcgagatcacaccactgcactccagcctagcgacagagtgagactctgtctcaaaaaaaaaaaaaatttactcttaatgacttaatacaattcagttttaattttaagattcattaccactgttcttgtacaattattttataattataaaaaaaagaacattcactatgatcaagtggaaatcatcccaggcatgcaatgagggtttaatttatgcaaataaatacatgtgatacatatcccattaacagaaagacaaaagcatatgataattttaatacatgcataaaaagcatttgacaaaattcaacatcccttcatgataaaaaaaaaaacctcacaacaaattagaagtatgtaactttatgcctaatttcaccatttctattcagcatagtactgaaagttctagccagttattaggcatgagaaagtaataaaatgtacccatattagaaaggaggaagtcaaactgtccctgtttgtagacaacatgatcttatatagagaaattcaagtgtttctgacttcaaaactgttgaagacgttagtgctacttaccattatctcctgagcacatgagggtcagtatagaacttctttacccccttgagtttaggcatagctttgtgattggttttagctaaataaatctatgcagatggaacatatgccatgtgtcacttaaagatggaagcaattaattgctgatagaagactctccaaggttgttttctctcttttgttgttgttgttgttgttgttgtgttttatttatttatttttttagactaggtctccctctgtcacatcggctggagtgcagaggcacaaacacggctcttaaagctttgacctcatgggcttaagtgattctcctgtctcagactcctatgtttctgtgaccacaggcatgtgccaccatgctcagctaattctttttttttccgtagagatggggtctcactttgttgcccaagctggtctcaaattcctggcctcaagcaatccttccacctcagccttcctaagtgctagaattatagatgtgaggcactgtgcctggccaaaggttctctttcaatgcagcagcaatcctcgattggaattgatgttggaattgcaaagttgaactatcctttgcttgatggttgtcttggaatatcatctgaaactgcagtttccttgtataagtaagaaataattctttcttgttctaaataagtgctattatttgttttgttatcctaaaataatctagcacactctgacgaataaaaaaaaatcaagtttaccctaatatgctacattgtcacggaatcaagctgaaagttaccaagctaaagataattaatattttcacctacaaatcaagcttaaacattcttatatatgttcctagacctaattagatgtgtacaagtttggtacaaattctcaaatatcagtcatcttatctttttaaatggcccacagtagtagccattgaaagcttgagtagctgctcaagctcagcaagtacaaaattagaccactatttctgcctaccctcaaacctatattaccttcttaatcatatccagggagaaccagggagcaatcctgcttcttaactcttcatccctccccactcataaaaagctatatggaaaatcatgtggattttgaacatgtatctatcattgtctgtttccttattggcactactaagtttggaccaacatctttggaatataactaggttagttgcaacctcctaaactctgaattatcctctactcttgtcattcaagatatcactgtaaaattcaaatctgatcatgcataaagtactttactgaatgtttgttatagcaaccatatattctctaccgtggcacatcacatcttccatcataatttctttgtatacatttctgtcttcattctccaccaacctatgacttgcttgaggacagaaactacggattcatctttgtagtcttagttctcaatcctccctcacccatcttatacttgttcccagcctaacctcagggaatatcccatgagaatcctagctgtcaaataaagacaaaacattaatacctaaaaacagcataatttatgctgactcaaataaggtgctctcagaaatgtttcgagaacttcaggactaattttccaattcctatttatcacttcaaagctgaagtaatgtcacttatttctgttaatagaattgctcagaaatagtttctgttgttaagttcaggatttacataatttaatcaagtacatgtaatgcattaaaagtttgtaatttagggtatacccaatctaagctacctgtttatatttgcctacaaagcacatacacacttatcttataattgtgaaaacagtttgggtagacaaagacattttttgttgcctactaaaaatactgaattttgccagacactgaggagaaattgcaatgtttcaaataaaacatcattgcaggtactattgtaagcctaatagcatatatatatttatagagacagaggtaatagagagacttattgtcacaactttgtaatgtacttgcaaaataatcttacaaaaaatttaattaaaaagtatagaatttttaaattgttgatatttaataggatttgttctaaaaaatgcttttatattttccttacgaaaatcagagaaaaacacttttgctatgatagaattatacacacagtcattaaaatctgataagatggctcctgctaagtgaactttgccaaaattaattgagcaagatgcacctgctggtttgaaaggccagctgtaacagtatatgaaagaatgagagagaggatgtgctgagtgtatatgtcacagagactggggatattcaattaatattttcacttattagaaaagatgaagcaattgatgttcctagtgatattttaaatgccagtggtattaattctgaataattgctgtcattatctgtatattattttgcacaggtaagcagagtaaatttagagaacattatagtttaagtgtgaaacaaaatgactaaagaacctactataactttcaaaatcaatatttggaatatgcaaatgattaagataataagaatgtacatataatgaagagtatatgatattttaaatctgacaatttaatgaatgaaaagataaaataaaatattattatacaactttataccaaagatgctaaggcaagaagtgcctgacacctggtagatgtttgataaatatttgttaaatgaatgaatggataaaaaagagtttcatagagagtcttgaacagaagactgttcaagagatctcaaatatctgtttacatggagagacaaatattttttagcccataaatatttaaaaccaactgaaatatttgaaaatatatttacagtcatagtatgataaattgtccattctcacaaagtagtcactgtattttggttggctttcttaaacagaaattacctaaactaaaaggattactactgtatcttttcttatttttccatactttttctggtgcgtgtgtgtgtgtgtgtttgtgtattttatatatatatatatatatatatatatatatatatatataattttattgtatgtattaatataatatatatcactgatatatgtgtgtatatatgtatatatgtatacacacacacacacacacacacacatacatataaaatatcctctaagagaaaagacagaatggagagagaaaaaataaaaggaaagaggaaattatccagagagacaccatgagttatggtatctactctttcctccctagagataatcacatctttctaaacttacatataaattaataaatccacaaagtaagaaataggcaaaaatttctattatatataaaatacaaatttacactagccatactataaatgtttgcattgttaatatgcagataaaaatgtaacttctgtcaaatatctaagaagataaagtccccttgttctcccatcttgattaattattttctcttttgagaacatatggtacagaaagaaagaactctccatagttgtgaaactctttagctcatctcatcagacctgataatttggaccttatgaccaggccagttgaaaataattatagtgttaataatggaaaaaatgagattaaatcaaaattagttctatttagctcagattcatgctgacgtagagccaaaagccagctttagtttactcagccttcctttggcaatttttcagtcaagtacatgaacatttattccggtaatatctagtggtgttttggcctgaacaaatcaatggattactacaaacaacacaatagttgccaaataaacttaaaatatagatcaattagttcacatacaaacacactgactgcttcacactatattattaaattgaaaaactattccattaacacgatgcattactataaaagaattggcatatatgaatttcttaacatgctcccaactctacttctaaataaggaagtttactaaatgatccataatattcttcatacatgaaggtcaaatactgtttctatatcaaacattaaaataataaattaccaaagatgtattttccaagtttggtttatccagatattgataaaatattatgattctctattcagaaattgtattactcaattgatgtgattgattggatcaaatgccatatatagttgtactttcttctgtcatataaatgaggcaacaatggccttggtaaattaactctaccattgtttacttcttcacagaaggctaagaccattacctcaaaagcccaatggtgccaaacataaattttcacacatgcaattgttctgaacaaactcctgataagcactatttttagcactttagagcctagctccattacatatctaggaaaacttcactcaacatttgttagtcatagataagacacatcctgaggctatagatgacaccaagcgactgttgatctttggagttctctaactcatcgacttccagttatagtgctgagctacatcacccagatgtataagctcactctcatattcctttcttcctggagctcctttgccctctctgcgatttgggttctggccttctgcttctgtttctgaaacatctgctgtgtatgcccctcccacgtaatcctaaacctacacaattaaatgttattgccacttcatgatcatgtctttttccttgatcagccctgaaaccctcaagttttaagcataccttcttaagttttaagggcactgaataaattttaaatataatcgttaaaatattttatatcacaagctgcttgctacacaattattagaataactaaaacaatagaacagtaaaacaaccattattaattaaaatgccaagtaacagggactctcatactttactgataggaagtagtattacagtattgccattccaaaaaatgatttatcagtctcttataaaattaaactatactttcatatgacttagcaatgctattcttgggtatttaccatagagaatgaaaacctattactctagagaatgaaacattaatcgtattcatgaacacttatagcagttttattcataatcattaaaaatggaaataactcaaatgtctttaaatgagggaatatcttatactggccactgcataacaaattttgggacatttgtataataggaaactactgagaaataaaaataagtgaactataaatataaacaacacttggatgaatctcaaagatatgctgagtgaaagaagtcaacttaaataattcatgtaatgtatgatacttttatataatgttcttgaaaagtcaaactataatgacaaagaacagatgagtgattggtagggtttggagtgagggagagtgtggctgcacagggatagtgtgaaggaagttttggtgtgaatggaaatgttttgtatcctaattataacggtgattacacaaatctttatgtgtaaagattcatagaactctgcacacacacagaatcaattttgggtatgctcctttaaaaagttaaatttaagtctttacattgaacaataactggaagtagaaatattagaattctatttattatttatagtatattttattatttgtagtgtattatttacagtatattttctcttaggattgtgtatgtctttactacaagatacaagcaactgttgaaatattccattattattttcactgtgttttgatgtcacaccattactcttaaattttacaggaactttaatgtctataatttcatagtcattaaatttaaaactattcattctctcacaatagatatttaaaattgtgagttatatggcttacattttaaatatgtatactttttatggttcttaatatgtgttgtcaatgtgtcaaatttttaacatgtacacatttcattctcattatatttacattttatttggctgaatttttttctatacttcaataatcaagcttgttctcttgatttccaaggtattcaaaataatattatttcatggaaaatttcttttctcacatggataactggagaagacatttaactggctttcctgcttctattcctgccctcatctctgccgtatttccctctcaccacagcagtcagaatgactgtttccaaacatgtcagaccatgttacccctctgctcaaaactgcagtagctccccatttcagggtcaaaattaaagtctttcagatggtctctgaggttctgactcttacttgcttatctgacataattctctgttattaccactctttaaattgcacccctgacacactcctggttgtgcactagctgtttcttttgtctacaactttatttcccaaacaattgtcactgttcattgcctgacacccccaaatattagatgaaatatcactttctcgatgagatttcttctaatcaccttgtaaacaattgatataaaattggtaaacctattctcttagcatttgctgattttctcatattgttttactgttttctatttttattaacctatcatatattaacataaaattatttatatttccaagtacctaatacagtgcttgacatatagaaggtgatcaatacatatttgttcaatgccagagaataatttataaactaatttgtgcaagaagtattttatgtatgcatataaaaataataattcatgatcaaatattgcttgatgtgtttatttaaaaaagtatggtttgtctccttaaaatatttgtcaggaaaataaacgttgagtttaaaatcaaatataattatgtaaatgacaactcagtcttgaacattgagatatacttcaagttccctcttgacccatttatgcctagtgttccattattggagtgctaagcatgtgggagttatttgtattctattgctcaaggtcatcaccaaggtctgactgcaaaaattcaaaaaattgcaacctcaggcataaatgggttaactgtgatggtatataattttaatatattgtgatactatatacttttaatatatttaatttcatacaaatgtatgatttggtgcttttatctttatcctaaagaaaaatctacctattttcttttttcaaatttcagttatgttttcaattttcttctatctattggattccgataaatggatgtaaattgtcatgtagtctaatcttatgcaattacgcggtccccagttaatgcagagatcattcaaaagtatacacattgatgcattttaattgttattttgtacatacaaccaagatcacaggagacacaggagatatgaagcaaagaagactttttggatacagtttgtaagattagatatacaactacagggggtagatatttctaatatttatcttggctgtcccatgaaggtagttaaattttgtttactacagaatagcaaattacactgtctggcttaaagaatgcctgagttgtagtgcatgataagatatctcccaaattatgtcaaatatatctgtgaaaactgaaaataagactaaagtttgtaatacaactaaatgccaaagttgaatctctaccaacatcaaagttaatgtaatcaatatacaaatattttgtcttctcatcatctaaaagaaagtaaaaagtttcatcatccgtctacatgccaccttttaataaattggagccctatctcctctaaaccatctcctctccccagtcgttttgcatctattctgaaacagcaactccatatgatactccaagtgagcatacaggagagagtctggaaacttcggtttttcatgcttccattgattcagagcatagaagcagaatccaccacagtagactagagaatctgtagatgttcaacaagaaccaatgactaggttggaaacttaccttgtgttccacgtgtgggactgagaaatttattttgccattactcagtgaagagagatgaggcttaaaggtatccacatgacctaattactaaaaatttctgaattggggtagctttcacttctttaagtaatgttgaaaaaacaaacagcaatatttatagatagttctacaaaaatagagaatagaaccattgttctgaatactgaaataaaatataatttagataatagtctactgcgttaataagaaaaaccttttgccatattcaagaacatacaatgtctataaaatgaaaagagaagaacaccaagagagaaataaatgagataaaaagatagcagaaaccagttgtggtgcttcacgtctgtaattccagcactttgggaggctgaagagggaggatcacatgaggccaggagtttgaggccaggagtttgaggccagcctgagcaacataatggtacctcatctccccccattttttttaattagccaggtgtggtgatgcacacctgcagtgttagctacttcagaacctgaggtgggaaaatcacttgaatccaggaggtccaggtggcagtgagccacgattgtgccgctgtattccagcctgggtgacagagtgaggctctgtcacaaacaaacaaacaaacaaacaccaaccaaacaaacaaaaaagacagataatagaatgaaatggaaaagaagggtaacataagttagaatttatagacaaataaaaattggaattaaatttacatcagagtcagagaaaagcacaattagcgttgagataaataaatatatttttaaaattcaaattggaggaactttctaataccaaaacaaaatcaggccacgcatggtcgcttattcccactcttgtaactgcagcactttaggtggccaaggcaggaggatcacttgagtccaggagttcacaaccagcctgggcaacatcatgacactccaactctacaaaattttttaaatcagctgaatgtgttggctgatcccagctactcatgaggttgtggtgggaggatcccttgaggctgggaaattgaggctgcagtgagctgtgattgtgccactgccccacagcctggatgaagagtaagaccctgtatcaatcaatcaatcaatcaatcaatcaatcaataataaataagagaaagaaaattctacaattttgagaaagaagaaatgttaatgggacagagaattagaaaaacaatttagaaattgcattgccctcagcaatataaaatgtataatagtgtaacaagttttaataatttttctagatcattatattataatgtatatatgatttcaaataccaccactaaaaccaagaattggaactaaaaaaggcattgaggtaatggaagcagtaaatataagataatattttattgaagaattttgtatatactgtttttattaagggattcagttaaagagatatttcattgttgacacttagacctagaatataaaatacgacattaagcaaatgagtcgaaagaaataaatcctcaaaataaaatataatatgtaccatttattagaaacaaattcattcaggatagttacaaataaaaccatgggagaatatgttggacaatgtatatttcatatgaaatggaaaaattaaattaattccctttaatatgaggaacattgttaaaattctcactgttacaaccatttactactgtcctagaggtcttggtcaaaccaaaatgaaaaaaaaaaaggaaataagagatatttggaaattggaaagatttgggggttgatcaaggaaaacagatgtgatgaaaaaagacagtaatgcacacacaaacttcattgaatggcacttggacagggttgcatgagaagggacgtctctctaacttaagaccttcagacactaattgtgaggaggccaccatccagaagagaaggaacacaaggaaactcctgaggtaaaagggaatccgagagagacttacttgtccaagtgataactaagcagcaccacggaaagtttctgggtcagagagctcttaagggcagtagcagcttaggctttatcaccacaaagctctagctcatcaatgcccagcagatgctatatgtagttttacaggttatacaaagtaggcaggctctaaatattagtttggtgcaaaagtaattcaggtttttgccattgaaagtaatggccaaaaacacagtcacttttgcacccacctaatagctaaaaatcttcttgtttggactatttttaaaaccattatgtatgtaaaaattttaatgtggtaccagctggcatttgagctaacagatatcagtctgtagtgaagaaatatcaatgtaggggccaatatacagaggcctttttgcctcacttatataacaaaatttaaaaattggaagataagttagttattctaatcatatgcagagaaactggattatctagcaagtaaatgcatagaacaaataggtaaaatactgaatgaatacaagatttccacaaggttgcagaatacaagattgatgcccaacattcaatgccatttccttaccaaaagactaacagttataaaaaaaaatcagaaataagatattattccctagaatgacaaaactgatacacatgactatttaaacacacacacacacacatacacacacacacaaacactcatacaaaacccatatgagagaaactatcataatgaagatttaaaaatctgaataaatgaagagatatgtcactttatgagatttcatgaattaacagtatactgtctgttctctccaaattatcctattaatttaagccaaattaaattatatatttaataatgcttaataacattacttaaaaatacataggtaaaaaggagccgcaaatgtaggttaacactagaaaataatagtgtgggggtaattgtccagacaaaataaaaatatatgacagaattatattaagaagaatgtgtagattttgattatagcttttcttttgattaaaaaaagccatagacaaagataatatattaagagatatacctaaaatgtctccaaactagaagggattaattactatcatgcacacattacttttgaaaataaagaatgcacatcactgactgtgggaactccaatgccctgtttgctcctttccccaaagtctcaaactagactctcagtggtttctctgttgggtttataccagagaagaactaagggcagctcaggaaaattaacctcctgagcactcctatgacactttatccttaaagggaaagtaacaaaaagctgtttccagaaccttaaacagggaatcatggcaagagatgttctgatgcttcttcctaatcagagccgaagctacaagaagagacagtgacacatataacttatttttgctgttttcttttttcaaagccttcttctcatgctttttggggcaagaataggggaaattttattcttacttcctctaggactttgctattattcccactaagctagattagctactttacatttagttaaataatactatgcacagtgagggagaagtctacggcctgggtgcttcaggatggacttacaacataacagccagcctttaaagttatttatttatttatttagttagttagttagttagttatttagttattttgttgcatggccctattttgcatgtcaggacctgaatataacctcctttttcattatgactcttatgtattccagcgtccttttaagtatttgggtgcctttggttaattcgaacaaaagttacctattaaggaaatcacaaataaaaaacatataccttgatatacctatgattgcaaagcagtgtaagttttatggaagcccaatagaaggagaattctgagagagaaatttcagttctggtgattgttacatttcaagaaaaaccaaaactgaaactctattctcttccacagaaatgtctcattcatttctgtgaaggatatctttaatgtccttcacagatgttaaaactttaagattctatgagatatggcatcaggaatatctcactctttttaatattttatgtagtctctacttaaatacttttctttacttctttgatctaatgaatttttctgtgaaacaaagaagaaatcaaagttcaaattcacctctagggttgccagataatatatatcgtacactcttaaatttgaatttctgatagaacaatatttttcagtataagtatttcccattcaagatatgagatataataatacatccattccttttctgaaattcaaatttaactggacttttttctgtttttatttgccaattctagcgaccttatataatacatcaaattttatgagttcataaactttgttaatcatgaaattggaagaagtatggtaacaaccaattttttgacatgtaatatcataagtagttcaaactgaaaacgtttaaaacaacatttttatttcagtgaaattctttcagttatacttttgaatcttcataaaaaatattttcagtctggtaaatatacatagatatgtatttcttttccattaaaatttttaaggacataatgttttcatatattcttttatcaaatattttaggtcagtgaatctaaaaataggatcaaaactcaatgtatgaaagaaaatgtatacaccttcaaatctatgagtcacatgaacttcaccaaaatcaaattttgtttttcttttaaaattattcttctctgtattttttatttcttttattttcttgaaaatttgtatttttcaagaaagagggacattttgccattagtactggtgaataccattcagctcttttttttaagtcacaaaaagccagaggaattcaaacttcaacatatctctcactatcctcaaaaaactttcttcctcagctatacataggcatctattctgccaagcatctgctgaggaaatgatgtaagtaaatttccaaagattttaagtccctagctttagcctaagtatagcaattgccagattgcactgtgacttaaaatcatatcaaagaaaaatgcccaagcttcctccacatggcattttaaattttatgtatggcttttaaaaattgtctatataagagattagatacaaaataatactttctcaggaaaaggatgtttctagaggagtttatggtaataccatcttccttaaaatgtgcttactttaaaggaccgatagcaagcaagagaagagtatatgccagcaattaaaatattgtctccaactgagtatcaaggagaaaaatatgctgatgtcattaatgtttaaaaacattccttttaccacaagtaaggtatagacttaagaaatttttaaactcatgaaagccttctgagctttcttttctctaattaatgggtgcaatgggaagtaaagtggcaaatactatttggtatcattctgaagattaaatgtaaataatgcataaaatacaatgaacacattgcccaacatgtagcaagtactcaataaatagaacttattattatttttaattcaattttaatttaatatattagattggttttaaaatttatgaagctagatgtccttgatgcagtcttaccaatctaaatatacattcaatttttttgcattaaaagcaatactcattaatcaagaatacaatatattgtcactaaccattctatacaatagatatcacatttaaacgttaaatgattacatatggctagtactgtgttagccagtccaaagacatgaaaataatctgaaatttttaagtaactgagctgacagaaagactgatgattatatgttagtactataatcaaagagagctaactgtaaatctctggaatttgacatgtcatccacattaatgtataagttgttaagtgtgataccaagaagagaaattgttacctacacgccaaagtcacttaagaagatggatgtggatatagtgtttagttctaaaattaaaggtgaagctataaaaaaaggatggcttgggaggctgaggagggcagatcatgaggtcaggagtttgaggccagcctgttcaatacagtgaaaccctgtctctactaacaatacaaaaattagctgggcatggtggcacgcacctgtaatcccaactacttgggagactgaggcaggagaatcgcttgaacccaggaggcagaggttgcagtgagctgagatcgcgccactgcactccagcctgggtgacagagcacgacgccgtctcaaaaaacaaacaaacaaaaacgaaaacaaaaggatggcatagaatgtttacaaaagcaccagcctgggcaacatagtgagacctcatctttacaaaaaaaaaaaaaaaaaaaaattgtcagatttgttagggtgcctgtggtcccagctactcaatggctgaagtgggaggattacttaagcccaggaggttgaggctgctgtgggttgagatcacatcactgcattctagcctgggcaacaacgtgagaccctgttttaaaaacaaaaacaaaaaaaaggagtttataaaatcaactaataaaataaagataaatgacgatgaattctgggattgttttttatattagtacaagagagtaaaaccaatgattttcagatcttggacaacttgcttagcatatcacaaccagcttttcactaactcctgctttgacatcattgtaatttatgttgacgtaattgaaaattcagaatatgatctcattacctctgtagccagagccattagaaagaaaaatattccttactgtaaaataaatgatatggaaaatactagttgactattttttctcttctatgaatcataattatttgtattcttgttcacaatagaaatcatgtgattatgtaaattaccattactattctatttctaataaaatattttaagatattttaaccttaagataacatggtattgtcatgttaaactatatttcataatatttttcatggcattatccttttaaatgagacatatttaaaaactaaatatagaacctaaatgggagaagaaatttggttagattatgctatgttttatagtgttaaactcttctatatatagtttatatgaagatgattgcatttgttcatcttgctttaattcatattactcagtgcctgaataaacagtacatttttttatggacacaaactaacatcatattgtcagtttccatgcactttgaaggggatcatgtgatacactgcaatatgtatttgtttaattacttctcaaaaacgaaatcatagagttggaagatccatataaagaagtgtgtaccaatgttgaagatgaaatgtaattataacaaaatattttgtaagtctgaaagccatttatgtctggtaaacataaccatcatggaagaatatgggtatgtttggcagatccatgttttctcttggaaggcagtacgttaggatgatcacaaaacaggagatgttttataattattttgcaaattatattttcaatatctacactaaaatgtcagatacatattcttatggaaaagtttgtggaacaaatttaacttaaaaattttttaatgtaagcagttacaaatttgatgagcttttgaataacatgccttgaatttcctgaacaactcttcattatgacttacaaattatttggaattcagtaaagtataggatccaataatatagcacataaacagaaatataaagtgtcttatttgtacaaaaatgtgattgtactgacaggaaaaatttacagatgagataaagttcaaagagaggaagtcaaacactaaactacgtatatttctgtatttgagagccatcactccatctcattaactggtttatgtatttaggcatattttatttaaaactcactatttttcttacttaattcctaggttggttcttgtaaatattgtctttataaaattgtttctctcttaagatttatttttttttaataatatgctcttatttggtatatcctctcttgtgggtccaaactcctaaggtccctaggttatgctttcataagcaatgacaccggtttaatgaaatgaaacaatttaccctcataggtagtctacttctatcaagtaatatactagaattaagtcactggttcttagacattaaaaaatatatagcaaataatgaatccaatggtgctaaattcatgtgaatatattacatcaggctatcggtaaggagagaaattcaggtcagaatgttattactatatgtagacagattcaagcaaataaaactagagaaaaaggtaagggactgtatggttaagaataaattgataaataatagataaatttgatatgtcatttctgtgtaagagataaaaacaatatccttgatgaggatggagtaaggaaaactttaggaaagagaaattgaacaaaaggcaaacaaacccaaaaatcttggagaatttgaaaaagaagcaatagaatattaaagaggttactgtgtcaatacctaagaaaagatggaaataatgtattggcagtagtgctgagactagaggccactgtatttttaaagctataaaaaatgttgggatttccaccaactgtggtcagtaactgtgacacctggattttgattaattactaaagaacaaaaatttatgcaagagaaaaccaataattaataatttggtactatctagatgctaagcacaatatttatattttagatacaagatctaactaaacttcagaataattatcttttttgttttttactcaactactgcacatgaaaaaatttagcttcagcaaagttaaatgttttggacaagattaataaatagtagatatggggtgacattgaagtccttgaacttcaaaagaaatattttcccagcaaataaaatttcctccacaggaaaaataacaatgttggttatgggatttttgtctcaaaaaaaaaaaaaaggaaatgtagaatgattcagaaagtgagagaactagaaggataacaaggcccagtgttttttagagtaatgatgaggttcttgggacttttgtggatgagttgctacattaaagtggttgtgattttccttgcagttaaggagaccaaaaaatttgaagtaagattttaaaataccgatgacaagttttgtatttgaaaagaaagactatcaagtaggtgtatccatcaattagtgaggagaaaccaagaagacagtaaatgacaaagttaaagcagtagcaaagctgatataaggtgacatggagctcaaagaagaagcagattttgaataatatgtgtaaagcaatagtttcataaatgcaactgttagcttagagaaagtaataatgacccccatggggaatggtacatggtagaatgcatagctttctatgattctgtaacaaactgcagaaagagaaaaaagaacgtgtggtgtggtagactatcaaaaatagtttcagcaaaatttccaaccaaaattggtcttacagacctttctctacccctttatcctaaatgagcttctataaaatcctcagcaaatataatatacagagaatgacaatgtatgatttctgaagatgtcataaaagttaatacagctcattgtctctattgaagcttattgtggaatttagcaccatgtataaggaagccaatgccatgtagaaagtcagtatgtaaatcttccaacagatagcatcagcaacatctaagccaatggctggcatcaacttccagatttgggaggaagcaatctttagataattctagcacccagtctttgcaatgacaatgatcagagcaaaatcaaaataaaattgctgatttatgaaaataaatgttgtcattgttttaaaccacttaatttagggttagtttatcacacagaaacagatgaccagtaaaaactttgagtagtgaagatgaaagagcactaagaattaaaagtgctcaaagaactggaagtgaacgacagaggaggaaaagttaggaaagaaatgagagctccggagaatgtaaaaaacagagagacttgcattttggctgaggataagaagaacatagatcaaaggcacagagaaaaaatatgcttgtaatatatactaaaatcccagagtttcagctattgataaaagtcagattttttcagacaaaagtattttatcagcattcaaaataaattactcagaaaattatagtgtctcttgtgggaaaactaaccacctcctagttcaactgtcatatatatatatagcacttaatggttattgtatttattttctcatagttaaaatcactgaaggccatctttgtatgaaaacattgtacagagttcaaaacactaaaaatacacaagtagttcttggttttgggtcataaaaacaaactacattaggtgagataaaagagctactgcttttcatttattcaataataggtacattgaatctttctagcattggtctttatatatacccagtggaacaatgttaattaataatattttgaaattttaaaataaaccgaaaattcaaaattataggctaaatttacacataatgctatactaataaaattctgtgtggtcaaggatatttatttgaaaataattttatatttagttaatgataagtagccagatcattacttttctatgaaaaaattctgaaaagtataagaaggcaccattttcaaattaacatctgggatttactcagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgatttcagtaagccaaaaatgatgttcactctgtatttcttactatctcaatgatattcttcattatacaagtataacacctcttaagagcaattatttaagtaaaattttgtcagggagaagatatgaggattactctcttattaaaaaaaaatttaaaaaaaagtaacttgccaaaaaaaggcatgattgaattagagaagctcccgttttttgcgaccctgctcctgaagtgaaaccttgggttctaaacaccaaatggtggcctcatctaccatgacgcatgatatttgttttatcaaacagaataaactctattaaagatgctccttaaaagctctaatttcaattataccctgctatcagagttggtctaccatagatagactaacaaatactaatagaataaaatctaatgcataaaggacagaaaaaggtattacatttttccccaaatttacaaaattgattgttcattaagatatttatatgtacatcttaatttaattcacttatctcagattatttttaaatttgcttttaaacttgatggaaaattctcctgaattgtggcataatttgagttcaaaatatattaattatttccaaatctttatcttgaatcaggaaatgttcatttattacaagctatttctaaaactgcttttttttttttgagacaaagtctcgctctgtcaccaggctgaagtgcagtggtgcgatctcagctcactgcaacctccacctcccaggatcaagtgattctcctgcctcagcctcccgagtagctgggactacaggcgcgtgccaccaggcccagctaatttttatatttgtagtagagacggggtttcaccatgttggccaggatggtctcaatctcttgaccttgtgatccactggccttggcctcccaaagtgctgggattacaggcatgagccacagtagccagcctaaaattgcttttaaacctataaaataagaatttgattgggttattaaggtaagcctgaatatgatgaagtaggttgtaaaaatttcgaatttttattcatgctaatcaaatcaacattctaagaaatccagtatggtatctattgaaaggatgatgacactttaataattatggtattgtgcttttatagccagcttctaaaactgtcatatcactgagtatcacagacaagatacaataataaggttacccacagagaaaaggtaaaatgccttgtaaatttaactttctagattttcattttcaagtttttgtactaaataaaaactgaagccatatgttcagaagtgttcctgtatctgaaaaataagcttatggcacttccccataaaacacatttctaagtcccaagatggagtaattagagagatgtttctacatggagttctataaattgtcacacctgtttagttgaacaaagaatgaaaatatgcagacttcaacagaattcaagaactcattaaaagacttacactttaccagcagaaattacttaatataggaaaaacgtcagtcatttttcaggcagtcatgaagtgatttttaaatcactgaaaatgacaaattagaagtggaaaattatcacaattatataagcagtattactgcgatgtatagaacatctgcccccagtgatagccaattcaacattctacaagggaagccaattgacgcattcaatattacaaggctaaaggcagttattacatttttttcacttttaaaacaaagaaagcaatcatgtaattttcagttagtataaaaattgaatacactctgagtcaaaaataagcaggtatcatattttccatatggccatttgtagcaaatcatacatttcatttttaagaaatgatatatttttcaatcttttttctgtgtgttaataaaacatggagagaaagctgtgattcttttcgttctacacatggccataagaatgtcagtactcaaatataactctgtgatttcagactaaaaaattgtgtcatacctattttcaaatatgtctgtcagaagagaatgataatactttgaacttcttttaagattaagaacatccccacatctcatattctcctgattatcaaacatttattcaataccttatatgtgctgtaaaatagggctgtaaatttgaatcgatcacaggctttgctgtcaagaactttgcaaatcagtaggaggagtaaaggaagtggatttttgcagaagtgaaggagaagaagagagacttcattctagagaagatataatatatgaatgacagcagagaaaatatgaatgtatatggcttgtttatgacacaatcactaagactagttgattagagcaaacgactggttaagaaaatattgaaaaatgcttataaaagtagatagacataaattacataaacacctgaatgccataaaaaggatactggatttggctatattcacaaaatggtggacataaaattgaatgagaagttgttatgccaaacaataacaaaagtagcaaaagctaaaattaattatatgcttaccaagtattttacatgaattggttcatttagtcttaagaaaaacacatgaaagatgctactcaattctctttccccttaaattcaccctcttgacagtgctccatttactggtttcctcatttatattagtgaatttcatttttaaacaattaccaaattatagtgaagtcaggaccactttacaagaaattgatctttatgcctaattatacataattgattttagttaaatatcccaaattactgtttctacttggaagggccctgtttagaatcactgaagagttgcttgtttcactgaaaacacagaaaagttcttaaaattaaaaagaaaaagagagagagaaagccacattgacatttgctattctgtgttggtggtgtcgcttttttcagatgaactctctcactgaaaactacaaaaattctgtataaaaacacacagaaatctgcacaaagtcctttaagaacgaacaaaaccaggcaaaaatagaatgcatgagtaaactcagaaatttatccaacgaaattatctaatctgtagaatagtgagaggaccacaaatggttgaactaaaatgaatagagcctcagtgaccagtaggagaattcttaatctaccataccataaactcagaaatttatccaacgaaattatctaatctgtagaatagtgagaggaccacaaatggttgaactaaaatgaatagagcctcagtgaccagtaggagaattcttaatctaccatacgtgtaactgtagaaggaaaggaaggagacattttggcaaataactccttggcatatatttggcaaatatcaaaagaggctgaattaaagttctggtagaatttttaaaataaattgacgagtggattctaagatttatatgtatatgcaaaggatctagaattgtcagaacaatcttaataaagactaagaaactggaagatttgttttatagaacctcaaatttgatataaatatacactaaccaagaaacactagcattggctaaggaaataaaaatagaccaatagaatagaacagagattacagaactagacatacacacatatatgtttaatttatttatgataagatctcaagcaaatctatgggtaaaaggaagttgccacatggtgctgaactgtatttccatatattaaaaattaaaccaaccttctatgaaatgcgaaaattaactgagtggattataaacctaaacagaggactaaaactgtaagtcttctagaagaacgcattggataaattctttgggattttggaacatgcaaatgtttcataaagaaggcacaaaacatacaaaatgtgttttaaaatgataagtttattttattaacattgaaaacttttgctcatcaaagtacatggaaaaaaattttaaagtatgctgggtgtggtggctcacacctgtaatcccagcacttggggaggccaaggcaggtggatcaggaggtcaggagatggagaccattctggccaacatggtgaaatcctgtctctactaaaaatacaaaaaaaaaaaaaaaattggctgtgcatggtggcacgtgcctgtagtcccagctacttgggaggctgaggcaggagaatcgcttgaacccaggaggcacaggttgcagtgagctgagatcgcaccactgcactccagcctggtgacagagcaaaactccatctcaaataagtaaaattaattaattaattaattaaaaggcaaatcagagacagagaaaaatatttgtattatatgcatacatgacaagtgacctctatccaggacatatacagtttttctacatatcactaataaaaagacaacttaaaaatggcagagtgagtgagccatattggctttcaatgactacaggatattacgggccttatataaatatacacagatactaccatattattaaatatttcattgacattttcatgaataaaccagagaagcaacatattatattgattttagatcaaatcactggagtcaaataattccaaattatacttatatttctgccatttcctcaaatggtaaaatagagatgagattatctattttatttactactttatggactttctgataagaagaaaggtgcatattaaatagtagttaaaaataaccaaaggacattaaattagtataccaaagggatagctgaacccccatatttattatagcattattcataatagtcaatatatggaatcaacctagatgtccatcaagagatgcctggataaagaaaatgtggtctatatacacaatggtatactattcggtcataaaaagaatggaatcctgtcattcctggcaacatggataaacctgtaggatattatattaagcgaaataggtcaggcacagaaagataaatactgcatgttctcactcatatgggagaactaaataaaatttgagctcatggaagtagtgagtagaattgtgagtattagatgctgggaagggtagggagaaggaggatagggacagtttggttactggatacaaaattatagctagatagaaggaatggtttatggtgttctacaacattgtaaggtgaatgtggttaaccgtaatttattatatattttcaaaaagctagaagggagtattctgaatgttcacaacacaaagaaatgataaatgcttgaagtgatggataagttaattactctgatttgatccttacatattgtacagatatatcaaaatatcactctgtatcttataaatataattattaagtgtcaaccaaaaaaagcaaaaggaaaaaataagtattctatacattgaacaacaataaaaagacattcaaattggcatatatgtatatctgtttaataattttagctaaatttatgctttattaagcattcagctcttttcattttataatcaatttacactctcatttctcaatacaagcaataaagtttcattagcatcctgagatctcataattatcaataattactatttattaagtatagtatacactaccttgttggcagacacaaactattttgagacaattttttgtttgttgtttgttttgtttgttttgttttgagacggagtctcgctctgttgcccaggctgaagtgcagtggcgcgatctcggctcactgcaagctccgcctcccgggttcacgccattctcctgcctcagcctcctgagtagctgggactacaggtgcccgccaccacgctcggctaattttttgtatttttattttttattttttatttttttaggagagatgggatttcactgtgttagccaggatggtctcgatctccttacctcatgatccatccgcctcggcctcccaaactgctgggattacaggcgtgagccactgcgcccagtccaattttgagacaatttatagtagggtggagaacacttggaaataatgttttgccaataaatctatggaggattcatcacaatggaagaaattaattggaagattcagaggaagactcagttctttatctggatggaatacggtagcaaaggaaatttttcatgttagtaattgatacagagcctttgcttttaaatgttgtgttattgtggattatgctgtgtttggaaataacagtcaccatcaatgctaataattatcatagtgactagagaaacaagaagaaaaaatgctacaaaataaagtttgacaatgtaaaactaatagcaacctagaataagcttatataaacacctgcctattcaatgccttaaaaattatttacattattaaatgtgttaaacatttgccataaattatcattccaaattttataaatactaagctttaacattgactatacatgtgtgcttatcagctcatgtgactccattattttttaaaattccacttatgagagcaaggactagttcaattctctgcatggcagggggttagagatagggttaaattgacagagattaattttccaaactctatcagaattgagtctcaaaataggattaaagttcaattattaaaaatgaagaaagttatatctgatttagctcctgcctgcttttctttccatgagcaaaattctattcttcacaaattctacccactggtgaggattactcaaatggagaaatatgtactttacattggaaaatattctgtctaccctctgatctaaactgctaactaaatgtcttacactattctctactagtcagattggatctcttgttatctgtccaaaatggtagctgaagttaccatcattgaatgccattgcaaaacctttttaacatcactcatcttggattcaaacatcccagcatccttacaaataaactttcctatcttgaaactaaatgtttatggtagctttaatttagtgaaactaaaaacagtttattttctgacaatcacctgtttctacatcaaattcacacttgaaaatgtgtcattaactaataatgtatagcataataattttaacatttcctggcattaatcaaaaatacacatttaaaaatttagcaataaatcttatagttataaaatttgaataaatcactttctaatggatgcataaatcttacataacatttcaaatttgggattacaattaagaatacattttcatgtggttttatattatattttaattcttaattttacttttataatgtttgaaattgaagtttgaccttatggctaatgattcttatttgtactctatttcacaatatgtgaaatatctgaaaaatcaagaatttgtttttctaagggctcttaagttttgaaatatgattggcatgctctacaccatatttatttgcagccttaatgtaaatttgcattaaatgtcagttattaaactgctttaggtatgacaattataatattccaaatgatatgaattccaaaattctgtttggaaggaaattcaagagcaatgagaacttgacataatggctaattttataataatcactggttgatacggcattaggaatattaattttctatggttttactatggctcattagaacataatattgattatgaatccagactcatatttcaaataatatatattaatatgcacagttgatcatggtagaaaaatgtacatatattggtttctgaagagttttgaagaaacccataataaaatattagaaaatatgtatcaaataaagagatagatggtgtattagttcattttcatgctgctgattaagacatacctgagaatgggcaatttgcaaaagaaagaagtttaacggacctacagttccacgtggctggggaagcctcacaatcctggtggaaggcaaggaggagcaagtcacatcttacatggatggcagcaagcaaagacagagagcttgtgcagaggaactcctttttttaaaaccatcggctctcgtgagacttattcactatcatgagaacagcatgggaaagatgtgcccccatgattcaattacttcctaccggctccctcccacaacacgtgggaattcaagatgagatttgggtggggacacagtcaagccatatccgatggatagatatagacatattttatacatcttttaaatgtgatgcttcctgtacacatttggcacaggctgtacatctcaaaatatttcaaaaaaaaaaaaccctattatagttaccaaacctttatagggtaatcattctagtttgctcaagatagcaccagtttatgctcatggggtagaagacagaatattgctgaagtatctcagttctctccaaatattaaaatgccatttgtcctggatgttttaaccaagtactattatttatggttgcactaaaacaaatagggatgagtttgataaatcaccacttggtattttatattctgccatcatcttttccagaagtgtgagatatagagttatacataagcagaaaattatttttaacatgaggataatatggtaatataaccagtaataacacacctctctttttcaatgctttccagatgcagattttattgtatcaatcattcaaagacagcttgttggactttgaagacccaagcagacaaaagtaggtaattcctccttatttcagttggtatgcagagaagctactaataatgctactcttccagcacaatgtttccaggctgccagtgagcttggtcagtaggaacgacaggaaattatgagttatgtctatgttatatgtgagaggaaaattgaggctactagttttgtcatagggtttatagatatttgtctgtatgttcttgctatagaggtttggtcaattattgtgtggtacaaaacagtggtcagtaaactatagctgtgagctgaataaggccttccacctatttttgtaaacaaagttttattgatatagtgaaatccacacatttatgtttgtctatggctgctttcatgctgcaatagcagagttgaatcattgtgatagagaccatatggatcaagaagtctaaaatatttactatctaactctttacagaaaaatttgccagcccttggtataaatctacaactatttacatattttactatgcactgatgaacatttcttattctacaataaatacttactttttaataaaactatgtttcaaatttgtttccctagaaaatcaatgatgaatatgtagttgcccctaaactgtgccactattaatgatccactgtaggatattagtgacattactgactgtatacaaaccagaatgcatacattaattgagcaatcatcagcatctacttttaaaaatgttagtaaatattttagaagactgtcttctgatgatgagctaggtgcataagcagaaggtcttcttacatatcactctgtgaagcacgtcttttcatttagatcaaatgactgtcccaaaattatttttctcattttttattgcaagttcctctgtgcatacaaaaagtaaagtgatagttgtcaaagtgtcagctcagctagtagacaacttcacttacagttaaaaaatgccagctttggctgtgcgtggtggctcactcctgtaattccagcactttgggaggccaaggcaagtggatcgctggaggacaaaagtttgggaccagcctggccaacatggcgaaatcccgtcactactaaaaatacaaaacttagccggctgtggtggcatgcacctataattcaagctacttgggagcgtaagacaggcaactcactggagctttggaggcggaggttgcagtgagccgagattcaccactgcactccaacctgggtgaaacagtgagactgcctcaaacaaaaaaaaaaatgtgagccatattaataaaagcagaaacttcaaactgataatcagttaattccaacaatggttttctttttccctccaattcattaaattaaaataaagttttgcaagtttattctgtcaaaggcaggacatctgacaatattggtagtgccattgggaatttgtgaatttagcaaacaatattcaaaaataaagttattggttcctgtggtgaaattttaaatacacattttgttaagtatgtggcataatacattgttttgatcaaatatagaaaaatgtggagcagaaaatataggaaatgtattgtggttcacacatagttcatattttgtttcaaatcagtcatgatattcacacaactaaaataaaaactgtagttgcaaaattcacaaataattttaaatacttatagagtaatggaactaatttgttgtgacaaaactattattgaaaaaattgtaacatggcataatgtgctttttttcttgcttcttttcatcaacattcaaagtttagaaatgtttaagtctctaaagaatgactttgaaaatgaatctaagggtgcagggaagctttgacattttggtaacagaatgctctagctgcatcttgctcaaaatcagtttcaaaaatttgattaaacagctaaaaaaatttaagtaccaaagaaatcagtttttgaacattacagtaagttgcattttttagataaagcattgaagtttattcctccatgattcaagaaagacacttagcaaatttaataagacttcaaaagtatctaagattttaaatattataacagtgctttggaatagctgggcttgtgggaagcatttgagggggctcctaaatttcaaggataaacttacatactagagcataatggaaataaattgagagagtcaacaactttgcagtatctaaatttagccaaacgttctaaagaataataaatagaaatcatttacttcatgaatatcttggaaaatgttatctaacaaactgattttgaataagtaaaatatagaactcctacaaaaatattttatccttgaagaggtccttcacatcccttgtaagttctttcctaggtattttattctctttgtagcaattgtgaatgggagttcactcatgatttggctctctgtttgtctgttattggtatataggaatgcttgtgatttttcaacaatgattttgtatcctgagactttgctgaagttccttatcagcttaaggagattttgggctcagacaatggggttttctagatatacaatcatgtcatctgcaaaaatagacaatttgacttcctctcttcctatttgaaaacctttatttccttctcttgcctgattgccctggccagaacttccaacactatgttgaatacgagtggtgagagaggacatccttgtcttctgccagttttcaaagggaatgcttccagtttttgcccattcagtatgataccggctgtgggtttgtcataaatagctcttattatgttgacatacattccatcgatacctagtttattgagagtttttagcatgaaaggctgttgaattttgtcgaaggccttttctgcatctattgagataatcatgtgctttttgttgttggttctgtttatgcaatggatgacatttgttgatttgcgtatgtttaactggcattgcatctcaggtatgaagccgacttgatcttggtagacaagctttctgatgtgctgctggattctccttgccagtattttactgaggatttttgcgtcaatgttcatcagggatattgacctaaaattctatttttttgttttgtctctgccaggctttggtatcaggatgatgctggcctcataaaatgagttagggaggattctctctttttctattgatcggaatagtttcagaaggaatggtaccagctcatttttgtacttatggtagaatttggctgtgaatccatcgggacctggactttttttggctggtaggctattaattattgcctcaatttcagaacctgttactggtctattcagagattcaaattcttcctggtttagtcttgggagggtgtatgtgtccaggaatttatccatttcttctatattttctagtttatttgcatagaggtgtttatactattctctgatggtagtttgtatttctgtgagatcgatggtgatatcccctttatcattttttatttcatctatttaattcttctctcttttcttctttagtagtctggctagtggtatatctattttgttgatcttttcaaaaaaccagctcctggattcattgattttttcaaagttttttatgtctctatctccttcagttctgctctgatcttagttatttcttgtcttctgctagcttttgaatgtgtttgctcttgcttctctagttcttttaattgtgatgttaggatgtcgattttagatctctcctcctttctcttgtgggcatttagggctataaatttccctctacacactgctttcaatgtgtcccagagattctggtacgttgtgtctttgttctcattggtttcaaaaaacatctttatttctgccttcattttgtgaaggacgtcttcaaggaaaactataaaccactgctcaaggaaataagagaggacacaaacaaatggaaaaacattccatgttcatggataggaagaatcaatatcttgaaaatggccttactgtccaaagtaatttatagattaaatgttatccccatcaagctaccactgactttcttcacagaattggaaaaatctactataaacttcatatggaaccaaaaaagagcccacatagccaagacaatcctgggcaagaagaacaaagctggaggtatcatgctacctaacttcaaattttactacaaggctacagtaaccaaaacagcatggtactggtaccaaaacagatatatagaccaatggaacagaatggagacctcagaaataacaccacacatctaccatcatctggtcttcaacaaacctgacacacacaagcaatggggaaaagattctctatttaagaaatggtgttgggaaaactggctagccatatgctgaaaactaaaactggaccccttccttactccttatacaaaaatcaactcaagatggatcaaagacttaaacataagacctggaatcataaaaatcctagaggaaaacctggggaataccattcaggacataggcatgggcaaagacttcatgtctgaaacaccaaaagcaatggcaacaaaagccaaaattgacaaatgggatctaactaaactaaagagcttccacacagcaaaagaaattgtcatcagagtgaacaggcaacctacagaatgggagaaaaattttgcaatctatccatctgacaaagggttaataaccagaatctacaaagaacttacaaatttacaagaagaaagcaagcaaccccatcaaaaaatgggcgaaggatatgaacagacactttgcaaaagaatatctttatgcagccaacagatatgtgaaaaaatgctcatcatcactggtcattagagaaatgcaaatcaaagccacaatgagataccatcttatgccatttagaatggtgatcattaaaaagtcaggaaacaacagatgctagagaggttgtggaaaaataggaatgcttttacactgttggtgggagtgtaaattagtccaaccattgtggaagacagtatggtgattcctcaaggatctagaactagaaataccatttgacccagcaatcccattgctgggcatatacccaaaggattataatcattctacgataaagacacatgcacacatatgtttactgcagcacaattcacaatagcaaagacttggaactaacccaaatgtccatcaatgatagactggataaagaaaatgtggcacatatacaccatggaatgctatgcagccataaaaaaaaaggatgatttcatgtcctttgtagggacatggatgaagctggaaaccatcattctcagcaaactatcgcaagatcagtaaaccaaacgctggaagttctcagtcataaatgggggttcaacaatgagaacacatggacacaggaaggggaacattacacattggggcctgttgggggttggcggctagaggaggcatagcattaggagaaatacctaatataggtgacgggttgatgggtgagcaaaccaccatggcacatggcatacctatgtaacaaaattgcccatccttcacatgtaacccagaacttaaagtgtaatttaaaaatatatatttcatctgcatattttatatcaaaaaaagatgtaataatatcttcctttagcagactttttttaaagaaattaacagaaacctcaacatgtgttcagtgaaaatgtccataatttaaaatgtaatggttaagaagtgtcaaataaacacatgaacaatttcaaattcattggtcataaatgcaagtctgaagaaagatgtaagtaattttatggtgaaaagcatgtgaactgttgttcagactcttcttatgctataaaacatttagcagtaatatgatttaattgtattaaccaaattgatttattaaactttaccataaaagagttcagtatatataccttctgaaattgtatttttcaataataaaggaaatatttcacatttaatttgaaatacatagataaaattaaagttacttgtgtatatggttgtatacatatgcattttttacctgaaaattgctcatcacattcacaaatgaaactatttgaagtaatattgctgcagtttccatggaaacagacatgtggttgacactggccaattatttctgagcaattctttcctataacaatgaaaaaaagttttttttacattggatatcaatattataaccatcagttttccctcaattctttaataatgaaaatatcaaattctgactaatgtaatttcagttatgaaaccatgttatacgatgatgcatttaaattgaaataaaaattaattttgatactttacataagtttttcatcttctgaccccagactataatatccaaatattttttctggcttgtagtatttgagctttatttaatttacataatattttaaaattttaattgtattttcatgatagataatattcatatatttaagtaccagtttttcaacatacattgatagtattgcagtgataatttacaaaatgacacattcaaatgtgtactgtttctcagacttaccccctagccaagggaacaattcaaaagcagaaatggctgcctggattctcagaatatgtgcacaaacttccaaattcaacacttctttgcacttgctggcatatcaaattttccaaatctcacttacacatactattgtggtcccactatatcagttatatacacacacacacacacacacacacacacacacacacagccttccataacatactcattctatgcatatttaatcatcttataataccttagtagaggaatgtgccttgaaaatcccagggcatagcaagtggacaaatgctgttacaaaccaactgcatgtaatttggcaatatgtttttttccccagtttaattaagctcttaatttaatttatgagcagtttttgccattatcattgatgtctttcaaattccttatatactgacatccctgcctcactaatgcagaacttttttcttcatttgcctccaagcaaccctaaatgtaatgaaaatataaataatgaaaatataaataaaaatcattgtgtttcaaaaggttctccaaacataaaaattaaattaacagtataatgccaataggccacaccctaattaaaacttagtgagttttatgagctaaattgtgcccacccaccgccgccaaattcatatgttgaagtcctatccctcagcatcacagagtatctatatttggagataatatctttagagaagtacgcaattaaggttaaataaggtcagtagggtgcgtcctaatccaatgtgactggtgtgctttcaagaggagaacatttacacacagatacatacagagaaatgacaatgtaaagacacagggagaagacagcagtctatggaccaagcaaatagatctcagaagaaaccatatctgccaatctttgacttttggcatctaaaactgtgagaaaataagtttctgtttaagccatccagtctatggtactttgttatgacagctctagcaaattaatgcagtaagcattctcaattgttttgacaattctacatatttcattatcttcttcgatttttaaaattgaagtaattatttataattaaagtggcaaatggagtattcttaatgttataaaaataagtaagcattatttaggtattttatagtgctcaaagcttaacgatttaaagcacctatggctgtaagaaagagaaagagagagaaagaaagaagaaagaaagaaacaaacaaacaaagagaaagaaagaaagagagaaaggaaggaaggaagcaaagaaggaaagaaggaaggaaggaaggaaggaaattgagtaggaagcaaaccattctatgcagttataataaaaccactaaaataatatcccataaactatgaatgcatacacgcaaattaatattctgacacatggtagaaattttctggccaaatgttctttaaaactctttggacaggtgaaaatggatgctttaaagactgtctattaaattgctttatcattcactccaaatcagcagtttgagtgttttcacatttcctctagtctgccttaactttaatcacctgatataccccagcggaaagaagaggtataacttgcaccttctatcaccaatgccaacacagtcaaatgagaatttgatccacgttatagagacaatatattcagtggctattattggtattaacttctataataatcttggtactaagctatcaagttcaaaatgactatttgaaagattggatgaggtgaattttacagcctacaatggcttattgaggtcttctattacatctttttattttatcttattttattttttgagacagtctcccttcatcgcccaggctggagtgcaatggcgcgatctcagctcactacaaactctacctcctggttcaagggattcttccgcctcagcctcccgagtagctgggattacaggcacccgccattatgcccagctaatttttgtatttttgtagagacggggtttcaccatgttggccaggctggtcttgaactccttacctcaggtgatccgcctgcctcggcctcccaaagtgctgggattataggcatgagccgcctccaagtcggctcccattacatgttatcacacagcctctttaaacttggctccaatggagtcagcctcaggcacaggggagaaggaatccccctaaagcctgcctaacaaaattacagttaaatccctgcaggtgatctgctctagatatagctctgctttaaccttccttcctcttttatgaccaaaatacataccaatctgctgttttcgtatactattattatcagctgtgtcaaatatttctctttgttagatcatcgtggtcttatttcacttgtaactctccatgccaggtctgtcaaaccctcaaataaattcttccacaagtttccaagctttaaatgttccctacattttttcagtctttctcctcactttcctccgatgaccccagaatcctctagtatattctcaagtagagagagttttattcccttcaaacttcacgttagcctcaggcagcatcatttacatttttttttagattgcctttcctctggcttaattactcaccaaacatctttttacaaccttttctgattattgccttttattgagcttattacaaccgttattaattataacatcttctttccatccttgtcactatcagttataaatcaccatttggatgccacaccaacatccatttaaaacattgctcttggctcacaattatctgttcctctccaatcctgccaagcagcttcaatcacttcccttcaaccatagttccctaacttcctctactgagatgcataatttattttcaagttatcacctatctaaataccataatcttgggaattcattcagtgactaaaagcttttatattattctgataatcttatgttttaatgtatgagacgttaagaatggatgttgggaaagatgtaaatatagatatttcactattaaacatgtttctaagagccctccttcagttaagcaaaaagcttattttggaggatccctgataggatttgtatatgtccagaatctatatccagccaaatccaaggaatctattaaattttttatttatttttatttatttattttattttatttttatttttatcttttttgagacggagtctcgctcttttgcccaggccggactgcagtggcgctatgtcggctcactgcaagctccacctcccgggttcaccccattctcctgcctcagcctccggagtagctgggactacaggcgccctccaccatgctcggctaattttttttttgtatttttagtagagacggggtttcaccgtgttagccaggatggtctcgctctcctgacctcgtgatccacccacctcggcctcccaaagtgctgggattacaggtgtgagccaccgcatttaaaatgtactttgatttctgttaacagtttataaatgcactgtgtttctctattttaataaaattatatattttaaacaatcttacctgtaaatggtgggtgacagacacattcatatgcttgctcatcccaattttctcttttattaatgcaactgccattatttttacatggtttaaaagaacatgcatcaagttcctggcagtattttccagaaaatggaggctggcaatggcagctatatgtcttgctccaagcttcactaagacatttaccatgaccagagcaaaattctgaactcagagattcctggcagaactgctgtttcactgtcacatttagtcgaagtcccagtggacaaggtgatggaccacttgccataactgtgataaaataatgtgtcccaacactcagccacttagaattaacagtgtgcattccttttagtctgcagccaaaaagtaactgatcttccgttgtggtattttgcacacagccaacgaaagatgtttcagaaacattcatcaaatttatttctggaaattgaagagatggttcagaagaaattacaaggatatctcctaattgaatttgcaaagggcaaatctggggaacagcttgattgcctgaagtatctattttagtgtttacacccaaaaaccagcaatctctgtagaagtccaagcagatgttttctgttagtgtccaatttaccacatatgatgagggttgtggatgccattcttccaccaattgccgtctacatgtttttccatttatgaaagagctgtgaaaaaccatcaggctcagaatgacgattgatttgtcagtcattttcgggtagctgtattttacagtttatcataaagaattgctgcaaaatggtgttttaagtattaccggaaatttccaagtaaagttgtggttaaggattcctgggaattggaattgaccttttttctatacccaaagtagctttgatgacaatgtgctttgatggagaaacaggaattcaaatgttgtaaatattcctttaaacagaaaaaaacatatattgttagtgaagttttccctaaattaataatatagaaaatgctagctctttttgtggatttcataagagcctacactgcaaagatagtgtcaccagcagctggggaccttctttgggaaagaaggccaagaaaaacatgatcaagatatgttgatctggtcaagctttatatagtcacctgattctgaaaagttctggtttcatgacataattaagccagcaacttactgcggtcttttgtgttttctctttacaccaagcttcaatctaatcaaaacacagcacagccaagattcttttacagatggtttcaattttcttgggagataagcattcctcttctgattagttttcaaaaaacacctttaaaacgtagaagagtaaacaccatttaaacatatttttcatgtaatattttatataaaaataagccttaaaataactcatagtgataatcatgttccttttatgataatccagaggatgggaactcccatatatatgaaaattctgttgtgcaaatgactaacctagaatgagtcttctgtaggaatggtggaaggtgccagataaagagggaaaagaaagtcaaaaagcagtaatgaaaagattataaatataagtaaataaagtaaaaataaatataagttaaatggtagtaactgaaaggaggggtcagcccatcaattctgttgttccagagggcaagaaaacataaaggatttctgagtttaatatattgacctatttttttttaaaaggtaactaccaattattgaaggttttctctgtacaaatcactctactacttgattaacaaataaactgcaatcctcacaattaaactcaaattttgagaggaaaggtaaatgatgttagtgaaaaaaacgtgttctttggatctcagttatgttattcatttgtttaatgtccttaggcaacctgagatttaattctctccactttcaaataggtacaccagggagaagtacacctaattaacaaggtagtattgaagatggaatgactacgtaaacatatatgagtcactcaataaatagtagcttttatttttgttattgtacaatttcatccagcaggtaagtggtatatgttggattaaaattcaggtttgtcagattcaaaatatcggcattttctactgtactataaagatcaattaaatgttgttaaaatacattatggtatgccattatataatttatttgttaattcatatcaaatctttatggtaagtctaacattttaatgggtattttagatcaggcagaaatcaaatttgaattataaattacctctttgcaatttcagttctacatattataaatctatgaaatataaattcatgtgacaaataacacaaatatgcatatagaaagataaaatacaacttctacataattcaatgttctacataatcatgtcaatttcaaatatattaatcaccttgttaattttatagatttaaattatcaatcttgctaaaggtttaaaaaataattcaaacaagtaaatttgagctcaatctatgtgcaaggcaatatgctcagtaccaggattcatcaataatcagttggaatagggtatcaatggaaggaattaagaactcaatgaaggagacagatcattagacaaggaacatcatcaaattgctatcaacaaaatagtctaacagtctgagacatgtagcaaggacatttagtccaatccaggaaacaaaatctaagctaaaatgataaaacggaatcacctgggaaaattgccaaaggaaaaatgttccaggagagagcatctacatctaaagattttgaggtgaatgtgacactggatgcctttaaggaagtaagagaagtggagctttctcatcaaagagggaaaaggaattacaattaaagataagcactccatttaggaagagattatatcaagaaggagcagccattctcagtaaaggagctcatattttattcgagagcaatgaagagcctcttgaagatttcacatggatgattaacaaaataaataaataaataaatcctcacttaactttgtccataggttcttggaaactgcgacttcaagcaaaacaacatatgacaaaatcaattttgttctctcttcaatgttttaatgaaaagacagagaaggaaaagatgttgaggaccaacatgttgtgtcgttttgcttaaagtcacaattttgaagaacctgtcaactacattgagaactcactataatttaatagcattagtctagtttcaaggtgaggaacatattggtgagtgcaattaaaagaattgagacacttgtggaggagaaaacaacactaatgtagtgaaacaataatgaagactaattagtacagaggcaatacaaatataacactcgtgaagtccataaatattgaaatggtagaattactacatctccaaggctgttggcctaaagaaagagaagaaaatccaggaagaccagttggagcagtaagacggcaaggaagaggggagaagtctgattcacttgtgcatacgctcagtttaaggtctatctgagtgattttctagcacaagtgttcagaaatcacaagagagaaagtgaggttttagagaaagatatgaatcactaggcaatattgaaatacttttgtacctgtaaatcacaaatttacagtagtagcaacctgcacaggtgtattattttcccagcagcttagttgaaaaggatacactaaagattaaatagcaaatgagttaaacacagtcacaaatttatttccacatgtaaatgcgaggaaacaaattacatttgcattgaagcaaaattaggcctatgtgacatttttagactgactgcagatgtgagcccacattattgtggggctaatcccatggttcttagagcacgctgggtctctaattattgtgcatttatgttttcaaagagaaagtggcttgatgcattgcatttccaccttgtgaaaatttaaataaatgaaaatagcagcaaaggaaaaaaaacactaacacaaaaacatctattaagtcaatgtatatctatacatgctgaatacaaaatgctttggattttattgggaactagagtaatataaacattataaatttgaaaaaggtgatgtaattttgaccccaaaggtatgatgttatgtgtctcagtttttcatttataaagacattcttcaaaccctgtcaaaatagcaagccaaatggcattctcctcaattctaaacacacatattgattaaaatcaggaagtaattttatcccaggtgatattactattaatatcttataaattcttgggccaagaagtccagaaacccagaactacgatggagccattgacagcatttcacataattacaaccataacatcacttgacaggttacgttaccagaaaaatattcacaggaaaatatgtgtaatttcagaactgtatgaactgtatcacttttatagtagctttgtagttaggttattctaacaaataaagtccaacttaaattcagtagttaagaaaacatgaacaatatttcttctttcacaaacagctgtcatcttaaattacatcttttaaaaaaacaaggtaataagtttaaacaaataagttttatataagccaaaaaataatttgaatagaacatgctcattataatagttggcatataataggcattcaattaaagatagttgagtagagattggagatgatggatgtaatttatttctatttgcactcaatagacaatattatgaactgtggaagcctttaataagcttgtagttgattctacatacctgatatttttcatgtttcacttctttaagaagtatgacctccacaataagcagctttttatttgtataaattatacattgtactttcaaaacatatacaaagaggaaaattagaaatagaagagataaaattaacagatacaaaagttctcataatttatgcctgtgctctagaaagtaagcaacaaattttacctaccacagattggactaaaattataggagtgaaaatgtgtgtttcagaaatgctaccagcagtgtgaatgatgaacattttagcaaggatactagaaaagggaaaaaaatggtaaattttaaaataaaactgagagtactagagaagagacagcagatttattcatattttttaagggagtagtgactgactttatcgattatgctcctactattgggagacaccggtccttctttagtacactgtcttgattatgacaatgatcctgtgaggtacatagtcatggccccattttaaaaatgagaaaacttaagtcaccatagtgtccaaagaaataagaataaaaagagtaaaaaataaaaaataaaatgagaaaactgaagcacagaaagattaaggacttgcccaagctcacacaatcaataagcagtggtgcatgtattgacctgactccaaaacacatgttctcagtcacatttaccatctcatacacaaatgcacacacccagttaggcttctgaggcaaaggaggcaggtaatttaggagaaagaatattcacaacatgattgccaataaggcataggattaaacaaagcggctgaggcaaaagatgataaacaatcctggagaacaataatattcaagagacaagtgaaagaaggtatctcaaattatccttgcattttgttaagaaaaacaaagaaaagggttttcagaatttttagagttggcacttttataaattatgaagtgagttttctatatttcattatcataatggtggtaaactcagtaactggtcagttgatgctataagcgcaggtagatttgagtggtatggtgggattatgggagagaaaaatcaaattcaaaaaatctttgaaaaaattgtctatggaagaagagtaattaagtaaacaagttgccaaaatagagttaaaatctcatttactacatcaacttcttcataaagctgtgtttaaactcagatctctagcttgagcaccactctacaagtgccttcacattatagtatcctttttgaagaagaaataataggcagaaatgtaccttcattcaattccctcttatttctctctcccaggtttatataatcctaaagtaaataaacggtcaggaatgaagtgattgtagggaatgtgcaagggtcagtgatgtcaggaggtagaaagagccacaagactgtcacagatgagctgaagaatgaagtgcattgtggattacgcttgggggtgggggaaagtcagaactttttgttttgctcatcactcagctacttacaaatgtataattttataatgctttttaacatgcttaaatgtttagggattaaatttaatatgtcagtattttaaaaatattttcctttttaatccacacactctatgagtaggcctcagaaattttaaatagctgtattaaagagtacttattagaaacagtttgtcttctgtgaagtgaaatcggttttctgtaagtaatctagaatggaaaataattgacaatagtatcactatatctgtgaatgtccatgtatacatgtgcgtttgtctgtgtgtgggagaagggaggtgtatgcagccttcatctcaatttgagtcatcacagcatattggtattgttagttatttctcttttgtagatgattaaaatgagaatgtaaatgattacattgaggtttcattattcaactcttttaagatcatatttcctatctcttaacagagataatatattttttctagaatattttatattttaataaggaaaaactacatttaagaaaaacacctaaattatcgttgccattatacagttggtctatagtatatggattaaaagtggtaaaggaaatggaaagaaacatcaatatattgtaactggagtaaagaatgacacttggtaactcactgattatagagtataaaagatttaccattcaagatatcatttcaatttcaattataaattttgtattaacatttctttagcttgtggttaaatttttatcaaaatatataattccatatatgacattataaaaaagtatagagattattgttgacatattaaaatatgctgtaagaaattagtttttttgaaacactttaagcttgccttaaaaaatattatctagacaactttgccgttatctagagggtgaaaatattattattaaacagaaatggatgagaccatagcatcatacatttaccaacagcattatttgcttttaaaaaacagagctggttttataaaataagattttaaataaattatgccttattttgtacttccttttcctttctccacatatggtcttatagattattgattttttaaaaaatataagtataacttattttccattgtctatgttttagctttcatgaaaaaaggttctctgtttaaacattgacctgtcattgaaattaagatagcttaagtatataaaagtcaaaggctatatgcgacttatagacaaaaatgttttgcttccatgttctgacaattatgaataaagctgctataaagagcataaggatgtcttacaaaacaaaacatactcttaccatgtgatccaataatcatactcaactcacacaaatcatactttgggtattaactcaaagaagttgaaaaattacatcccagaaaatcctgcacatggatctttattatattaactttttaaatacatattttgttaaaaaaatttagtagagttttaaatttacaaagttattaggaagagagtgccgaatgttctcatgtgtaccatattgtccagtttctatgatttttaatgtttcatattagtataacacatttgtcacaattaatgaattaatattagtatattaactaatgaattttacttaatgtcaatgctttattcagactttttcattttttacattatgttcccttttcttttctaggatcctattcaggctactacattacatatagtagtcatatcttcttaggctcttcctggttgttacttgccttgttttgatgaccttgagatttttttaggactattggttaagtatttgtagaaaaccctgcagttatgattcatctgatttcttttccattgttgtacaaaagtaatatgtactggggagaaaggccacagaagtaaaatcttctttaagaagtgaagcagtaaaatgtcattttcatcacatcatatggtatataagtagtcaccattaatgttaaccttgatcacctgtcttgaggtagtatttgtcaagtttcaccaccactcttttaaccctgcctccattgccatactaattctttggaatgtaataaactatacttagttttggaagaaaccattaaactgttttccaaagtggtggtaccatgatttttaaaaaatgtttaccagcaattaatcaggagttattattactttgcatctttgccagcagtagcagtgagttctttggattttagccatttaaataggtatttactggtatctcattgttgcttgcttaaatttctaatgacaaatgatgttgaacacctttttatatgtttatttaccatctgtatattttgggggttgaattgtctattcagatcttatgcacgtttaattagttctttgttttattattattgagttttaagaatccttttacatttggataaaaatcctttatcagatatgtgttttgccaatatttctccaagtagttatttttgttctcttaacagtgtcacttcagagcagattttacttttaaaaaagtccaaatttccattttctgtcatgaattatgctttcggtgttgtatcaaaaaatgtattgccaagcccagggtcatctacattttatcctatgttttctcctagaaattttgtagttaagtgttttacatttaggtatgtaattcattttgatcaaatttttgtgaagagtgtaagttgtaaattcaatgcctatgttcattttatttgcatatgaatatcaaattcttccaaaaccaattaataagaagactatacttttggctttgaattacatttgattatttatcacagattagttgactacatttgtgtgggtctatgtttggactatctattctgttccattgatctacatgcttgttcttttgtcaataccaggctaccttgattattgttgcttaatggttaagtgttgaaataaggcagagtgtattctccaaccttattttcttcagtaatttggtggttattctagttttttgccttaccataaaaactctataaccagggtgccaattttggcaaaatagcttgatgtaattttgattgggattgtactgaatctatggatcaaacaggtaagaagagccttaattatattgaggctcccaatcaatgaacatgaaatctctttctatttatttataatattcatttaggtttttatcagagtttagttttccacatataggtcagtacatagttttgtaggtatatacccaattatttatttattttggatactattacaaatggtattatttttcctttaaatattagttgttcattgctgttacaggggaaagcagttgactttgtatacagtattaaattttatcctggacccatgctatactgacttatttaaggcattttttaatatttgggaatacagaccattttatgtctttcttattagtctgcatatattttcatgcttttattttctaattgtactagctagaatttcctagtgttgaatagcagtgatgagaggacattcttgccttgttccagacctttggaggaaagtatccatttttctacacgaattagcataactgtaggattttacagatgttctttactaaattgctgtttttctcctctatttttggccttctgagagttttcatccagattagttgttaaattttgtaaaatattttttctgtgtcagtttatataattataaaaaatttttcctttagagtatcgatatggtagattacaatgattaattttaaaatggagacctaactttgcactgtggaataaattactgtttatttatttctataataaataaaaaaattattattctttttacttattgttggattcaagtttaaatatttgttgagaatgttgtgtctatgttcatgagagttattagtctatagttttcctttattttaatacatttgtctacttttggaattagggtaatgctagcctcaggaaatgacttaggaagtgttccatctgcttctattttactggaagaggttatgaagaattggcatcatttctttctttcacatttgatagaatttaccagtgaattaatctgaggtgacttcttttatgaaagagtattagttattgattcaatttctttaatatatgtaggcctattcagatgatcttttcttgcatgagtattgatagtttgtgtcactcaagaaatttgtctattttatcaacattttcaaatattgagacagaaaattgtttttagtatccttttatatatcctcttaatgcccataggaacaataatggcaatccctgtttgatttattatattaataacttgtgtcctctctctcttttctcccttgattagcctgactagagtctttaccaattttattaatattttcaaataataacttttgtattagtttattttctttattgtttttctatttttaatcttactgagctctattctaattttaattatttctcttcttttgcttagtttggctgttatttctctagcttcttaaagtagaagcttaagttattgattatagattttactttctaatatatgcatttaatgttatacgtttgtctctgtgcactgctttttctggatctcacatggtttgaccagttatagtttcattttcatttagttcaaaatattttttaagtttctcttcagacttctttgaccaatgtgttattcaaagtacactgttaaatttcaaataatttgacatttcttcaactatctttcttttactgaatcctacttttattccacgtggcatggggatatatgttttatgatttcattttgtcttcatgtgctcaggtgtgttttatagtctagaatgtgtgctatcttgctaaatgttctacacagtctcaaaagaattcctcctgctgttggatagactataattgccaattatatcaagctgttttatagtgctgactggtcaagcatatctttatgaggtttctgcctgcttggcttatcagttacaaataggggtatttaatgtatccaaccgtaatggtgggttttctcttattcctgtctgttttatcacttgtctaacatattttggcataacgttgctaggtgcatgcacatataggattgttatgtctgtttgcagaattgattccctgaagaccgctttatctgaaattacttgaggtactgaagatttcttttgattagtgggagcataatatatcttttctcgtctcttttaacctacctgagtctttatatttaaagcgtttcttgtaaatagattataggtgggtcttgtttatttgtttttctccactctgataagcaatttttttgtaactgtatttcactgatttccatattcctctttctatgtgctctggttttagttgggtactttacatgattatttttatcttctcttttagagcaccaattacacttcttttaatgattgtattgattgtcctgaggtttacaatatccttccttcctttcttttttttttttttttttttttttttttttttttttttttggcagagtcttgctgttgccaaggctaaagtgcaatagtttggtcatagctcactgtaaccttgatctcctcgactcaagcaatcctctacctcagcctcctgagtagctgggtctaccagcacatgtcaccagaccagactatgaattttttttttttgagacaaaatcttgctatgttgcccaggtcttgaactcctgccttcaaatgattctcttacctcagcttcacaaagtgctgggattacaggcatgagccatcacacccagtcacaatatccttttttaactaatttaatttgatttttaaataacagtattctgcttcatgtgtagcacctgtaccttgtaacagaatattcctaatttatctctcctgatctttctgacatgactgttatttcacctatccataggctacaatcacccaatatatggttatcaggttatcattattactttgaagttatttctataactattaataaggaaaagaaggcattttgttttatctttatttattccttctctgtcttcctttcctcatgtagatctgagtttctgacctatattatttcactctccctttttcaatattgtttgcatgacatgtctgccttcattaaaatctctcagattttgttagtctgagaaagtttttacttcttcacttttaaagtatcattttactaggtatagaattctaggttagtgggctttttctcttgaaaggtatatcattgcactcttctcatttgtatagtttctgataagaggtgggctgtaattctgatccttgttcctgtatagaaaaagtgtttttttaatccctctggctttaagatttttcctttgtctttcattttctgcagtttgcatatgacatgcctagagaaatttttttgttttgtttttatctttatagtttatttagcttagtgttctctcaacttccaggacatgagaatcatttgtcactcattttggaaagttttcagccattattttttcaaatattttttcagctctgttctctttcttctccttctaatattacaataacacataatacactttttgaaattgtcccacagtacttagatactctgctgtgattttattttattttatttttcctctttaagttttagtttgggaaatttctgttgatatattttcaagcccactgatctttccttagctttctacctatgtccattctctaatgaacctatcaatggtctttatttctattatggtattttttatttctagcattttctttcagttctttcttagagtctccatctccctgtttactcatttgttcttgcattctgtcttccttttttattagatctcttaacatattattcataggtattttaaattatctatgtggtatttacaacatcctcgtgatgtatgaatttggttctgatgattactttgtctcttcagattattctttctttcctttaggtatgccttgcaaatttttgttgaaattcaagcatactgtatcgggtaataggaacagagatgaacaggcctctaatgtggagatctctgtcaatgtggttgggctttggctttatttagagtttgctgtacctaaaggtgcctaagacttgatttcaaattcctttagtgtctggttttgttgtcccttttgctttggactttcctaagtactcatctacagagaatgtctatgatttgcagctttcaactattgtcttttatggtactgaggctctgttggtttgatggtaacgtataagagagggaaatgatataatctatgatctatggtctatgatcctccagttaaatctcagtcttttcttgggtctgtgtctctagcctgtagccttaagaaatgtttcttctgccaggagtggtggctcacacctgtaatcccagcactttgggaggcctagacgggcagatcacgaggtcaggagatcgagaccatcctggctaacatggtgaaaccccatctctactaaaaaatataaaaaattagctgggcgtggtggcaggcgcctgtagtcccagctagtcaggaggctgaggcaagggaatgatgtgaacctgggaggcagagccgagatcacgccactgcactccagcctgggtgacagagcaagactccatctcaaaaaaaaaaaaaaaaaagaaagaaatgtttcttcttatatgaatttcccattttcattgagatagaaagtatacagggggctagagtatgacaaatacccttgctaacagtcctggcatgactctggccaaactcttcctcactggagagtaggcctttgttagaaagaagatctgggttcatttaaaaaggataactcttcccctccccactccctggatcccacagaatcattctcagatctttacagtgagaacgtggagaaaaatcctggaggaaaagcctctgaaagtgtggggacctacctaagactgcagtgtagctccggggagattctccctcacacaaatcacatgaatacataaagtgtattttgttagatgactcaggacccagaggtacccaatgagtaaactggagatgaaaataaacataacataagaggagtaacgtactataaacagaaagaacatacatcttcctttcgttgattggatgacagaagaatgccagaaaggaagcagagcctctgcaggaggtacagactgacagctcataacagattctccttagagaatttaagatggttgatgtggaatctagacaatttaagatggttggtgtagaattctagcttttctctaagatttttttcatcataaatggtttatattacacattcccatcagcagtttttgagggttccagttactctgtatcatctccaatacttggtatgggtggtctttttaacttttgctaaactaaaatattttattgtggtttaatttaattatcaattatgtcaaacatctttttaatccttgtttgccaccttcatatcttctttggtaaaataactgttcaaacatattgcctactgttatttgggttttttgtttttgtattactgagtgtttagagtgctttaaacattctagatgaaaactctatgctaggcatatgacttgcaaatatttcctaacaatctgtggattaaattttcattttctgatgaagtagctcttaagattttcatttgataatgtccaattaataatttttctcagtactttcaaacttaaatgtaaacctcctgtcaatatggtgaaatacagcaagcaattcctttctgtttacttgtttgtttccccactgtagactcccaccttggaatgctgcaatgtgaagtgacttcttctagatgttaactcagctgtacttctgaaacctcctatcagcatcattctgcctattactattgcctcacttctctgttggatccttgtttcctggaccacacatattattgttataatctctctttttgctggagaaaattttcttttttttttctttttttaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcattgttcaattcccacctatgggaattgcggtgtttggttttttgttcttgcgatagtttactgagaatgatgatttccaatttcatccatgtccctacaaaggacatgaaatcatcatttttatggctgcatagtattccatggtgtatatgtgccagattttcttaatccagtctatcattgatggacatttgggaaatttttccaataggtctctcagcaaggtgaaatgggatatacatttttaaaacttcaaatatctcaaaaatatcatttgattcacacttttgattaatattttttgactgaagtagagtgctgggttgaagatcattttcctgtaggaaaggtatttcttcatctcttccagtttttttgatgtaaaagtccattattattcttacttcaaatcctttgattatgaccttatttttggtatgtttttctcccacaaatccttatctctattgttaaaaaattttcagtgattaagacttgaagtatgtcagttttcattcatttagatgtatcaaaataaggcatgtatgtgtgttgttgttaatttagaaatttgttatttaattctaaaatagtattactcaaggcaattatttcattcaatggtttcttattccattggtaaatatggtgcaatgtttgatgacgcacataatattctctgtctgcctcttggtctttttgaggctgaacttcaaaagcattctttgactgtacttaaaacactttaaggcgagggttaatttgtgaagaatttgtgaataggaattactttctcaccaattccttaaggatatatttgtttttaaatttaacctacagagattccaattccattctcacagtcgtgcaataaaattgacaaacagtaactagactattttattttcttgcaataagaatacattatacatgacattacttaaaagagctgtaggaaaatagcacacctgctgcttttcccactaatggtatatgcttttcatctactagggagaaattattctttaaagagtatgtaaataattctattttaaaccagagaaaattattaattaacactattaacttcttaatacaaatgcattctgtgtgtgtgtgtgtgtgtgtgtgtgagagagagagagagagagaaaagagagatctaaaatttaaatactcacctatctaggacctaaggttaacaacctaaccttctctttgcttgcttcatctcccatctacatgcttctacatatgctttatcacacagtcttataggcaaactgctaataatatgatgtgtattgtggaatccacctgccctaacctagattaggtaaatttttttaattgttatttcagtcttcccaggtaggtacaattttattccaatttatggattagcaaaattgatgtcaaaaagatccaataactcaggacaggcgaggtgactcatgcctataatctcagcattttggtagactgagacagggggctcacttgacgtcagaagttcaagaccagcctggtcaacatggcaaaaagtcatctctactaaaaatacacaaactagctgggtgtgatggcacacactcctataatctcagctacttgagaggtcctataatctcagctacttgagaggctgaggcaagagaatcacttgaacctgggaggcaggcggagattgcagtgagccgagattatgccactgcactccagcctgggtgatgcagcaaaactctgtctcaaaaaaaaaaaaaaaaaaaaaaaagaaatcacctaaaatcatataacttgtatatgataaattgaaattgaggattcaaaacccagtggctaactctaataagttgatcaccttcaggttaccatttctgtgaaatttttccctaactttccggcacacttagacattactacctgcagttactcatacgccttacagatcctcttagtataaaaattacattgtaggccgggcacggtggctcatgcctgtaatcccatcactttgggaggccaaggcaggcggttcacgaggtcaggagatcgagaccatcctaattaacacggtgaaaccccatttctactaaaaatacaaaaaattagccgggtgtggcgagcacctgtagtcccagctactcaggaggctgaggcaggagaatggcatgaacccgggaggcggagcttgcagtgagccaagattgagccactgcactccatccagtctgggcgacagagcgagactctatctcaaaaaaaaaaaaaaaaaaaaattacattgtaaagtaattttaattataaaaatgcttcttcacaaatgtaaaagaacagaaattataacaaactgtctctcagaccacagtgcaatcaaactagaactcaggattaagaaactcactcagaactgctcaactacatggaaactgaacaacctgctcctgaatgactactgggcacataatgaaatgaaggcagaaataaagatgtcctttgaaaccaacgagaacaaagacacagcataccagaatctctgggacacattcaaagcagtgtgtagagggaaatttatagcaccaaatgcccacaagagaaagcaggaaagatccaaaattgacaccctaacatcataattaaaagaactagaaaagcaagagcaaacacattcaaaagctagcagaaggcaagaaataactaaaatcagagcagaactgaaggaaacagagacacaaaaaacccttcaaaaaattaatgaatccacaagctggttttttgaaaggatcaacaaaattgatagaccgctagcaagactaataaagaagaaaagagagaagaatcaaatagatgcaataaaaaaggataaaggggatatcaccaccaatcccacacaaatacaaactaccatcagagaatactacaaacacctctacgcaaacaaactagaaaatctagaagaaatggataaattcctccacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattttaggaggccagcatcatcctgataccaaagctgggcagagacacaaccaaaaaagagaattttagaccaatatccttgatgaacattgatgcaaaaatcctcaataaaatactggcaaaccaaatccagcagcacatcaaaaagcttatccaccatgattaagtgggcttcatccctgggatgcaaggctggttcaatatatgcaaatcaataaatgtaatccagcatatgaacagaaccaaagacaaaaaccacatgattatctcaatagatgcagaaaaggcctttgacaaaattcaacaacccttcatgctaaaaactctcaataaattaggtattgatgggatgtatctcaaaataataagagctatctatgacaaacccacagccgacatcatactgaatgggcagaacctggaagcattccctttgaaaactggcacaagacagggctgccctctctcaccactcctattcaacatagtgttggaagtcctggtcagggcaattaggcaggagaaggaaatcaagggtattcaattcggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgtttatgggtaggaagaatcaatatcgtgaaaatggccacactgcccaaggtaatttatagattcaatgccatccccatcaatctaccaatgacttttttcacagaattggaaaaaactactttaaagttcatatggaaccaaaaaagagcttgcattgccaagtcaatcctaagccaaaagaacaaagctggaggcatcacactacctgacttcaaactatactacaaggctacagtaaccaaaacagcatggtacttgtaccaaaacagagatatagatcagtggaacagaacagagccctcagaaataatgccgcatatctacaactatctgatctttgacaaacctgagaaaaacaagtgatggggaaaggactccctatttaataaatggtgctgggaaaactggctagccatatgtacaaagctgaaactggatcccttccttacaccttatacaaaaattaattcaaggtggattaaagacttaaacaatagacctaaaaccataaaaaccctagaagaaaacctaggcattaccatttaggacataggcatgggcaaggacttcatgtctaaaacaccaaaagcaatggcaacaaaagccaaaattgacaaatgggatctaattaaactaaagagcttctgcacagcaaaagaaactaccatcacagtgaacaggcaacctacaaaatgggagaatattttcacaacctacttatctgacaaagggctaatatccagaatctacaacgaactcaaacaaatttacaacaaaacaacaaacaaccccatcaaaaagtgggcaaaggacatgaacagacacttctcaaaagaagacatttatccagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagttggtgtggtgatacctcagggatctagaactagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtgacacatatacaccatggaataccatgcagccagaaaaaatgatgcgttcatgtcctttgtagggacatggatgaaattggaaatcatcattctcagtaaactatcgcaaggacaaaaaaccaaacaccgcatattctcactcataggtgggaattgaacaatgagaacacacggacacaggaaggggaacatcacactctggggactgttgtggggtggggggaggggggagggatagcattaggagatatacctaatgctaaatgacgagttaacgggtgcagcacaccagcatggcacatgtatacatatgtaactaacctgcacattgtgcacatgtaccctaaaacttaaagtataataataataaaataaaattcttcttcaatatactaaagctctttagggaaatattatatatgtaatccacatcccctaggcacatattaagactgaaaaatatttatagaatagctaaataaaggaagaaaatgaatgaaaaagaaaagaaggaaggaaagaaataagaaaggtataaagcataaggatgctgaaaccattaaaagagaacatatatattaaaataattctggcacatagcaggttttcagttaatttttgtataatgtgacaaattagttccctgcccatgtatatgaataaaccttttatttatatacttgcatgttctatatgtgaaagccaatatttctcatggaaatctgtctaattctaagaatttaggcctgtggctagacaaagaccactgctaatcctcacagctatttaagtacttttaatgatgataggtttaaagtccctacaaatgtgagtttaataatgaagggagaaattatgacatgtaaacaactttcagaagtcttgtttaggattaggactgacaagatatagtagaagcatgaatggtagtttatgtttcaggagaaaatatagggaaatagacaaatagatatttcagtatagagtgagataatttcttaaagatgtcagggcaagagttacaattttattaagggcttaatctgcatcaggcccaatgataagtgttttgtatgttttattcttttaatctacagtcttcgaaattagtacaaatatttacatccattttacatgaggatgtacaaaggcacaaggatgcctggtattactaactcttcttttctccaaaattctctaaaaattatcctcaaaaaatttttctcaaagagaatacaatgcaaaaggaagaagagtttatgagaaaacaaattagattctactctagattctgacacttcctagtcagagaatacaatctcttactgggaacaaaagagtttcaagttaacacacacttttcaactatgacactgtatgatgttgttatttttcctttaaaatgataataaaaatactatgtggataatagctctattatttatagtgctctcaatgtctattacatgaacttatttatccatttgcaaataattcttagcctcagtttccttagctataacatgatattaatgaaaaatacttgctcttggaacatggaaattggatttaaaccaaaggaactactgcgtgtggaagggctgtatatctaaggatattatattattttattttccattataaacctaggatatattttatacctcatattttaatagcttattttctgtcccattttttaaataaaaataattgtctgtaacaaaagtattttggaatctgtttttttcaaaacaacaacaaaaaaaaaacaaaagctcaaaccttaaaccagtttctttgaataactaaaatcaatcttcttactctacctgaattcatcactcaaaaatctttcacaatgaattaatctgcctttacatccaagctaataaaattacggttgaagcaatacttacgtattatgtaaagtgaggttacgggtaaacaaactattttaaaatgatgctgtaattacatcctcatgaggtctatggttaggcaagtcattttgggctttttatcaacttatctgtgctaaataaaactaacattttaaagtaaaataacttaaataaaatttacacttggaaattaacatttaagaatagtagtatgaaactacagtttaattatttcaaccaagtaaaggtaagtacaggcatacaggacaccaacgacagattattaccattgttgtgaattacagatgttaatcattaaagggaataaaaaaattcaagaatatacaagttttcacatgtaagtttgaggcaggatagtaaaaattcaactccaaacacgttctatgtgtaagagtttccagtgatttggaagtggttcctgcactcaacaatcttgatgtttagatagaaaaaataaacaaaaagctaaggataataaaaataattaacgacatgattcttaatagacactcttcctttaacaggcttaacatatatacattatctaaatctcacaacagctttaagaggtaacattattacctctatttgataaatgaagaaactgagtctcagaaaagtaatattcccaacgtcttacagctggtatttggcagaatccaaacttatatccaagcattctgttatcagtgcctgagtccttagttactgtcctagagtagactaaattgaaagaaaaaatttacttctataaaattaacatattatgaaaaatctggagcattacccatatcttataaaaattatggttttcacctccaactttccaccttcatctcttctccaaaaagggcaggcaatacatctcagtttttgtatgtgtatttcactagtacaacaagttggcaaacacaaggtaaatgttcaataatatattaaagcgtcaaaggtttccatgaacattaaagaaggaaatagacattttgaaatatgtctgttctatatttagtgaacacattatctaatcaaaaaggtaagatttattttatttattttctttaggtcatgcaaaattgtggtatcatcttaaaattagaatataaaccccatgagggcaaaagttattgtcttttcttgttcattgctataaatatagcaataagtgtatattagtaggttctcacactgctaataaagacatacccaagactgggtaatttataaaggaaagaggtttaatggactcacagttctgcagggctggggaggcctcacaatcatggcagaaggcaaaggtgtagcaaaatcaggtcttgcagtcccctttacacaacatcagatctgtgagacttactatcatgagaacagcatgagaaagacccgcccccataattcaattacctcccaccaggtctctcccatgacacgtggaaattatgggagctacaattcaagatgagatttaggtggggacacagccaaaccatataaatgtgtaatgcccatgtcagaaaaaaaaattgtgaaattctttgaaatgaagaaaaatgattcttgtgtgttctatcaagcacatccttctgggatatccctctctttcattgtgtttgagttgttttacaatttggtaaattgtagcacactattaataatgctaataatgcttggtcgttgacatgcaatttgtgtccaatggagatacaattgattattggattgtggatgtttatcaattttgcatctatttgtacattcatttcaatatacattgttgcctctgtgtgtgtttgtgtgtgtgtgtgtggcggtggtggtggcaaattaaactttaaatgagttcgaacattgtgctagttttctcttcaattgatgagttaaattaaacttttatcgtgtattgatatgtaagagttatgattttaccttaaacattatttttaacatctaaattagtaaacaaaggcataccaaatactagataactaataaatatatgtatattaatctataaaggttaatataacttaataatagaatactaaattaataattgaattaatgagtgaataagatatttttcatgaaatatcacagttaatttttatggtctctattagtctgcattcattgttataatatgcttggccaggtgactgagaacacttgcaaaaactataataactatatatatatatatatatatatttttttttttttttttttttttttgagataagatcttgctctgtcacccaggctggagtgtagtggagtgctcacagttcactgcagcctcaacctcccgcggcttaggtgatcctcccacctcaacctcctgagtagctaggattacaggcacatgccatcacacttggctaatttttctatttttttttttttgtagagatgaggtttcaccatgttgcctaggaatcaatacttttctaaacgatgtatggattttcactctttatagattaattttactctttatagattaattttactctttatagattcaccctttaagtttactatgcatattagattaacttttcaaatatgcacaacatatttcatgtatttcagtagtacttgatacatatcaccccctctggctatccaaaataaaataattgtgttatatagaaaatgtgtacttgcaaaagaattccattataatttgaaaactcagaaagcatatggggccaatacttctgaatttggccactgtactttttgatatcagataagatacagaaataatttatatatgataaaaagaaactcaatttgatttccacaaaatttatagttctagacatttagaaatgtgtttatttttaatgagtgtaacaaggctattgctaagataacaagacatatgttgaactggctaattttcttcaagatgcaatgagccctcttgggaagtaggccttgtgctggacactaaggaaatttgaagttataatgtctaagttttcataatatagtgcagaatatggaaacatgagaagtaaaaatgttacacaatatgtgttattgcagaggtacaattatatatacacatatgtatcatttatgtaacagtctattcctgatatatacatatatgtgtgtatatatgtatatacatatatcagaggaatataatgtatacatatatacatatatgtatatatcaggaatagactagaataactattgactgataattgtgagttactgttatgtctatcctatttacagggtctctaagcaagaccagtgtcattgtctgcaatgcttcttctatcttcttttttattaacaacataaatcatggattttacagagtgagaatttcattggacgaagggtagtccaattttagtgcttgattgcatatttctttgcaattggagaggcaattaaaaattaagagtaacaaacatcttctcaaaatagtaaatttgaggacaaatatgaaattatgactgctgatggactaggctcacatgttccaatttgctgtttgcaaggttgacaccaaaaaattattacaatttctatcattctgaacaagtttatatggatgcatttgctgcaattaagagaaaaatatagtttgttcaggcttatcaatttttattctcacataattagatgctgagtaaaactttcattttagagatgtagaaatcatgatagagaatgaccatctgctcaacatatatacgtgttgtatcaaatcactgcagtacttaagtacagaggctctagagtcaaaaaccctgggggaagaaatcttggtgtgtttgctttctacctttcttacactgaataaattactgaacacagtttccccatcagtgaaaagaaggtaatgcttgttcttatcccacaaaatcattgtgaggactaaattatataaatcataaaaatacttttgagaactcagaccttccaaatagaaagttagtaaatttattactttaatgaaatagtatatgcgtgaagaaatccaataatcaggttttgttaaaaaacccctctatcccatatcttagtctaacttacatagccaaacatacctgacagttcatataaaaaaatctacattaagaaaattttgacaatttgaataaggtttcttatggaattaggtctcattattttggaagaaagtaatttgtttgattggctatatttaaagtattcatttcttctaatcttgttttatcacacttagcagagttacagaagattgtaaatgtaattttttgattaatgccactccgtgttaagggtcctcaaattatgaagggcagagattctaatatctcctactcatcaaaatattcccagtgtctcgtagggttcttggtatataacggatgttttaaaaatattttatttgattaatagtcaacaatgtaagtgaataaatgataatttaattcatttttgctcataaataattttattgttcggagtttgaggaattttaccttcaaatttcctgtgggtctcttcttacaaaaaatcacttttaacatttattacaattctatcaaatcttggtgacgtgttatactttcatcagcacttgcaaaaatatttagtatttctaaaaaaatactctgatgtaaatctattatgtaagctttagatttcattctacttgaattatttatctaaggtatatagagtaatttttctggtaaattgaaaataagattctatatattctgatctctgaaatgaattatatatccctctgtaatagtataacatagtttttatagctgtaaattaaatgagaaattagtgggccagcacagtggctcatgcctgtaatcccagcactttgggaggctgaggccagaggatcgcttgaaaacagtggctcaagatcagcctgggtaatgaagtgagacactgcctgcacattaaaaataatagtgaaagtattttgtgtggattgtctttaagtctgtgtgtggagtggggtggagatgggttgtttgtttttgagagagtcgatctgtcatccaggctggggtgttagtgttcttaagttttgaaatatgtatgcatatttttgtatcaaaacacataaaagcataaatactttaagaatttcaatgcaattttgcttccaaattatatgctaatttttattatgtattttgcatattatgtatagtttaatctttgaaagttattgaatatgtatttgatttaatttgatcttcccttatattctcacatttttgataccttttgtgcagctgtgctacaaaatctaatgcatctgaaaatttttataataactgaacttttcacattttatggctaattctgccttttaaccttttccttgatcctctatgaacaatttagtgtaacatttaattataattaccagaacacaacaaaacatgaaaatgaagttaaatgtaggatattacatttttgtgttcaaatagtttcaatttttaatttaatatctgattattttgtgagaattaaatgtacaattacatgtaaatagaaccttcaaatacatagattaacaattaaaaaaacacttgttgtcatgacatgcaaaccccaagagcaggcctgttatatatgatttttttaaatgtctatgatttttattagtaacattttataaatgcattatggggtaatgtattctttaattacctacattttaccattccacaacatatacatacctcaaaacatcatactgtaaattataaaaacacttatgtgacagttaaaaaaataaattgtgatacacacacacaaacatagagagacagacagaatggcgtactattcagcctgaaaaaacaaagaaatcctgccatttgaaacaacataggtaaatctggaggacattatgctaagtgaaataagccagacacagagagaaaaatagtgcatgatctcacttatatgtggaatctaaaacagtacatctcttagaagcagagagcaaacagttgttatgaagaatgaggaggtgggaaaatggggaaattttgggcaaaaagcacaaagttgcagctatgtaggatgaataagtctagatgtctaatgtaaagtaatcatttcactatgtatatgtctataaaaaattgtgttgtatacgctaaatatgcccaattttattaaaaataactttttttaaaaaaaagtttaaatgtttatatactgctagatggcaggtgggtggaaattatatagctacatcaggggtagtctacgttatgagagaacaagttctccagacggatggtttgctgagttagtgtttctcaaggatatattccagacatacttttccttacagccaacgtggaataaaagtccaactttttgtttgagacagagtctcactcttgtcgcctagtctagagtgaaatggcacgatcccagctcactgcaaactccgcctcctgggttcaagtgattcttctgcctcagcctcccgagtagctgggattacagacacacaacaccacgccctgctaatttttgtatttttagtagagacggggtttcgccatgttggccaggctggtctcaaactcccaacctcagatgatccgcccaccttggcctcccaaagtgctgggattacaggcttgagccaccgcatctggccagaagtccaattttcctatagcagtcagaattaatcaccctggcctgcacagtaactctcttctttgtctgtttattcagaggcatgaggagtccaaagtggccatatggcagtcttaacttccatttcaatggaataattgttgtgtctcctggtggaagcattctcctttttggaactaacggatttaggccagcagagcacaaggtcacagaaacaggaagtaagcattttgctactgggtcagtaggagtaacagtgagtggtaccactttcatttccactctctaaatgttggaccgtgaatcatatacatgaagcatatacagccttctagagaacattttcccagcccttcaagatgttgccacctagctggtactgtaaccagctcttcaaaacacaatttcactgttttatcaaaccacttacttcaggttgatgggaagacatggaaacactggtgaaatctatgagtgtggtttcactgccacacttcatttgccatgaagtgaattccttagaatcaatgttgtgtgaaataccatgatgatagaaatgtattctgtaagcccatgaatggtagttctagcagaaggattgcatgtagggaatacaaatccacatccaaagtatctaatatagcaagaacaaaatgctgcctcttttatgacagaagtgtctcatgttattaacttgccatcagaaagctggctgatcacctttgagtgtcatgtgagggcctcagtgtttatcgttgctgctggcaaattgagcactgagcgatggctttagccaggtcaaccatggtgactggaagtccacgttgctgggcccatgcataatttccatccttgccaccatggccactttttctaaactgatttttttttttttcaattttactttaagttctgggatacatgtgctgaacatgcaggtttgttacataggtatacatgtgccatggtggtttctaaacccattttaaagtcatatgttgaaagcatttgaagatagggctcaatgaaaccactgagaagtcactgaaaaaactggggaatcatgactggtatccatagaaaaagtcatcctatcaacttgattattgtaatcatcctctgcagaggtcactgtttaccaagcatctcagtgaaaacaaatattttcacattatttgcccattcagaaaggtctattatacacacctcttaccagacctcctcaacactgattttccagccaagtcacttccaagtgcctggccatccattctaaccggaaaattcaacttaactcatgatctgctagccttcccagccttctgattcccctcgcccaccatcaattactctcacagtcatctctctaataaaatctttgattaatcctgtcttattgtttgtttctcaaataaattaatctaacaaaggtattgttagtggagatcagcaacacagagtacggcatttgacatgaaataactaatcactgactcttttgttttccatatccataaacaggaagtatctaaagcagtttacttttagatgaaatggacaacagtatatctttacagtcttgcctcatggcaatgagtgctcctactttatctaacagagtagctcagaagtcttgattgttttggaatttcacaaaatagcactcttgcccatttataaattatattctcttaattagactactaataacataagaaatgtcttaaatgttctagtaattacatacatggcagtgagtctggagtgttttagtccattttcttttgctataattacaaattaccctgagactgggtgatttataaagaaaataagttattttggtctggttcctagagactgagaagtccaaggtcagggaggcgtatctggtgagagccgtgtcctaacttagtgaagggtatcacatggtgagagagcaatagcatgtcagttagggcttttcttcctcttcttataaaaccacctgtcccgttatgggcctcattctattgaccttatctaatcctagttatcttccaatggcatcaaatctgattcccattgacatatgatttggggaattaagttttcaatacatgatatttacagaaaaaatcaaaccacggcaggtgtagaacacaaagattcagagatcaattgtaagtaaaattttgagaaggtcctttggtccgaaatatcttagaatatttcttttctcttaaaagatgccatcactcttcttatctctcatcaccaagcataattcacagcacttgataagtctctttagatttgtagctagcaaacatttggaaacactgctccaacctgtcttttttagtttattcaaaaggctgcttggctcacgcctgtaatccctgcgctttgggaggccgaggggggtggatcacgaggtcaggagattgagaccatcttggctaacacggtgaaaccccgtctctactaaaaaatacaaaaaattacctgggcgtggtgtcgggcgcctgtagtcccagctactcagaaggctgaggcaggggaatggcgtgaactcggaaggcgaagcttgcagtgagcccagatcgcgccactgcactccagcctgggcgacagagcaagactctgtctcaaaaaacaaaattaaatttaaaaaagactgctaatcttgagtggaatcgaaataacgagagggcactgcataaagtccaggtggcagtataagcttctctaaaactcaacccaaataattcagtatattttataaagctataggaatcggtgttggaacaggagtgtgtggagttttgggtagcccaaagggatgagtccctaggtttctggagaaaggttaagcaattttctccttctcatcacttaaaaatttccatgtctgttactggaccatagtaaaaactaagtgtcagtccatgggacagaatgactttcaatgaggtgcatgtccttaggtacataaaggttagtcaatctcagcaacaacctcttgtggcctaggagtagtatattctggttaaccccaagtaactctagaaagcattataaattacagacacctatatcacctccctaactcacactatattcacaaaaggagtttccttatgactaattaatggtagagaaatatactggggtatgactcacgtatgggttggtttatggtagcactattgaaaactgcacatcttcttcattataggcccacacaggacagcccagtaacatgatggagaacagaaatcctttcagaggatagatctctgagcactaaattgatcacacctttcaacagaacagatgacataccttttaaaagtcatccagtttctcttcaggtcaccccagtgttagcacagaaaagtcataaatgtcatggtggcacaaaaggttatgcacaggcccaataatacagatgccttctcatccaaaatgatctagttatttccactagtctatgtctgacttgccagtataattggacgctgtctttgctatcacactgttactcagggagaccgggcatacacctattacaatcaaatgcattgacacaaaatgaaagtcattcatccatagtagacatgataaactgtgtagatatgggtttgattttccacacatgggacctccctaaacagctttagttaagggttacaaagtaacacatccatcaacatgataatccatacaacattgtctgaaattaagaagctcattttatggcaaaggagttggttcaataggctcacgactattggattcactggttgtgccatgtgaaatagcctaggatcagtttttaaaaactattaactgaatggctgaaagtgttactaaggtatcagctcgagcactatactttcagtgttgagaaactgtccttctggtaacagcacatatgttgaaacaatggccaatataatgagattgtaacttaatatgaattgagaaaataaaggtgaaagtagaaataatttatatttcaaaatgtccatattgtggaattctctcctcacaaactcagtctctgtttctgattgttaggagcaacatttctccaaggggaacacagaaaaaaatttcactgaaatagaattgataactacaatctaccaactaggttctaatgctattgataagcagacaaaatgtatttgctgtgcaggctgggtgtcctggttacaatgaggatctatgatggatgttatctactatggtttgaatgtctgttgcgttgaaatttaattgctgttgtaacacaattaagaggtaggacttttaagagttgattaggctatgagggctctaccctcctgagaggaatgggttcctttgtaaaaaagtaacttgaccccctcttgccgtctctcaccctcttgccttctgccatgtcatggcccagcaagaaggcccttgacaaattccagtgtcttgatattgaacttctctgtctcctgaactatgagccaatatatttccattcattataaattacctagtctcgactattctgttatagcagcacaaaacggactaagacactaaccaatcaattggggaaatttatttacatataaagtaaagagaagtcactcattattccatgttccttgaaaattctttatggaaatttcaataataaaccaataagaacatggtaattaaagattcagacccttaagaaataaacttctaggtttcttttcttggcaagctctgagacaagctaaagtcttttgcaaattttcagaaatctagaatggatgattcaagagaaagataagaaatatcaattaattgctcaagaggagatgcagaagcaagtattacagatgacttctttaaccgttttaagttctctagaagatcaaaattaaccgccatcttgaagtggatattatgactgattaggctttagatttcctcttgggggcttgctattcttaaaaaaaaaaatagtatgggatcttggcataatgaaaggacatttcaagcaattgtgaatgttgcaaggagtgacacattttaagctttacctaaaattatctcaaccttatgatgttctggcttttggatgcttacttcctcataattctgtgtaagtaaccactctgttgaggcctatatgcttgtatcacctaaagcaaatatctggagtctctgggctcagatgaattaccaaagaatgtgaagaaagatctggcttcccagaagctgcttaagataccaggtgatacaattcagaagtacaggagaactaaaatcccctagaacaaactttgacagatgaaacacaggacaccagaggaagttgattaataaattgcctgtctattactccccctgaagcaataatttcttatatacgttttcctcagagttgtcttgtaagcatgaaacacatgttcttcatgaaatatcaaccagcctgataacacattattatggactgaatgtttgtgtccaccccaaattaacatgttgatatcataatgccaggacgaaggtattaagtgttgggcctttgtgattaaatcatgatgtaataatcattacagccctcatgaatgggattaatgcctttatgaaagagaccccagagagctcccttgctctttccatcatgtgaggacacagtgagaatgctgtctatgaatgaggaagcagaccctcactagaacccaataatgttggcattttgatcttggaattccagcctctagaagtaggaaaaataattttctgttgtttagaagccatccaatttatggtacttagttatatcagctcaaaatgatgaagaaaatattatcttttgtttgctttttacatttgcctgcctgtctcatatttttattgttattgtttttgtctcagccttgggattgtatcctataataaatcattaaaatcaatctcaggtttttgtttttataaagaaactaagattaatataatgagataatcaacagtgagcttaccatttgtcagtcagtaatttaaatgggaagatattcccaattattttgcttggtagcctacttggtgaaacttctagagagagcaatttctcagtgtctatcaaactctaaattcacatactctttgacccagctccaaagtaggagtcagcaaacaatggcctgtgggactccaaattcagcccaccacctgtctttgtaaatacagtttttcaaaatgcagtaatgcacattagtttaagtattgtctatgacttctaagctacaagatcaggattgtgtcaaagattgcatggcttaaagagtctaaaatatctatctagacttaacagaaatgctggtggacccctggcttaaatgtcaacagttattattatttaaaaaagcttataaaaacataatttttgtatcattccaagaattaaactggattcatactctgtttttcatgactcatttttttcttataataaaatatacctgccatcttgacaaaatcatttagttaacctcagtcaagttactaaactgctttacacctcagtttatgaaagggaatgtggaaagacaacatatatttccactgaatttgaaaggacatcatgtatgtagagtgtttaggaatggccaaaagtttttagggccattcggtctgcatactttttgttccttgtgcttgcacttaaaaatatgaagtcccatatttttctctttaaataattccaataaacatatttttctagaaaaataaagaatctaaattgcctacaaaattttaatatgatagttaatataatcactcgctcctataagaaaaatagtaatagattaaagaattttctgtatttagatctcctttacagtagaaatataaatgaataatctgtgttttttacggcacaatggaaagtgtggatgaccttactgaaatttaattattcagtgcttttaaaactctttgatccatgataccttatgacctctgatcaggaaataaggaatgccacagagttcaggataggaaattttatagaaattaatgttctcccggcaagagggaaataaacaggcatttatctcttaaaggaaatggctttaagaggcaatacctatgttaacatcattgtatttgccacatttatcatggcatgagttataaagaaaacgcttcataaatgtttttcaataactgaatgaatacatgagtgaaatacaaaggtctatgttatgttcagcattcgggattctgggattaaatggaacatgaggcaagaaagaagatacagtgtggcctcattataatctgacagaaccagagaggtataactaactgaaagcccaatccccaaagtcagactacatgaaaggaaacattcaagtcctagtatgcacataggagcctttgttcagagttttaaatggatagggagatccctatgagcagcataaatattaaagtcaaggcagaatctatttcctcttcattttatgcacgctgctcagtgtgggcaaacacggttggtatgaatttgtggactgggtgccagagctgggagcagtaatcaacaggtgcccacagatgctgattgaaagatagaaaacagctaaaatagatttgagctatctaattaggagccaccataagaagcaactgacacattaaccttttgtttcatcggtaatatatagaacatcttgatttttaaaacatctttcattaacctaattcacaagatctggttggtgatgtaaattctttgaacctagaagggaatttgttaactctgtgtaagttactgtgtgatgtggataatatacgttaaaattcttataattatactaggcacttattaaacactctacatatgtaaattattgttgttattatttctattgctgttatagaaaatgtataaaaatgaaatatgaatattttaaatactttaaaaggtggtgttttttattttaatttaaacaattattgaactcaactacctgctaaattatatataatcatatgcttaacaaattttttaaaattaaaacaaaaatctaagattataaccagtattatacctctacatgtaagaaagtctatatttactctggtacgtattttaaagccttcatatttctattcaatctgaatgatctcaagtcataatatttttctttgatccaaaattgtttgatatccatattatggtacatgatgttagaatacttgttttgttctgccatgggctggtgaattaattatgtctaattcttcttgttctgacttagcctttcttcaagattagatcaaaacattattacagctacagtccctgatgcattattagttcaagaagcaatgtaatatcacatttgttactgttttatcaagctaggtataaaaattgctttacgtttaaaggggaaaaagtgaaaattccagcaaagcagcctcgatttcacaccaggacaatcaggaatattttctcacttttgctgtcctggagcacaggtctgacaaataacagagattagaaatgattctaatgcttccctttcccacattccctagatggatatgtactaaaaagctttagagtaaacattaccaacagaaaaaaaatatggcaagtatgtttttagataaactaaagggtataatctctacttctgctttctgaagtttccacttttatactgttggtgagagtgtaaactagttcaactatcctttttaatgaagtttgttttaggatctttaaaaatatctctacaatttattgtaattgcttcctcaattttaactttgcaattgtcgattttatagatttttaataataaaaaaggataaattttgtttttaattaaaaatatgtataaaaattactaatattagctgctttaaaagattgctaagctctatttgtgtgtaatttattgccatattaaatagaaaataagtatttgtgatcataatgaacaacaccgatcccacagaaatacaaattaccctcagagaatactataaacacctttatggaaataaactagaaaacctataagaaatggataaattcctggacacatacaccctcccaagactaaatcaggaagaagttgaatctctgaatagaccaataacaggttctgaaattgaggcaataattaacagcctaccaaccaaaaaaaagtccaggcccagacggattcacagcagaattctaccacaggtaccaagaggagctggtaccattccttctgaaactaccccaatcaatagaaaaagagggaatccttcttaacccattttatgaggccagcatcatcctgataccaaagcctgggagagacacaataaaaaaagagaattttagaccaatatccctgatgaatatccctaatgtggtggtactgagagatgtgaattgggggagatgattaggttagaggcctctgtcctaatgaataagtgcctttataaaagagtcccaaaggagcttgttcacccattcagcaatatgaggacacatagaagatgccatctataagaaacaggctttcaccacatatggagtctgctggcaccttgatcttgaatttctcagcctctagaactgaaaaaaatacatttctgttgtttataagccacccaatttatgtcattttagtacagcagcctgaatagactaagacactcactctggcagaagttattgatgatattgcctttgtccgaggtagaaacacagatcaatctcaactcattggcatgggtagtgatagacaataacattaccctaatttttttttttgtcttttagtcatcctggtgtctgtgccattgctcatacttcttgtacttggatcaaagaaacaagcaagttggaactatttatatattgttttaaagtataagctatttggctctctaaggttaatcttcatggtctatcaaatttgttattttggccttgatttggcaattgaggttcctagttccaaatcaccttataggaactattaatcattctggctttgtgagagaggcatgatgctgcgtgctatctagatttttaaaaggttctgcacatctgctctctagtcagaaaatcactatgataatacaacaaaaaggtcaagaatattttgtaatacagttttatatgaagtttactgaataatctctgagtggtaaagagctggatttgcagctttccttaaattggctaacctcttgaaagtaagagaatgaccaaaaggggtgactatgagccggaatatacaaacacaatggccagaccatatatgaaagtagagctctgacccacctctgcagcaaccagtccagaaagccaaaaaacaaccccatagcaactagctgaaaaacagccagcacttcattgactgacggcttccttaatttttgcgtctgcttgcaacttaggaccaaatgaagaaagtcaaatatgcacacataaccaatcacattggatgtcctggttctagttagcttatctacagcttctccatggcaacagcctccaatcagggcacaaccgaagccttcccctttttccaccgtaaagcttcacactccactgcctgcctttaagtctttgccaaatacaagtgataattcctgactccattgctctgaataaacaacttttacttctcatttgggtggtttatgtttatttctacactcatttacctgatttagctgctgctggaaaacacgatgtttctgttttcacatttcaaatattcttttacacgcatctcattgaatgaaaaatcatactgatgagagacagtctggaaaatgtgcttgtattagtcagggttctccaggaaaacaaaagcaataggagatattttgttagttactataaggaattggctcctccagttatggaggccagcaaatcccaagatctgtagggtgagtcagtaaactggagacccaggatagctgatgttttaatctcagtctgagtctgaaggcctgagaaccaggaatgcccatgtagttccagtctaaaggtcagtggccttgggacccagaaagagcttgatatggtttggctgtgtccccactcaaatttcatcttgaattttagctcccataattcccattttgttttgggaggaacccagtgggaggtaattgaatcatgggggcaggtctttccggtgctgttctcatggtagtgaataagtctcacgagatctgatggttttatagatgggagttcccctgcacaagccctcttgcctgctgccatgtaagatgtgattttgcttctcctttgccttctgccatgattatgaggcctctccagccatgtggaagtgtgagtcctttaaactttcttcctttataaattacccagtctcaggtatgtctttattagtagcatgagaacagactaacatagagctgatattttagtttaagtctaaaggcagaagaaaggccaatattccagtctgaaggctgttaccagaggattctgttccttactcagcgatgtcaaactttttgttctattcatgccttcaactgattaaatgatgcccacccacattaggaaaggccatctgttttactcagtttatcactttaaatgttaatttcacttaaaaacaccctcacagaaacacccagaataatgttggcccaagtatctgagcagcccagggcatagttaagttgacatgtaaaatcaaccatcacagtaatatacaggtgtctagcccctaccacacagaaaagagtggaaacagtgctatcaacggacaatataaagcaggaagtcaaattatctgagataaggaaaaagaggaaatcatggaagaaatttaaatgtggtgacgtgatgatgaatttacttcagatacatttaatttgagatagaatgatacattcaagtaaatatggggaagaagacaatgacactaaatagataaatttgagaatcatacgactatagaagacaagcaaagcatggtgataggagagataccttgttaaagactatagttaaataaaaaaatagcaccgagacctgagttctgagaaattctagtatttagagaccagataggaagataatatagggcaagtggttgagaaggagtagcagagattttttttttttttcaggtagacagggaataaagtgtcttgaaaaacaaatagaggaaatgtttacaaaatctaggtgacacctttatcaaatggtactggggagactaataagttgaatgaatattaacaattatgtttcacaacatggaggtaattactggagttatcaagggctgtttctttagagtagttcaagaaaaagccagcctgatgtggtttgcagagccttcaaacttctggttttaatgctatagtgcactagctatttggataatatctaaaaatgctagaaaaatgtgatagtaatattttttacatgcttgtctgagatggtgtaaaacagaagaaagtagtgaaggccagaaatcaaacaaaaattagataagacctcaacaaagaaaaggataataaacccttataaaagacataaagcatgcacaaccctttggggagatataatatgcttgtgggcagaaagactcaatattgtcaggttgttaaacgtctctaaattaacctataaatttcaatccaaggcacccaaaataaaaatcacaattggacttttttcatagaaactgagaatattattcttaaactcatacggcaacgctaataactaagaattactaaaacaagttttataactaaacagatgtgtattgatgtatgtagccacatatgaatacatggacatagaatgagttcatgtcccttgcagggacagggatgaagctagaaaccatcattctcagcaaactaactcatgaagagaaaaacaaacactgcatgttctcactcataagtgggagttgaacagtgagaacacacggatacagggaggggaacatcacacactggtgcctgtcagggggcagggggcaaggggatgaatagcaataggagaaatacctaatgtagatgatgggttgatgggtgcagcaaaccaacatggcacatgtatacctatgtaacaaacctccaagttctgcacatgtatcccctaacttaaagtataataataaaaaatcatgctatgtggaatatcatacccttcaagtatgtgtatatgtaaattaaaccctaaacattaaacatttcctaagatttatatacatttatgcataaacaataattaaataagacttgtttatgtatacataacacacttgttatgtttatatataacatgcacacacacacatatatttatatatacagagagagaaagagagagagatctgggaggataaacattaaattatgaatgtatttactattagttggaaaatcaaaaattcatttcaaaagaaaacagaaattaaagaaacagacactgaagactaatggatactttaagatgattgtctctgataaaaattattgctaccagaaaagacttgcagatatgcaaaatactagaacacgcttgaatattcatcggatgagccattagcatgggacagctggagaaacagaagatgaataatggaagaatcaaaatccaggaaatatgaagacagattggactttgctgatagcaggatccctgcagtaagtgctgatgctgagaggattttcaaattagtattgagaatgattaagagtcaaactctttggtcaggctgagtctgaatctgaatttcctgctttgcctcttagtagctgtgtaagcctgggaaagttacttacacctttctgtgtgtcaatttcctcattttattaaatagcaataaaaaatataacttgattaggtgagttgttaagaagaccaataaaatgtactttaaagagtttctagcaaaataagtgtttaatattggtggacaattattacaatcctttgttttccacaataaatggtaaggatataagttgaaagaaaaggtaaatgtctttaggagaattaagaaagcaagaagagtggctgaaggaaataataaagaataataataaggaaatatagtttgattgttggacagttccaagggtccaataaaggttgtcaattgagaatctatattttaacaaactgtcttggcattacattatcatacttatgcacagaaaaagatggttacaggtatccaggacatacttatatttagcattccctttgtaccagatcctgttgttaagtgcttcacaaatattacctcatttaacccttaaaaattgctatttgtaaaacaagtacttccaggttcaccttcctaacaaataaaacatatattgagtatctcccaaaaaaagtaggtaattaagcagagaatgtcatgaatagaccactgctatattttaatgtttgaatggataatgacccttataatataatgacccatttatccattcaaacactaaaatatagtcgcaacaattctttcaaagtttaaggagacttttttgtttgaaacccttccatgactcctcctagtattcaaaattccataccataataagccttacaaaccctacatgatctggcatcctgctaagtctctgacctcacccccctgccttcactcactgcattccagccatactagtgttgctacaccttgagtattgcaaagatatatgccatcctcagggactgaaaacacaatttctgttaatattctggcaacaagtttaatgcagttaaagcataagtgaactaaatggaaattaataaaaagaaatagagagcttattagaataattatgtctttaaggtaaattattctccattgtatttaaagtgtttattattttattgcactgcaaaatatataaactctgcagattaaagaatatctaactggaaattgcattaattctgcttctccagtcttgtagctggtgcacaaaaatatgcatcattgcatcactaaggagattcaataatttccaaaattatttgacctcagaacacatctcatagaataatatttctcagaaacatttttggaaatgcactaggagacgaagttcttctgccatctttgttccttactttgatttaaattataacactacataagccaaagacatagttctcattcagtaaaatttcctaaaacaaacttatagaagactaatcagatagcaatttctgagaaagctatgatatacaatataaatatattggaccgattcattgagaatgattagaattaaacagaatgataacactcaacatagtttataatgaatcacatttgcaaatcatgacattataataatactccgaatcaccatgctaatttagacaggtaggcatatatccttaaaatggttcttatatatatcaaatatgtgttgtatttctagctactaagaatgacataaaacaaatgtttgaaagtatatcacggtctgatgaagcttcgttttcaatataaataaatattacagcagtttgctttaaaaaatttagatgaaaactatgttctttgaagtaaaattgatgagtgaaaagtttcaatcttgaaagtattaaaaatattcatgaactgtctactgatcgaattctctctgaagtatagtccttcaaacaccttctgtcatgcatttcatccaaccagatgtgtaagctcaagaccatgaaaagaaagggagaaagctcataatgctttgctgccactatagcacgcagccatctgtgaagccttgttttaacattattgcttcagtgggtgtttatctttgcataaaaaagtttagactgatatattcccatgtctttgcacacactaaacacttacatttgtagtaaaggggaatcttattttagtttttaacagaatcgtaaatccagaagggacataagagaagagctgggtttagatggaagttttctgtccccagctcaatgctttctccattaagccatcattccaatgataccaagcacattgtattctaagaaaatggaacaaactctctaacctgccccactatctagttttagtggcataaatactttgtgggcaacaaaggaaatgaaataaagagggtgaggagaaaggggaggcatcaaaattcagagctgatgctttagaacctcttcagcaatgccatatttgttaaatgcaagcagataaaaacatgccacattttaaagccaatttgtgcctctagagacaagaattataaagtctattgatcagaatgaggtaatgttagaagggaattaattattttagctgatgccaaatatacataaaattcttagcatacttttaaataccaatattaaagcaaaattaatgtgagcacatacttttatatagtaggaagcaatattcttttaaaacttagagaaaggtggccgggtgcggtggctcacgcctgtaatcccagcactttgggaggccgaggcgggcagattacctgaggtcaggagttcgagaccagcctgactaacatggtgaaaccccgtctctactaaaaatacaaaaaaaaattagtcgagtgtagtggtgggcacctgtgatctcagctaccagggaggctgaggcaggagaatcgcttgaatccgggaagcggaggtagcagtgagccgagatcacgccattgcacactccaacctaggcaacagtgcgagactctatctcaaaaaaattagagaaaggtaattaaaaatcactaccataaaactgacataagtatcacaatttttatttttatttagtacttatatttattccttcattttagtaaataaaattgcctatatagtttgcataaatttattcacatcttcaatcttgctgacactttttttcctgttggcctcatattccttttctgcaaattttctcacagcaaaatctggaaatatagcccttaaagttaggtggtgccactttatcacacaaatgtacattaaatagttcaaaactatgttcctttaatctaatatacaaattgtatactgattgtaagagattctgagttaatttaaacattgcgattaatagtgtataaccactgatgagtaagactctttgttgaagtaaacaagtttgatttcagagattattgaattttacgaacatttgttcatgaatcaatatttggccattatgtaagttgtatttttttagaagattaattgagctgattaagccatcttgtttaaactgaatttggaggttaattctgaatctcttgtgtttcaaaatcacaacaatgttatccattattttgttataatccagactatattttaacacatctttcaacttaattgctaatttaatttgaattttaaatattaactttcccatcaaaaaaactttatctgcctttccaagatttaatcactagatgcataacatttttccccaagggttgatacaagctgtcttacaaattagcctacccttgtcccatgtggataatagtgtatttattagaaactatggtcagatcttgtatgctgcccaacaatactgctttaaatagatatataagctatctctttgctcaaaatgaagatgtgttccaataagattcctttgatgaatgcctacagaacatttaagaaatgagtgattgtatattagccaagtgctcaccatcacggaggatggaatgcaattacctgggaacctggaatgatagaaggtttgattttctaataagctagaaggctagtaaagcataaaatttctagcatggttggaaagcttaaagagagcttacacaaatcaaattaataacatttaaatacaaatacattaatgtgcaaggaattgactgcacactttgcaaatatttaacttcatttattctaaatatacagatagatttgactttttagcagttttcattgagtagtttatgaattctaagattatttccaactatgggattatttccaggcacttctttattcctaattggttttaaatacattacaaaaaatatttcataaaatcaactagatatagtaggcatctatcttccaataatagctagatttgactcagacttgatagtttacaaagtattttacaatataccattaaatttgtatttgagtgaacattgtataaccaccagtctatcgaattttaaaatacctaatattcttttccaaatagtatttcatatggagatttttcaaaaaaataactgtggctatggataacaatagaatgtgtgtgtgtgtgtgtgtgtgtgtgtgtgtgtgtgttatgtttggaaacactaaggatatgtgtcaacaccaatcatatgttcactgtattaaaaaattagaatatttggtcttgacagcaacctcggtcatattccaaattccattttttattatgcttgaagattaaaagctgattaattagattttaagttatttaagggatggctcaaagatgatttataaccccaactctatttcaatgacataaacaccggctacttgataaaccttgatattggcaacattaaaaatgacattggtaaatactattatgagcaaatctaccaatgacttgaatttttttaaagacatgcatattttaagcattcaaatatatttctacacaaaatatttatctgcactgttactttgataacatgaataaaagcaccaacatttatactaacatctctcttctctgaactaattgcacaaaccacatgaaaaattaaattagacaattatataattagaatgtgatcacaattctctgttttatttacttttatttatttatttagagacagagtttcagtctttcacccaggctggagagaagtggcgtgatctcggctcactgcaacatctgccccccaggctcaagtgattctcctgcttcagcctccggagtagctgggattataggcacttgccaccatgccgggctaatttttgtatttttagtagagacgggatttcaccatgttggccaggctggtcaggatgaacaacctgcctcggcctcccaaaatgccaggattacagatgtgagccactgcacacagtcagctgtttttttacattattttacattggtattttcctacttaactaattatgttttgctaaatatttatatatattatataattatatatgtaaatatataatatataaatgtatattatgtataaatacattatatattatgtatactatttatatattaattatgtgtgtgtatatatctatatatatataaaattatattatagtcccaatagttttaccatatgggaattgataaaatgtttatctcttcatagaaaagggaatctctcagaccaggtgttttcaagattttgttgttttgctttgtaatcacttcaatctttgttattcattaatcttctccctatgatttaaaaccatagtcagcactgattgcaccagagtctacaattgcttaaaattcagatttaagtagagtcatgactatgatattttttgcttttgctctaacattgtgaatcacaatttgttagtttctaaaccaaaataacagatgactttgagtggaacaatccttgctccataaaaatagtctgctgcagtgaatagtaattcgtcaacttctctctaccattgctggagtgaagggtatgagggagcatagtagagatggccttgcttttgagttgagagtgaaaaatttcagtgtgaacacagaatcaaactttcccacttattactgaaaaagagaaagtgtgtgtgtgtgtgtgtgtgtgtgtgtgagagagagagagacaaagacagagagagagagagaaagagacctctttacagaccctatatggaagatctgttttgttttgttttgtttttccatttaactctttcatgaccacatgggtggcctttggtttgtaacttggatatggatgttgtttgtcattgcactttgtattttatagcagtagctcattactcatgagaacacgtgaagttcttattgaaaaacagtttttaaaaattcacttaagtctattttgcagaatgtcattttgtgcatattttccaatttaatagttgcatctggccggtaactttggctaaaattatttttggactaaagtatcctgtatatactgtgatacggtctggctgtgttccctcccaaatctcatcttcatttgtagttccagtttcccccatctgttttcatgatactgggtgagttatcatagatctgatggttttataagggctttccccccttttgctctgcacttctccttgctgtcaccatgtgaagaagaatgtgttcacttccccttccgccatgattgtaagtttcctgaagcttccccagccctgaagaactgtgacacaattaaacctctttcctttataaattacccagtctcaggtatgtccttatagcagtgtgagaatggactaacatgtgctgagtaaaatttttaatatagagaaaagtaaaaataaaagccatcaaaacttttaaatgtgaaatttcatgccagtgatctaaacagtttgagaaaattctgtcttggtgtctcattgaggcaaaagaataactaacatgattattttaatagattattttgacataattcattctaaccaaagtacatgtttacaaaaatcttctttataaaataatttaaaagaactgataatcacaagacagattactaataatttttaaagttttatgtaaaaagttattttattcaaaagtattaaggcagttacttgggcagtgaatctaattttgctttaaaaataacggaaaattacattttactggaaaataaattgggaaagagacttttcagtactcttacattcattagtttaaagaaagaagatgttaaaaagaaaaaagttgcctctaaactaaaaaattgcctcagcttcccaaagttctagaattacaggtgcgagccactgttcctggcctagattttttttattctgttttttttttttctctgatcattattgcctctaaatattaaaataaaatgttgtttagttagaatatatgactggttgtgaataggtgcttggtttagtactacagattttaaattagtatttagatattaaccaacatttttatacatgtttattttttaaagtgattttatggagcttgatatgagtagcaaaatcacatggcaatgatctcaaaattgaattttgttttaagaatctcatgtcaatataaataatctttcaacccataaatgtcaatgaagaaagtgggatcaaagagtatattatctgggttatgttataattacaagagacagaattacaacttgctgttttaaatttcaatatgtatgttgtatatgtacgtaatgtaaactgataaagaagtatcaaatcaattttcaatacaaatggctaaatcaaaataagctacatatttatggagggattaaaggattaaaagcaatgaacaaacatggaataccttcaaatttaatagttaagaaagaccatcaaataaaatttacaaagaccaattatttcatgactattatggaagatccagtgctgaatacaagattagataattatgcaagattatacaagatttgatgctgattgatgaaatagttacacttgtatacactagcattgctgttgaaccattttagtatttatattatttagcaaacttataagcatcttggcaaacctttttagatttgtaaaaaatttaattaaaaaatattttaacttttttttgttgttttttttttgagatagagtctggatctgtcacccaggctggagtgtagtggcgtgatcatgactcactgcagcctgtacttcacaggctcaagcgatcctccacttcagtctcttgagtaactgggaccacaggagcacatgactacatctgtctagtttttttttttttttttttaatatatagggacagggttttgccatattgcccaggttgttgttaaattcctgctcaagctatctgcttacctcagcctccaaaaattctgggattctcccaaagttcagcctataatttttttttttttaattctaggttttatatctggtcattaattacattgaaaatgcataattttcaaaatggcaaaactgtgactctgtaaatataaaataaacatatgtcattcattttatttaactcactgattaatgtgaatataaatgaaataagtcaattcaaatgagaatttgacttacaaagagttttattctccactagacaacattcatttgtatttttttatttttttaatacaacttgatcttttttttgtttgttttttgttttttgagacagagccttgctctgttgtccagactgtcaagatcttggctcactgcaacttctgcctcctgggttcaagagattctcatgcctcagcctcctgagtaactgggattacaggcgcctgctaccatgcccagctacttttgtatttttagtagagatggggtttcaccctgttggccggggcggtcttgaaatactgacctcaagtgatctacccacattgacctcccaaagtgctgggactacaggcatgagcgaccacacccggccattcatttacactttaatgaagaaaaagtatcttcatggctaggagcaggcagcatttgccgttaagttttctacaactctactactccttcagagttataaatagcttaatcaatctaaaacaactaaaggtacacacttctatagaatcagaaggttcactagacaatgtcgagaatgccactacgaaaaaactgccagtcatctcttctgcctgtttcaagtctgacaaattttgctgactgtaactcccactcctctttataggtcttatctacttcctgccactgtatgcatattcttatgcaaaatgttctttatagagttgagctcatctagtatagccaattttaaatttcactatttccacagatattttcatatcattaggaaatccttagaaagatttcaatggctgcatgatatgaatctactaaaaactatataagccctcttctaatgttggtcatagagggtattcaagtgtttgctatcttaaatggatctgagaacagcactatacataccatattcaactacaaaataaattttaataatattacagtaatgaatgttttataatacttctagaattagatctatgtagataaaatatgttcctgattacttgtatgtgtgtgtgtatgtatgtgaatgtttgcatgcctacttttaatattagtgtatatagtgtctgtattgtattgggattattggattttgtattatctaatatgataggcaaaatacaacacttgaaaaagttgtatttatgcaataactgaaatggaaaatattttatatatttatgtgccatttgaactttttactttgaaaattgtctgtatcttttggaattttgttgttgttattcttttcaggttaagggaatcaaatgtaattggttatagtgacaatgttgcaatttgcctaagccctgtactccctgaaacagagaaggtcaagaaatcttcctaatccttttgtgatttgggcaacagcttctgaaacactcttcccaatatgatttaaacagatacagaggcctccttatttaccttgacaaggctagatagactctccaaattcccattctttatctcataaatggttggctgagctgttttctccactgacaaatttagataaaacttaatcaaactttagtcagacttctctccttcacccaggcccctgaactttgacccacactttggtatatagtttattcttaaattataaaaatagtggtgttatctgctactaacaaactacaaaagtgaaaatgtccaaagaactattctacaaataagtaatgtgacatgatcatacttaatgcagaatttattgataaagaaagatacttatgtaaggaaatgaaatatattttcattatttgtgattatttaaattttagtttgctaaattgaaggtaaattccataaacctgtattcactgaatcaattaggttatcaattatggcaacttctttttctaattattatttttataggacattaaaaaattgcaacttgtcaaagcttttaataactgaattaagtcatttcataataactgtagacttctgtagacccagcacagtagtacctcttgaaaagtaaatgtacacttttatttttaagttgtactgcaaaggaactatccaatggaagtttccacagcgattcaatctgttcctttatcccaatccatttccaagaaattctgtatctgtctgattcccggcacttatctccacctcttctctatgattgtatcctttccaatttgaacccgatgatctaaattcatgcttctccttatgaactcacttcaatattctgcaactgttctacactataagatttgctgagtattaaacccaccctatgaagccctgcttcagcattctctggatacaaatacacagacaattcaactcaaacttgctcaaagactaactcagttttatgcctgaggaaggaggtgtgctcctgatgttctgtagcacagtggttcccaacctttttggcacctgggaccagtttcctggaagacaatttttccaccagatgggaggggagggtggtttcaggatgaaagtgttccacctcagatcatcaggcattagatccctcacatgcgcagttcaaatagggtttgagcaccagtgaggctctaatgcgcccctgacctgacaggaggcaaagctcaggcagtaatgctctctcaccctcccctcacctcctgccgtgaggcctggttcctaaatggacacaaaccggcactggtccctggcccaggggctgaggacgcttgctgtagcagatattcctggactaatagatcttactacaataatctgtatctaattttatagcaggcaatgtattaactaaacctaatgcagagacataaagctatatcaccaaatgcccatggggagaactggagatgcagtatgtttcctatataaactattttaaaatactttggctctactttgttatgctctataccagaatttggcaaactgcagcctgaacccatatatgcctgccttcctgttttggtaaataaaattttatgagactacacctctgctcattactgctgtgtgtagctgcttttgtgcttgtagctgtttagttgctatgaagaccttatctgttgtattcctagggctgtctttaagaacatgtgcccagtgcactcccacagggtaccacacagagaagggcttatatttaaggtctcattttctgcaattacgttattgaaattcttaaaacattcatttttgaattagtgtttataaagtctgctgggataacatatgatatactgggggcttaatgcctcagctcatatgtttttccaacctgactttctcctcaggaagaatttttctgacagcttctcccagtcaaccctgtctgcctatccttgtccttcctgatctggttcaatggctgccgcccattggccagaacagttacagattacattagtcagggagatcgatgttccaccatacagatgtcctggtctggaatgcagggagcattgggctctggagttggccagaaatgtctcagggaggggcaaggtggcaaccatcctccctggaccagtggtacagtgaattccccaaatgactagacagatgctttttgtccactcccatccattatttttcactgagcccttttgtagctgaacctgtttttcccctaagcctgtcagaagttagtatctgactctactatatcttttttttttttttttttttttttttttttttttttttttttggggataagaccatctttatttcccagtctttgtctaggtttctactattctattttctccatgcaacatatctttgaacagcttagactggtcagatatctgcaagattgctttttttttttttttttgcttctgagagttgttttttatttatttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgacaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggtcatgaacagacacttctcaaaagaagacatttatgcagccaaaaaacacatgaagaaatgctcatcatcactggccatcagagaaatgcaaatcaaaaccactatgagatactatatctttctgatcagggagaaacctcaaggcaaaatggattcagattccagacttacctcttatctccttatctttcatggcatctcaaacttgttatctcgactactttgctagctttatgttgtctttaaagattgcttttacatttatttggaactttttcagtgaccctaagcaaaagtgatccatctttattagaagtaagaatccactaactaagaaataaacattgttctctcaagttgttcaagacattttaacaggagtttatttttaaaaatcttgtaatcattatacttaacatgaaaatgaaattggcttgatgattcaaattattttaaataattttactttaaactgcaatttttttttcaaatattgcacaaactaccaattcagtaggtaccatttgaagacctgctgaatttctcatatatcgagaatgacactatacacatagctgaagctgaaattttcaatttattaatcatgtgcagatgcattctctctggcaatttaatttatttaatgcccaggaacaaatggataagatgtttatgtgtcatattaatggggacatagcatctttctcacaaggggttcaaaccatttttaaatttaatttactctcaaactgtgatgatactaatgtaattatctttcatattagagctaagattcaaaataaaaggggtaaccaaaattgccagaaattatgagattcaaatttgtgatcagaggcaaaagcctttcagttctaaggtacttattttaaacaataaagccaaatatcgaggaaattgcattaatgaaaaatatattcactatctgttgtttcttttaaatgaagaattgattcaaatcggcactttggttttgggaacaaggtattggagttagaatctcacctgaatttatatgatgcaagtgatggcagattaattcattgtttttaagtttctatgtccacagctctactgaaatcattctgacaaaaatcattagaaaaatataaattcacttctatagtgatatcctcctaaaatgataacctgacatgtcttatttttgccaagtggcttcatctgaaacagcatattgtaatgtgaaaaggattcagtaatcagaaacagtttagaaatgtcagtgtaggcaacagaagatcacagcaatctatcactgaggttcctttcatgggatataggatagatcataatgttttgttcaataaaaggaaaatgtaaaactgtagaaacatgaaaacaaagtgataaacaggaagctatgtccagcatctaaaacaagaatctggattatactcctgtcaatacttttgtctaaaacgagcacagagaattcaatgatttatatcttagagtgatattgtactattgagggaaatcatattaataggaaaaaaaagtttacctatgagacttttgttattgttaatttgatgaaaatttaccagttccttcattaagattaacacttagaaatcttgcttgtaaaaacaaattaaaacaaaacaaacaaaaacatctctaaaacaccttaataatcttttataaaataatgatgagttatatgtagttaatttttgccaacgtattagaacatgaggtgttctgtactcctttttaagcaattgataatgtccaaatctcaagctgatttttacatttaaataaaggaagttatttattattacatactcatattcattaatcaaaatatataaaatatttaaaaaatatgtcaatggaaagaaacctttctgttataaacttcatatatgtgtccttctaaaattcacaagatgaaattccaactacccatgtgacattaggaagtggtacctttgagaggtaattgggtcatgagggctctgcctttatgagagaaactccagaaaattcactagttctctttttgccatgtaaggatatgagaagacggcaattggcaatctgaagcattccatcaccaggatcctatcgtcctgtcactggatctctgtcttctagcctctggaactgtgttaaatttttgttgtttataagccatccaggctatggtacttgttatagtagcccacagatacaaagatactttccctttcctgtgagggtttttcaaagatttagtatccgcatgatatgttctaacacctatcaagcaattatttgactacatttttattattgtatctttgaacaagaaattaattaaacaatctctttcctgaactttctctcaacctccttctttattttttggcttgcttttatactgatatcagccaagaaaatattcccttttcttttaagaatccttccctagcccatcttgttttgaaagatgcttttcctatatgttcactctattacagtttccataactttgtcattgtatgccatatttgcctacttagctatctgccttctacagtaattactatacaccacttttactttctatcctcttcaccatttcccccagacacaagactgagtacttcacattttgcaggtactcagttgaatagataaagtcctcagttaaaaatagcaatgccctatcagaaagattactaagtgaatgacggccttctgttccctgattcataaaatggcacaaaggctaattacagaaagcaatgtctagccaagaaggagtagaaggctttaagtcagtgcatacagtgtaccacaattaaagttagaagtatcccagttttgtctggtatcagccctgatctcaacatatatttcactacaaaactcttaatttgcacaattatgcattcatatgttgttttcaatttcttcttggtcataaaaatattgattttgtactgtaactttacacaaggaaaaaaaaaaagaaacaattcaaattgtacctggtgtaattatattccaaagactgtttcaaagcaaatttcagagcacaaacccaagatgatcatcaggctatagaatgtgatagttacagtcactatcaatcaaaagtaataaaagtgatttctgaccaaataataaaatttatgttttcattatctttatggtacacttaaaacgaccatgaaataaactaattcattctactttgtgaaataaactgaatttacttcacaccattactagcaattctactttaatagatttataaattaccaaataacattcctgaaggtgtagtaagaaataaatttaccacctagagttttatttcttctcttatcttttacaatgcatatgactgcttaaatgatctatttagccctttactttattttttcactatatattagttcatattacttagcaatatacttttattattatacatttattcaagaaaaatgtttatatatttaattttcactttgcataaaactacatttgacacttttattaaaaacattcatattgtaatttaattttactttgaagttgtgattacttacagaagctggttcaaatattttttagtcttaaaacactcacacttcattattgtctagccgaattttgttggcaaattaataactgtttcttactttcgtaattagtttttgggactctaatttacattttagaattgaactgtctgagacaataatgaatagtcactattagacatgtaaaatttgagtagttcaaattcaggtgtgctgtaagtataaaaaatgcagattttcaaaaacagtaaaaagatgaatactgtaaaatatctcaataaggcaattgaaacttttaaaatatattggagtcaatcaaatatataattaaaattaattttacctttattttcacttttttaacatggctactagaaattttaaaattgcataaatagcttgcctttgtggctcacattatatttcctttggtctgtgctgttctagctttgctcaatggtccttctgcatattgttgccctcatttttctttcaatctttaactattttgtttttccacctgaaaaatactgttttagggggtcattttcacattattggtaccaacctataatacttaaactcttaagttgggtgcagtggcacacacctgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattgagtaacttgtccagtatgtgcttctctaaagaaaacattatcttaattgatgaaatctttacaataccatattataataatgtaggtattttcagaaaaaaatattagcaatattagttccacgggcattataaattttaatatcctcaaaattttcttgtaatatgtctttagttttttcaggtgtaccttgacttaattttgcaacaattcacttaaggttgctggtacttttatcttgtccaatgttactgtcttttcatatgaattctatataacttaatgaatatgaaccttaaagtgttttaaaattgtctctaatatcacatgtacttaattcttaggataatttggataataaaagtagaaaacaaataccattatttgtatcataacagtatatggtaataatatatgtcatagatctggtttcagtatattaagaactgttttgaaatcaatataaagagattttagtcattaaaaatgtacagatggtatagttatggtaaattgttgatattccaaagtaaattataacaagaattataacaatgtcgcaagatccttcgggtgtcacttcaccagccagacacctctgtggccagtaaagcctctgcttgagatttgctggcacctgctaggcttgctccgcccacccagcccagcaggcttcactcatctcacgctgccagcccagatcccacacctgccaaggctgagccaggtgcagagtggtgaggagtgtgtgcgtgaaagagtgcagggtccagccactgcatacaggcaggcatgccagctactgctactgcagtggggcaggcagctccaggcgctggcacaggtgcgagtttgtgtgaggctaaagctggaccagacatacaacatgccacaagcagtctctgctgcaggcaccagcatccagaggaggagaacgcagtggcaactgagagctcaaagatgccaggaactgcggagccccaaagagggtgttacaacatgtcacagccctggcttgtggagctctgaggtctgggctcccagaactgccactctttactcttacagtctgggagtgcgtcaccacctgcagctcagcaagccagccaggaacatgttacagctcctttcactcccgaggtttggtgggtcctgagttcttttcctgaatccaagaaggatgaggttacactgacaactggagggttagcaaaaggcagagaggagttttattgagtgacagaatagctctcaggagacccaaaatgggtcctttccacagacaggtctttgtgtagaggagacccgaagtgggtagctcctatctgcagggaggtcatcaggaagagtgtctgaatctggctgagtcctggggtttttatgagctcacaagcgaggaaatccatgctgattggttcatgggtggccatgggaggacctggaaaaagtaccataagttctcactctggtcacagactccacccagaactggcatccgagcccccaggcttcaggctgtccattgctcttgcttgaaggtggggtttcactggggaccttctttcctgcctagaaacctgtctgcctcctactgccatcaacatgccatccagcgtgcccaggctgtctgtgccaaggggcaactgcaggccagcaccaagctgacctcagacacctggcctccctcccaagctcaccagcacccaaagcctggagggggtcaaggcggcagtaggggtggtatgtcagtgcagccttgagtgtgtgcacagcaggctggcttatgacggtgcctgggctcggccacaactttgctctgcactggagcaggcattgggagtgcggagaggccagagaccaggagcaggcacttacgaacctgcaggggcagggggtttcccaggatcccaagagcacaaggatatctgggtcaggagccacagctgggtggctgccgctgcacctgggaacactgggcagcccctgccagctccacagattgcacatccccagtcaagcctcctccactgcagctggcttccatgtagtagctgttccagatgggccaccactgccaccaacaagatgaacaacaagaatacagcaagaaacacaacttcggatatagcaaaaagaaaaatgggactgaaagaaattacctttctacttgaccccaagatgcactgtcatgtcatttattctgcaaatgcatcagcctggcctatgtctggagaacacacagaggataattctaacaatgtcaaatctaggtaagttctacactgttttgctccgtaactccagaagagtcacaacctcaccatatcctagtttccttaattataatgagagagtttgatgaaatggaagattttaaacaatctcccacttttaataatatcacagtcctttaaaatctgtttagaaacatcaaagttaatattatacaaaatccataaaacatgaaatagaataaagagagaagctataataaataaaaacctaaggaaaataaataaaagcaggccaggtgcagtggctcatgcctgtaatcccaacactttgagaggctgatgatgtgggcagatcacttgaggccaggaatttgaaatcagtctttagttcttttctggccaacatggcaaaaccccatttctgctaaaaatacaaaaattagctgggcatggtggcttatcctggaatcccagatactacaaaggctgaggcacaagaactgctcgaacctgggaggccaaggttgcagtgagctgagatcacgtcactgcactccagcctgtgcaagagtaagcactatctcaaaaagagaaaaaaagaaaagaaagaaaagaaaaaaaattttttttggctactcccaatagattttgcatgtaactactggttgtttttctgcaggtacagaaatgattgccacatattcactccccaagattaggctgtaaggtttttcatgggcataaatataatttttcatctttgcgtcttaataaccaaacccaaacaggaataactcaatctcagttaactattaataaagtaagaagaaatactatgtttttactatagtttacatcatcaaataaagtatacagttgagcgatcttctgaataattatcatttaaataccatgtttaattatttcattaaatgtatctctgatattttgatacactaataatatagttataaaacttttccaataaagttgtccaatttttgaatttatggtactgaaaattactttatagctaatttttgatgtatattttagcttgtacctttcaagcagcattaatttagaatttacagtcctttgaattttaaaaattagttcaaagatttttattgcagtcttacttaaaatactttctagtttctttaaaatatttcaaacactttgaagacatttttttcaaaggatattaaagaatgtatttcagttttagtttatgttttgtcaaatatttataatgatcaatgatcatatcctatattatatctattactcaaaacattgacaaactataatctgcatttactaatatactaagatgctaatattcattcattcatactaagctatgtcaatcactataatacttgtaataataatatttatacttatatttatattataaaatataattataatatattataattatatacaattattatatataatatataacatataacatattattaatataacatataataatatataatatattattaatataacatataatatgttatatattgtatataatataacataaaataatacattattatatattgtatataatatataacataattatataataacaatattcaaaacttgtatatattgcaggacacaaataaaggtgttagactgttcttggtgtccattattttgtaactttcacttcaaaaatacgtgtgtgtatgtggtgtacgtgtgtgtatttaagcaagacttttactcattgtatagaaaatattgttcaacatgcactgaaatgatggcatgcatctctgccatccaaaggcagacataattctgcatgtctttcacatattttattctttctgaagaatctaaaagcacacaacttttaagttaaagcatattaaatggatatatataatgaatatgcgtaatataatgaatatacaaagtacaacatttacattaaagagtataaagtgagtatgtatattattatatatactggtcccatacacagtatcttcttattctatgggtacatccatgtcattatattttttaaagctttccagttgttgtaagttgcagagagatttgacaaccaatggtctagccataatcttcaagcctgaagatttttttttaaagacctattggtactttgttattttttcatcatctcttattttgattgttgctaccttggataattcacagatattctcagattaaaagttgtttgctcttgaatttactctgtatcttgcggacaatactaatgaaaatgtgattggaaagacccagagcatcaatgttatctcctgccaaggctgacaatcaactttgcccccagtggcatttatttttctacaggcaagttgggacccacatcttagactgccatccataggcagagataatttaaaactccatgttggatattttcatgtaagctctactattaacattacactctataacacaaaattggcttaggcaaacactttccattaaccaaacctaaacctttaatgctcccaattagctgaagagacttcttgagtcaccatttacttctctctcaagggtccctctattagttctatttctcaaatatttatagtgcagtcccccttttctatttcatttgtcattgaattcagaccctcattatctcttacattttttgttgacctaattgttcactcccaggtgtatcacattcgtgtgtctcattttgcttttccaatgggtaatggtatgtattaaatggtatcttttagatatattcaaaaggtaatgtaacagttttatttttaagtgtcaacatgtacaatgttttagaaattaccacctttgaaatatttaaactaataaatattagatggcatcttaaaaatatgtagggctgtcaacggtttttcaaaatacttttgggggttagaaatgcaaaagcaatgaaaaccactactctacttctattacaaatcttttaagatacatgttattataaccttgaaagtgctgattcataccatgaatattatttagttaatattaataagcagaattttatataacatttaatatttttatcagaaagtaattttctaaattaaatggttataaaaatacagtattttaatgtaaatattttacaatatcctaatttctccaccaactttttcattgtaaaattttttgtatattatataaacatgctatatatgtatataataatttttgtatataataattacagaaaattaccatatacaccatatacacatatagcatgcatgtttagtaaagacaagaaaaaattagcctactatctgactactatatttcctctggaagaagctatgtttgttcaagaggcaatttgacattttatatttgcaaaagcttatcagcaaatatcaggaacaaacatcagatgtgagctagcaaagacaagaaaacatcaaattcgaatgaggcagcttaataataaaacatatagcagggtacatatcacccatggggtcatagccaaacaatttgaagaggaagagttaatatattttaatagtcacctataacttattgtagtgtattcccatactgttatccaaaatttgtagttaacataaggacagaatggaaagaatgaaaggacagaatggaaagaatgaaataagtgaaaaaacccctgaaatattagaaatcttccaaatttaataaacataggtatcttgaagtaggtataccatgttctctggacctccacatagcaagaccctggagatagttggtcagggtgctcaatttcccaaaatatataaagtttgaggcaattttattttaaatttcacagggacagaatgccttcagtagatatgacttatatataattagcctgactgaaatgaaatgaaataaatactgtgttaattaagttaattttatttctatagtctgttgtaaaagtttcctttggtaactgttaaaaatgtgttgtgattttaacagtcctctgcatgaagtacagtttaaataattttgtaaaaatgtgatattaattggctaagacttccaaagcaattataatatctgtgggtggtttgaagctgatactgatcattgatgcttcatgaagtttaataaaatggtactttttttgcctgaatacattctaagccagtgagccatgtagtaccactttttcagcaacacttacagaattcatacaatgttagttctagaaagaattaagtatcctttcatccaactgcttctttttactgataaagaaattgcagtcgagagaatttgaataaattgttcaaacaattatataacaagccctggcttgtgagacaatcttgaatttatgtctccagcttcctagtttagtacatactcatttcaacacaaaacactgccaaggttttagtgaaaaagatatcagtaattcattaccaattatacaagttgcaaaattaaatcaaaatatctcagaaattcagtagaatattcaataattatttcaagttcattactaaatatgtagtcatattacagagtaattgcaggagaaaattaatataaaactatgttatattttttatttttgttaatttaatattcagctacattttcatgtatgatcaaaatttatttgttatagaaaaccattcaatttcagcaatattttataaagcatagtatctcttcggaaatatataacaaaattaagactatcaatctccaaaagttaattctgcagttttttttatctaaagaaaaccccactttccaattgacaaccattatgacattgtacacagagaatataaaaatttagttaactaatgcatggcacttaaaactgtgaatcagattcaggtttgctatgaagttagagtaggtagataggcagataatagtagggcaggatagtgccccaagtaatgtcaggtgactgtcttgtaattgtcaggtggccccttaattgtgggccacaactcccaataaaatcctaagaattgagcaaacatgtggcagatgacatgattgtatatttagaaaaccccatcgtctcagcccaaaatctccttaagcttatgagcaacttcagcaaagtgtcaaggtacaaaatcaatgtgcaaaaatcacaaacaatcttatacaccaataatagagagccaaatcatgagtgaactcccattcacaattgctacaaagagaataaaaatacctaggaatacaacttacaagggatgtgaaggaccgcttcagggagaactacaaaccactgctcaaggaaatgagagaggacacaaacaaatggaaaaacattgcgtgctcatagataggaataaccaatattgaaaaaatggccatactgcccaaagtaatttatagattcaatgttatccccattaagtaatcattgactttcttcaaagagttagaaaaaaactacattaaatttcatatggaaccaaaaaagagcccatatagccaagacaatcctaagcaaaaagaacaaagtgggaggcatcatgctccctgacttcaaactatcctacaagcctacagtaacgaaaatagcatggtaccggtaccaaaacagatatacagagcaatggaacagaacagaggcctcagaagtaatgccacacatctacagtcatctgatctttgacaaacctgacaaaaacaggcaatggggaaaggattccctatttaataaatggtgttgggaaaactggctagccatatgcagaaaactgaaactggaccccttccttacaccttatacaaaaattaactcaagatggattaaagcttttaacataagacctaaaaccataaaaaccctagaagaaaacctaggcattaccattcaggacatagggatgggcaaagacttcacgacttttaaaacaccaaaagcaatggcaacaaaagccaaaattgacaaatgggatctaattaaactaaagagcttctgcacagcaaaagaaacgatcatcacagtgaacaggcaacccacagaatgggagaaatttttctcaatctatccatctgacaaagggataatatccagaatctacaaggaacttaaacaaatttaaaagaaacaaacaaccccattaaaaagtgggtgaacggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggtgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagtgggtgaaggatatgaacagacacttctcaaaagaagacatttatgtggccaacaaacatatgaaaaaaagctcaccatcactggtcattagataaatgcaaatcaaaaccacaatgagataccatcttacgccagttagaatggcgatcattaaaaagtcaggaaacaacagatgctggagaggatatggaggaataggaatgcttttacactgttggtgggagtataaattagtgcaaccattgtggaagacagtgtggcaattcctcaaggatctagaaccagaaataccatttgactcagcaatcccattactgggtatatacccaaaggattatatatcatgctactataaagacacatacacatgtatgtttattgtggcactgttcacaatagcaaagacttggaaccaacccaaatgcctatcagtgataggctggataaagaaaatgcggcacatatacaacatggaacactatgcagccataaaaaaggactagttcatgtcctttgtagggacatggatgaagctggaaaccatcattctcagcaaactaacacaggaacagaaaaccaaacaccacatgttctcactcataagtgggagttgaacaattagaacatacggacacagggaggggaacatcacacaccagggcctgttgtggggtggggggctagaggagtgatagcattcagagaaatacctaatgtagatgatgggttgatgggtacagcaaaccaccatggcatgtgtatacctatgtaacaaacctgtacattctgcacatgtatcccagaactgaaagtattaaaaaaaaaaagaattgagcaaacatattcaggcatggccagtaaagggcaaaatgttggaatttgactttccttggggacatgtataggtgtttacagtaagggtcaaaatggtggagtttgaccttccaccagatgcactagactggtaagggaaaatttccccaagagagcatgcctgtaacttcaaccaccaagtggcgcactcagctcctccagtatactggcaagtcactgagcatgcggtgattagccaacagctcacacaaggggaaggatgaggggacaagacctcgaaaaaaaaaagaacaggaaataacaattctttaagagccttgaaccaacaatcaggtagggcactcaatctgttgagttgcccacttggtttcttccaagtgtgtttttctttgcatcagtaaactctcatttctgccttaaatctacttttgtgtgttggctgaattctttctctgaacaagacaagaattgaggactgcagagtctacccagacttgccaccagtaacaaaagttaaaaaacaaaaacaaacaaacaaaaacctctatatttaatcatggtgtcatcagcctagctctatgaccttaagaagctaacttaacatgttagagcctaaatttcatcatctaaaaagtaagaaaattatacacaatgaattcagagtttccttcttctctaggtttatatgatttagtagtttaaaaaatcatatccaaagagttagctcagaaattaacagaaagtacaaaattacaatatgactgcatttttaaaaatcaaagaaaatttgtttaccacagaaacataggttaaattacttagcacatcatcatgattttaatatgtccccccagatttcatgtgttggaaacttactccccagttcaagtgttggtagatggggccaaataaaggtgcttagatcatgagggctctgccctcatgaatggattaatgctgttattgtgggaatggattgttataaaatctagctcagtcccttcttgctcttgccctctcttgtccttccaccttctgccatgagaaaacattgcaagaaggctgtcaccagatccaggcacttcaacctgggaatgcccactcttcagaactgtcagaaatatatatgtgtatgaataatatatatatatacatatatacacacacatatataatataaacatataaattaaatataagttacctgttctaacagatacattttctaaaatggtgaccaaaatgaaatgaaaaagtatttatatttgtatagtaataaaagagaagtaaaaattttaaattataaattgatgtttattaaatatatattattagtcaacattctatctaaactctgtagtctaaaaagagtaggtaataaaaatgatgcagctttttaaataaggccagatgatcgctgaatgtcttctaatattccactgaaggattgcttcaaaaattcaagtccagtaaggattatttaggtttctaggaaatgtatcattattttatttttcatatttgctattaatgaaagccttacacttggtgaagttatatgttaacctctagttttcagaccaattaaaataaattttggtagtaaaaaagataaaccctagcggatttatagttatgcagggttttaaccagtttcttttctaagctagttatattattcaaatactgtctttgaatattgctcccttaagtgggcctctctggacccttaactgaactcataattgcctaattagcttgctaatgttgtggctcagaaaacaataccccaaaatatgacattttgacatgctgaactgaagatgaagctcaggttctctgatttttccccacctctccatgtatctcccacagatgttgaagtttccgttttcccacctagaacaagaattattttttcttccccctccctattacctcattatctattgcagaaaagaagatcaagagtaacaactcctgaacaaacccttttacaattatgatgactgtctctgaggattatttaaatccccaactgaactatttacaagttaatctgtgttcctgatccatatccattcattcctccctagaaaccatttattgtccttcaatagaattcctcttctcccctctcccataacctgttttaccagaatctgagctcccactttctttttttcttttttttcttttttttttttgtaacctcaagatggtatataagcttcctcataactcgttggaaagttgggtcttcattttaaaggcttctgtgtatatacactaaatacatttgcatgccatttttcttatcagtctatctgcctcatgtcagggatttttcaatgactctttaagggaccaagagcccaaggccccctcactagctatttaaacaattaaataaactttttaacacatgtttatgttttacataagtgaaaattatactttaaattaaaaacagaaaataatagcaaaagagttgagcatgacttttcaatgacaaaattagactaggaaatttctatgtagtcatgtcctccaagctgcttttgtttcgaaagtggctcacttatttgattttctcaggagaagcagttgagaaacagtgctgtgtatgtcaggctgtcttttctaattgacaaaagttactcatgacttatctcaagaatacaaaattgaagaattagagacaaatgtacgtataaaaaacactgatgaaaccacatttgcaaaaatgatcacagtgagaatattatgacagtgaaagtgatctgacctgagtccatcttgcctctaacttccaaactgtccttgttcatccctgggcataggccaaactaactttgtgaggaacttagtttacaatttaactttgagacaacgatgataactgtcaggcctctgagcccaagataaaccatcatatccccagtgacctgcatgtatacatccagatggcctgaagtaactaaagaatgacaaaagaagtgaaaatgtattgttcctgccttaactgatgacattaccttgtgaaattccttctcctggctcatcccggctcaaaagctcccccactgagcaccttgtgacccccgcccctgcccagggagaactaccccctttgactgtaattttcctttacctacccaaatgctataaaacggccccacccttatttcccttcactgactctttttcggactcagcccgcctgcacccagatgaaataaactgccctgctgctcacacaaagcctgtttggtgatctcttcacacggacaccagtgaaaataacagtttttcgaaaacaaatcttcttcttgcctggggaccagactgccattgtaggactaacaaattagctacatgattacaaattatggcttaggagccatgcagctggtggccacaagattccgaacctcctcagttgttcccagggttaacaccactctcctaaaacctaagattggtgctcaagatattcttcagactctgcactcagtggatcagttgcccccacccaaatcaataaactggctcatctggttttgtggtctcaacccaggatctgactcaacacaaaggacagctttgattccctctgattttatctccaacccgaccaatcagcaatgctcactccctggccccctacctgccaaattatcctcaaaaagatccagtctctgaattgggggtgagactaatttgagtaataataaaactcaggtcttcctttcagactgctctgtgtgaattaagctctttctctattttaattcttttatcttgataaatcagctcaatctaggcagcaggcaaaatgaacctgttgagtggttacactgatgtggaaggacaagggagttggaatgagggaaagaggagtcagccatgaaagaaagattcaaatattctaagtatggactcttattccaacctcaatgcctggcaggttttcagctctaggtgtgtggggataggtggaaaataaaaaataaaataaaaaaaagttattttcctctagggaaaaagtaaaaggtattcaaggggatagatttcctcctccaattctgccagtatactcgagattactgaacaatttccctaccaactaaatgaagcttgcaaagaaagaagagcctagacctttcttaagaatagtaatgaattagcatcataaatagcctatgcagaaaacatgctgaattatgcttagcaaataggttctctatactcttcaatgatttactaggacgttttttgggaactcatcagcaagtcattttgaagttattatgctgtgattaactgctgtgccatttttcccctcaaaattcatgaaaaatgcagagttactatctacttcacccactgtatgagtttcacaactgacttttatcatgatctctcatgctgggtttatagattgcttgaactgggggtgagaactcctgctgatactgtcacagagcagtctagttaggttccactaagtgaatctgttaaaactgtcaacaaaaaatagccaataacttttaagataaacagagatggactctttcctacagtgtatctagaaatggaagctgaataaagtctcaataaaaagaaaggttttgtttattttcattcctttccttttgcattattgtttggactgcttctggaaacttcagccttagaaataaatagaagtgaataccttttaaaatgaatgtcttcagtagattaaaagtaactgaagatttttttcaatgtattttttacttgctcctttgtttatattctaaaagaaatgtacttggaggccatatgttttagaaactccattacacatgtacatttgtttctcgttattcacatcagttatgttctgtaaggttgccataaatactgaataattgctttggtggggcgggagaatatatattacacatattatactttagaaaaacaatagttttcattctatccttctaggctttcagctggggcatttgtaaaaaaagacagattaacaagagaaaaacaaacatgtatatctcatacatacatgggagaaaagacagggcaatcaactctcaaaggggtagctcagcatttaaacttaaataccatcttcagctaaaatatatatatataaaaagagaaggatatctgagaggtaagttatggcaaggtgaccatgaaaaccaaggtgaacaagaataaaagttgataggcagatttacgtcagtgccttctccatagataaaattaccttgtgatttagagtcatatactctttctggtacagagaaggatagacttttacaaatagaaatttcctttataaatatacttttcccttataaaagtgtaatttctactctggctttagagtttctattatatctgctgtttctcaaaataatcttctaggtcaaaaaaagtgtatattttattttgggatgacataatctggtctcctatagccatagtcccgggtaacatattctgatccactataatataaattccatgtactatgatcagttgcatttctaaacaacaatagttcgataatgaaatttttcaaatgcttttgataaaaatgtataatgcccaagttcagtctatatagaaagcttttataaaaaacattttttaaaaaaccttcgaaaaacagtaaagaagatccaaatcaatgaaaatatatgtttatggatatagggtttaatacattcaagatgtcaattatgcctaaatttatcaatagattttaagaaatttcaatcaaattttcagcagatcatttgtaaaacttgaaaagatgtaatgagatgcatatggaaaggcaaaagcccaaagttacaaacattaaataattttttttaaggaacattacctaaaatgagaaaggaaaatcttctctggtgaatatcaaaacatgaaaagctatgcttgtaagataccataattttactccattaattccttttaaatcaattcatgaaacagaatatggcgtttaattattgaataaatatgacagtgtagacaagctggaaaattatagactcttcaataaatcatgctggaataactgtatatccttacggagatacaaatttatatagcagtctttcatattcaaaaatcaatttcttgtaaattaaatacatgtatgtgaaacataatgttaaaaacttttaaaatacatgtcttggttctagatagagaaacagttctttaaaaaggcacagaagccaaaaataataataaacaatgttgttaagtctcagaaaatacaaatcataagtaaagaaaattaaatgataagccacaaattagaagaaatttttgtcacacatgaaaaatcgatgtggggaaggataaattatatttctttctactagttttatcatatgcaggggaaatgaaattaaaatatacagtcatgtgccacataagagtatttcagtcaataatgaaccgtatataagatggtgatcagagcaacaggcgataccatgtagtctaggtatgtagtagtcagtaccatctcgggctgtgtaagtatactcttggatgttcatacaataatagcaaaattgtccaacaatgcatttctcagaatgtgtaccttttgctaagcgaaacattaatatatttatatatgtactcccccattagttttatgttttatacaggaacatctattttaaaaattgcaaaaaaaccatgattaagcattttaaaaatctatttgcatgctttccattaaacaaaactacatttttctccaggcagcttatacctgctttttgatagatgttatcaagacaattgatgatttacttcaatgggctgaggagataattccatggaagctcttaaagatctaatatgtgtgcttctgaaacatctataatttagcctttatggttatgttaatataggcaatgagaatcaggaaattcaccttgggagtgatgtcacaaagattgcggagtgggcatagcagctctcatctccccctcagaaaaactatagacagctattcaaaatcaaaaataggccagagagggctcaagagctcattaatgaatctgccacaacatgttgaagcaaaaatggaaaacatgtatatagaaaggatcactgatgagatcagaatacgcaagatgtcagtacaagcaaagaagaaatgtaaaagctactggtatcagctacatggtcggaaccactgtggtctccacaagtctgctctgcaaaggagaccagcatcttttgccactgaaggaatcaatagctatcctggctgaggaacccagagagggagacgccactgtttactcttctcccacacaagaattggctgctgttcagtcacctcaggaaagaaacttcttcaggaaaagaactgccacagatacatgcatatgttcacgcaggtattctgtgcaaaacctgaccctgaagcccagcctccctgtaagtgcccatgtttcagctccaggctctgtggctgtactggtacagcctacctttcagatactggaaccacagctataagatgttagtttgcacacataggctccagggccaaattcttgcagtatatgcccatgctttgaacatcagcccagctgtgatgaatacctgtttctgaagctgctctaaacctgcacacacctgcattcccattctcatcttctcaactatttcatgagtatactgtttcatgatcaccttgcatactgttactaatgtggcagtgtaagcctctatgacccaggcactagctcagctgcctagagagttaagcagtatcctagtcctggggctgctctaacactgtgcatgcctattctgtcattcttggcactctggctagttcacaatcatccatgcctcacagacagtaaccaacatggcagtgggagtccctgcgccctaggcactagtgctattactgccccagttcccaaaactgtagtttctccacacattctcattctttagtcctcagctttgtgactgttccatgtgtgccacccagacatcggtgccactggcacctctagtgggaccctaaaccattccgagtgccaagagcaacccactagctacaacaaatatctaggtacaggaaagtcaaaggtctccaatcaaattcggtccaaacaagactacacaaagacacgatataatcaaactgtccaaaatcaaagacaaagagaaggtcctgcaagtagcaagagaaaaaaagcataacacataagaatgtatgtacactgagagtgaaagaatggaaaagatattctatgcaagtggataccaaaagagaacaggagtagctagctatgcgtgtatcaggtaaaataaactttaagtaaaaaactctaaaacaaaacaaagaagggcaatatataatgataaatgtattaattaatcaagatgtaatgattgtaaacatatataaccaacactggagaagctaagtaatagtaatatatctgaagagagaaatagactgtaatacaacaatagtaggagtcttcaatactccactttcaaagatgggcagatcatctggacagaaaatcagtaaggaaacatcggacttgaactatatgctttagagcaagtggcctaacagacatatacagaacattttaacccacagctacagaaaacaaatttctctcaagtgcacatggaacattctccagcatagattatactttagtccacaaaagaagtcttaacaaatttaagaagattgaaatcatattaaatatatttttgaccatagtgttatgaaactaaaaataaatggtaagagaaatttcaaaaaagaatagaactatttgaaaattaaacagcatggtcctaagcaacaaacaggtcaagaataaattatggctggacgtggtggctcacgcctataatcctagcactttgaaggccaaggtgcatggatcacttgaggtcaggagttcgagaccagcctggtcaacatagtggaacctcatctctgctaaaaatacaaaatttttttgtattgcaagtgtgtattgcacacttgtaaccccacctactccgaaggctgaagcaggtgaatcacttgaatctgggaggtggaaggtgcagtgagctgagatcatgccactgcactccagcctgggtgacagagtgggacttcctctctaaataaataaataaataaataaataaatattgattaaaagaaaaaagtttaaaaatatcttcagagaaacaaaaatggaaacacaacatattcaaaattaaaacatttagcaaaagtatttctaagaaggaagtttagtaataaatgtctacaaagaaaaaggaaaagatcccagataaacaacctaatgtgacagacatatcaaggaactagaaaaagaacaatataaacccaaagtttgtagcatgaatgatataataaagactacagtagaaataaataatatagacatgagaaaagcaacagaaaagaaatcaaccaaattaaaatttgtgttcttttaaactaaacaaaattgactaacttttagctagaccaacagggaaaaaaaagaaagactcaaatatatgaaaccagaaattaaagaggagatattacaattgataacacagaaatataaaggatcttgaaaccactttaaacaattatacaccaacaaattggataacctagataaaatggataaattcctagacacatacaaaataccaacactattttgtgaggaaaaagaaagtttgatcaaaacaacaacaagtaaagagattaaatcagtaatgaatattcttccatcaaagaaaagtccaagacttgatggtttcagtgctgaattctagcaaacaattaacaccaattcttctcaaactcctccaaaaattaaagaggagataatacttccaaatggattttatgaagtcagcattacccaaataccaaattcagagagcacactacaacaaaagaaaattacaggtcaataatcttaatgaacatacgtgcaaattcctcaacaaaataacagcaaaaagatttcaacagcacactaaaaggatcacttactataatcaagtggaggatttatccttggatgcaaggataatttaatatatgcaaaccagtaaatgtgattcactacattaacaaaatgaaggacaaaagtgatatgattatctcaatgcatgcatcaaataagtttgaaaaaaatcaacactcttctattataaaaactctcaataaattaaatatggaaagaatgtacctcaacacaacaaaggccatgtatgaaaagcccatagctaacattatactaaatggtaaaaagttggaagattttcctgtaagatgaggaataagacaagtatgcccactctccccattttattcaaaaatagagttggatgtcctaaccagagaaattagtcaagagaaagaaataaaatgcatcctctttagaaaacaagaagtgaaatcattttggttttcagattacataatcttatatatagaaaaccctaaaaactccatccaaaaactgttagaactaataaattcagtaaagcttcgggatacaaaatcaacatacaaaattgattagtgtttccatgcactaacaacaaactatttttaaaaagtcaaaaaataagattattcaccacagctataaaacaaatacttaggaataaatttaaacaaagaaatgaaagactttgtatactgaaaactctaaacactgatgaaagatattaaagaaaaaacataaataaataaaacatatctcctcttcatggattagaataattaatattgttaaaatatccatactacccaaagcaatctatgaattttatgcaatttacatcaaaatttcaatgacatttttcacaaaaatagacaaaataattttaaaatttaaatgaaaacacacacaagaaaacctaatagccaaagcaatcttgagtaaaaagaacaaagccagatatatcacactacctgatttctaaatctattacaaagctatagtaatcaaaacagcatggtactggcaaaacaagcaaacaaacaaaaacctgttgtccaatggaacagaatagaaactccaaaaataaaatccatgcatttatggtaaatttatttttgacaaaatttccaagaacacagaatgaggaaatgacagtctttaaaaaatggcactgagaaaactggatatccctatgcaaaaggatgaagttagactctcatctctatctaaaatcaactcaaaataaatcaaagcctttaacataagacatgaaactatacaactactaggaaaaaacacagaggaaaagctccatgacattagtcagggtaataatgtttttggatataaccccaaagacacagacaacaaatcaaaaatagacaaagttgattacattaaactaaaaagtttctgcactgcaaaggaaacaatcaacacagtgaagaggcagtctaccaaattgtagaatatattagtaaaccatacatctgataaggactttatatccaaactatataaagaacttaactcaataatattaataataataaaagcctgttttaaaaaaaaaaaaaatggacaaaatacctgaataaatatttctcaaaaggagacatacaaatggctagttggtatgtgaaaaaaatgctcaaattactaatcatcagagaaatgtaaatcaatccacaatgagatctcacctcatgcctgttagaatagttattataaaaagaggaaagataactgctggagaggatgttaagaaaagggaacaactgtacacctgttggaatataaattagtaaagaccttatgaaaaacagtgtggaggtttctcaaaaaattgaaaataggagcactaaatgatccaggaatctaaccaatagggatatatccaaagagtatgaaatcagtatgtcaaagagatatgtctacactgcactttttgcagcactagtcacaatagtcaaggtatggattaaacaggagtgtagatctacagatgaacagataatgaaaatatatatatatacacacaatagaatactacttagcctttaaaaagaaggaagtcctatcatttgtgacaacgtggatgaacctagagtacattatgttaaatgaaataagccaggcacagaaagacaaatactgcatgatcctacttacatgtgaaaactaaaaaagtcaaattcgtagaaaactagaaaagtcaaattcatagaaacagagtaaaattgttgttacgagaggctttggggtggaattcttgggaggatgttggtcaaaggacacaaaatttcagttagagaaataaatataatagatctattatacatcatggtgaccacagtaaataacaatatattgtatacttaaaaattgcaaagcaatagattttgaagtgttctcagtattaaaaaaaatgataagtgtgtgaggtaatgcataggtaaaatagcttggttcagttatttcacaatttatacacataccaatacatgttgtataccacaaatatatacataatttttacttaactaaaaattaaatttacaaaaacagaaaagaaattggactcatctttcacatatttaatttaatcttgcaacaaaataacctcataaaaaattgaggactataactaatttattaatccttttataaaatgttcttgcatattgactgaggcattaaagaagcacaaagattacaacgtaccccattctcttatggtcacacagtatttaattagataattaaaactgtttagtatgtttctagtttaaattattttccaaagctgtgtaagaataaatccagcacacaaaagaaaacacattttgtccagttacttttgctctgactggattaagttttcttcaaatatggcagtgacctaatggccaactcaactttgactaatgagaaacttttgacgattattcgtttgcctgtatacatgtgtttttttgttcctttcttagggaacttaagcatacttgaaaatagcaagtacttaaaaaacataagccagttacaagaatcaagaagatacaacatatattagatttagaaacttgaatatgaggcagctttatagacattgaaatacaaggatttccaaagtataattttagtgaagaaaagggggaatataaacagtatgctgatatttgtacagaaaatacatatatttacaatatatttctggaaatatatatcagagacggcaaaggtctttgtgtattagccagctcggctgccaaaagaaaatatcatagactgggtggtttaaacaacagaaatacattttctcacagttctggaagctgaaactttgagatcagggtgccagcacggtgaggttctggtgaggcctctctttcttccttgcagatgaccatcttctccatgaggccccacgtggccttacctatgtatgtgctatggaggcagagacacagaaatctgtctctttctttttataaggtcacccattctatcgagttagaaacccacagttataatctcacataaagttaattacctcctaaaagccctatctccaaatatagtcacactaagggtaaatgttgcaacatatgaattttg
